United States Patent 7,868,149 (PLANT GENOME SEQUENCE AND USES THEREOF) - sequence listing, part 17

SEQ ID NO: 8155 - DNA, 21578 bp, Oryza sativa
ctttccccacgccgggatcgagctccggggaggggagctgcgagctggtacgtacgcttgatttctttccttgccaccgcgatattccgatgtatccgtgatgtgtcgttcatgggtagatcggctagggatttggcggcgttgaggaaagcgatggctgaggggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaaaggcatctagagctaggctctttaaggagtataaggaggtgcagcgagaaaagtcagctgatccagatatccagttaatctgcgatgattcaaacatattcaagtggactgctcttatcaaggtggtttttatattgcaacttgcaaggtgatgctagaaacagcaatataagtttttaactaatgccttttctgattgtatatgttgttagggcccttcggagacaccttttgaaggtggtgtatttcaacttgcattctctattcctgagcaataccctctccttcctccgcaagttcgcttcttgaccaaaattttccacccgaatgtgcatttcaaggttacttctgcattgccttctctgcgtacattttactttaggaaatttgacctatttgaaggcatttgtctctttcaagtgttggtgagaatgtaaatatgaagttgctgtcatcttcttcattttatcaggttttcctgtaacaatctgaatgtactaacatgacagaatttactgtgtagactcaactgtgctcttcctgttattgtttttgtcaagtcgcttctatattgttacatctgaattaacagaattgaaggagtaatttcagttatcattctttttaccttgtttgtgtttccagacaggtgagatttgcctggatatcttgaagaatgcgtggagcccagcatggacactacaatccgtttgtagagccataattgcattgatggcccatcctgaaccagacagtccacttaactgtgactcaggtagctccaccttcctactaattctgccacatatagttcagccattattttgtaatgtgaaagtaatagatgttcatgctctcactgaatcaagctatggtgcatgaagatttccatcttcgaggcctcaaccactccatgatgtgatctttttggagtagtttgagacatgaaaatatttggttctaattattgtcacatggtacattagccagttaaaaaatatggagaaaaacttggctatttactctaatggagcccctctatataaccaaaggaattacgtgataattgatatggtcagactccagtatcaccgttgtcctaggcgagggccaatgagtcccaggacgaggctgagtccacctcgggtggcgggtgtgcttgggatgctgattagattagttcgttacattgaaatagtatatctttccaattgttatctcttcccagttagagtccaacttgtaagggccattaaaaggtgtttgctacatcatcgcgagtttcaagttccttgtcctcattctttttatgcctcatagttccatgccgcctactctcctgggaagcctcatcatccacatgtcctaatcttccgcacacaacagaagaaactgatttatgtagttacaatatttaattttgaggcggtcagagaaaccattcctgctgatccattttacgcaatatggattgaataattgccttgtaaatatttcattgttggttattagcatttatactaatgagctaagatgtgcagtgtcacttatattgtatagttcctcattatgaattagaatgtaattttcccagtaaatttgtattggtcccattcaccgcctcacggtttatgtttgagattttttcagatggcactttggtcacattgcatccaaaatatgattatcataggtcaaaattatgaattactgtatttgataacttagggagctcttgtgtaatttcatcatctgatgatcatatacagtttgtcgcttcaagcattttgcaagtccgatttctgattgattatatagcggtttaaattactttttcatactttttacttggttgtttgaaaagaggcctgctgtgatattttaatccttatcttagtttctgctaattttcttccgtaaatataggcaacctcctgcgctcaggcgacatcagaggctatcaatccatggcaagaatgtatactaggttggctgccatgccaaagaaaggttaactccagggtgcaaaaggaaatatgcgccaagcgaaggcatggctgattcatgtgatttgctctgttaagtgtaactcttactgtcaccatgtgaacatctggtacttattttcttacctcactcttatggatgtatgccctggagtgaagagaagaaaaacatgcattgtaatgcttggtctatatgatgtcataaatataactgggttcggtacttctaatgcactgtccattgttcaattacttctcctctttttcctgtccggataaaagaagaatacttgtcctgtatgtttctgaaatcgccatacggctcctataaaacgccaggttagagccgcactactctaatcttctatgatgctgtcacgccgagaattcctttcatatttgctggtgttcagtttaattaacgccgcacacatacagatcacccgttgttgtattgcgagcatcgaaatcaatcaacactatatatgattttattgttatcgattgttccaatcgaatttccactgtgttacatgacttggagtcttggaccaaagaaaagaaaatttcctgatcagttggtatcgctggaaaacaacctagtgggcgcacgacgcccgttcctcgccatcgttgaagaaggcagactgcatgcgagcgactaggggaacgccgtcggaggcatcttcttgtcagccaagaagtggctgaagaggctgagcgcctgcctcggcgcgtgcaggggaacctcgtgcccggcgccgcggatcgtcacgaacgtcaggccctcgtagaggatcgtccatcctccaacctgcataaatggttcagtttgatgctcacaacgacctgtttctgaatatttctttgttgtaggatggtttaattacctgctgatggtcgtaccacggcgtccactcctgcaccgtcttcagcccaagcttgttcagggtgagcctcgtcgacgtcacggggatccttccatcggtgtcaccgctgcacccagtgaaactcattgtcagctcaattcaaacgccatgcatctattgctgtgtacacgttgttcagacatgctgaagtatactacaaggatgtttttttcacctgaaaacccagaccctgatgccgccggcgacgagcttacggatgatggggagagtcgagaagggagcatctctccacttgccgatcacgtcgctgcaacaaacacaccgtcacaaaacgattctgtcaactcaaagcttcaaagactcaaaagagaacagaggttgcaaacgcttattgtttgcacctgcagtgcgtccagttgtagccgatattggtcacgttggcgtgcagcgcctcctgcacgtcagcccggttgaagtacacctcggcgtgatccgacgtgcacggatcgtaccccgccggcctcatgtaccacccatgctgttacaaaatgacaccaaaaaaaaatcatgttgtttcttctctctgaaaaaatgtgatcgttctgtgtgccgatgagttgcctacgcacgtatttggagaagatttttggggcggcgccgtggacggcgacctggcgctggccgaacgccgccgacgacgagacctcggtgcagacgggggtgtagaggctgtacatgtcgatgaggcggtacacggcgaagtactcggtgagcgcgctgtcgcacgcgtcggtcacgttctccatgctgaagttgcagtacttcttgacgtcggcgtacacccggtccgagatgacggcgtggtcccaggcgtagtcgatcatgcccgtctggtccgtctcgtcgtccatcagggcattccctatctgcgtcagagtaatgagacgacgtgatcgaagaaataaaattgtatgagatcagtattagttcgaggcagaattgtgtagctaccatgaaacccttgaagttgatgtagttctccttggggccttgcttgttgccgtcgaaaatcttctccgaaagctgtggaacgtaatgccctgacaataacgcaatccgggaataatgagctcgcatcacgattttttcagaagctagatgctgaagtgtgtatgtgtatcagttcagttaccagcgtagctctctccagcgatgtagaagtcgtgagatttgtactgagggaagcgcttgaaccagttgagcaggaagatgtaagcatcatcagctgcgtgcatggcaatccgagttcagatactgtttggatcatccaaaattgaccccttttttttatcagagtattctgttgttgatgtagaggttaatttaccggtgatcttgtcgccaagctgctgcagatcggagcttgtgttagtgtatgagaagccgacacccacaggggactccaggaacatcagattggcctctgcagatttttaacagtgaacattcagttgtgccaaaaaaaaaaactctgaacccctgttcattgcgaggagtcagtgacagactaacagaatgcagggtttggcatgaacaagcagtacgtgcctttgttccacgagtacttgttccattttagctccggcttgcccttctgcaccaagaatggaccgagctcctccgcttctccatacccaacagacgaacacccaggccctgcagcaaaaacagcaacatttgtcatcctaactcaaacactcagtacacactcctgacgaagaattacacacagggtttttaagctactagctcataatcacgaacgaaaagagagaaaaaaaaaagaaacttcacatgcatggtgaacgtcgaccgttaaaacgttgcagagaccagtagatcagtcgtgtccatcccgcgcgagagacaacgacgcgatcacgagcacgagtacgacacggcacgggtcgccatccagtcataggccacaccacagcggaagcagcagcagccagctagcttagctaatggaccgaattattcgcgcatttctaacgagaaaccgagcttagacacagctcactttcgcgctcccgatccctttccggcgtcctgcctgcctgcacgtgaacgtgatccatctcattcgaccagttcacggcgtgcatgggtgactccgcgcgcggcacagtacgcagccacgcgcgcgcccggtgagatccagcaccgggccaccggcacaggcgcgcacagccgtggcccccgtgggcgctcgcgtaccgtcgtttcagatattttccccggccggcaaggcaggcagggaaggcaagcagcggcagtagtagcttcgatccgttccgtggtggggcgcgcccgcgggttgggctcgatcgggcacgcgaggtggtggccgtgtcacgacgcgcggccggtggtggcgcatgcttttgcttagctggtccccgcccgtgtagcatgcagcagtggccagcggtgtgtagtagcgtacgcctccgcctcagcgcgccactgctcgctatagaagtagcgatgattggtggccggtggcccggtgtgcgcgtccgtcctcctcggtcgcgcgtgaaagcggcgccataccgaccgacccgctttgtttcttgtctccatgtacatgatactacgtggaccgttggtgatacggtgcgtgcgtgcgtgcgtgcggccgtgcgctagcgagcacccccgtgcagtcgtgctccgtatgcctttccgggtcgatgggtacgtacgcgtagtgcggttccaacttccatataggcagaaacagaaggcgacgacgagtgaacttttctacccttttactcttttagtctctggaagcttgctctgagctatatatgtgggtaaaagggaatcggcggcaccaacagctgacggttgttcgtttttcacgtgtacgtttccaaactatatgtacatttttaaaaatattttctgtagaaaagttatttaaaaaaattacgttaattcatttgttaagtttgttttaactaatccttaattattatacgctaatggatcgtttcatattacgtgcgaagagatggaggttgccccaaccttcacctctaaacacagccaacctctttgttgacctttagaattttaagaagtaattggtaaaaaaatttagctggtgagaatctagaaaagctataaattctatctatttattttctaaattatataactacatatttttaaaacctagataaaaattagactatttatgaaaagttttagttttgaaagaaaccgtagctaccataaattcctaaaacaagacctaaacaagcttgttttggtctcctctaaaaatattaaataataggttaatactgcacacaacagggccaagtttcctttaaaaaaaagaacaacaacaacaagaagaagagagcgcaagaacagtaagtgtctctcctaaccactaatcggactttgtcggatggtgtgtaattgttctttcctaacaaatcccaactaacaaccataactacatagaattttcaacgttactaggttctgactgacatatcacagatgcttcgacgccttctgattgagtgcaaccaaaaaactcaactgatgcaagcaagcaaaatgatataagcccccagaccacctctgccactttgcttcagatgctggcaaaaaccgcgcggcttaattcagatcccgatgaggatgtgaattgtgccggaagatcagcttatcgccgggaaacggacacccgcgaggccccattggctgcgtggatctccctttgttcccggagcaagctagctgctagcctggctcgtgttgaccatgccaagcaggattggctatccctctggttgctaccagcaaccagtccaaatgcagaaatccagcagcatttcgttctctagctgctgctgcagctagctcgcatggatcgcgcccatccttctcgatcgaacgggggtattcatgcagtccatatcgtggggggtccccgggcggcttgtcttggaccagctgctaggagagtacgatatgctcttggctggacagcaaatccgtctggctagcgagctagctcatcgatcaagcggatggattcaccggtacgttcgtgaggatgagcaggccacagtgacagtggtggacctcgtcagacttgttctgtgctaacttgaacgtgtatttggctaatttttcaaattggaggtgaatggggctcggtctgtagtataattgaactgggacaaacactgaactcaattcaaaacttaatcctgccttctctatctagtagattaacttatctcatatagcaaaaaactgaggcaccacaaattatactctggaccgtgcaaactttctcctaaagagaacaaactagctagttactttccaacccttcaattttccaactcttcgtctccggcgctttcgactgggacggcgcctcagagcagctacatatgtatgtgtcctctagttgtgttttgttactctcgttctgatttttttctaaagagaaacacggagatgagatgttgacatatgcaacgaataattacaatatgcgctgttggatgagattcattcggatagagtgaacattggagggtttcaggctgagtttgagaaagaggagatagagaagattgggaagatacgtaaaacgaggtgagctattagtgcatgattaattgagtattaattatttcaatttcaaaaatggactaatataattttttaaagcaactttcctatagaaaatttttataaaaaatacaccgtttaatagtttaagaagcgtgacgcggaaaaaaatgtgcattctatctccaatctcccagaacgaacgctgcctcaatcacaggtttttggaagccgttcaggggaacgcccggttttggcctcctaaactagttttagcatctgaaccgttatggtgcagacaatgattttcttttcagattttctgatagtaattttatttttgaagagttttagacaataaattttttgagacaatttacatttttttaaaaaaaggataaaaaagatgaattacatcaccagcctctgcaactaagatacacagccaattgaaggcgacgagttgtagactaactaactaatatttctttttgttacgtaggcttcaatttgcacaggaatattctggccagtttttgtgagcaatagccaattctgaatccggtgatcactgacaatggcgtacctggctcaaagctacggccggagctgggttacgcgtgtggctgaatattgtttggcaatgttatgcaagttggtcaaataaatgtgataagtcgactgtacattagccattgaaagagactctacgcaattaaggtgtactcttttcgttctaaaatataagagattttgggtgaataagatatattctagtattacgaatctgaataggctctctgtccatattcataatattatcatgtgtctcatccaaccaaaatcttttatatattttaagatggagggagtaggagtatgtgactaaagtaggtacttcacttgagttagttataatagcatacagactattactccatgaaactgccaatagtgaattatgctagctggaggacaaccatttgatgggatagcagatggctcctcttttcgcttgaaatgctgattaattgattggttagttgggcatggtgattgtactatgatagacacttgaaacatgcattcacttacgacatgtcacaattcacacatactgatattgtcatctctacccgagcctcttaatcactacgatatcatcaatgtatatatacttcaaaacattaaagaagaaatgtctagtttgagttttagaggtaacgagaagatcacatcttaggattagtcgattagatcattcccagcaacatttttatagaaaacccagtatcatttttgtgctccagaaaacctttaacacccagcgattttaagttcttagggtaattttatcatccttaaaaagatactagacgtactactctttttagtataaaatttgctgtaaaatcttcgtacctccagatactttctcaagaagtaaaaaaattctctcttacgtaaggtaaaaaggtatcatactttttaatattaaagatacctggcacacaaaatttcgcactaaaaataattttagaacatttcggaacttcgaattttccttaaaacactccgttagaaaaaagtgagatcgccattctatcttcattcgtaattaacatcaatataaatataagaaatgttagaatgacttaaattgtgaaacagagggagtgattaataccgagttaatgcgcacacaaattttgtggagcaaaggcaaatggcagttggtggtagaagtggttaattgtgtgtcgagtgctagtattacgtaccgccgttgagccagaggacgaggggcttcttgtcggcggcggcggtggcctcgaagaaccagtagaagagcgcgcggccgtgcgtctcgttcaccgtcacgtacccggcgtactgcgcgaaccgcacggcgggttgccccggcagcctcgtcacgcggtcggcctcctgctgccgcgcggcctccgcgtccagctgaggcgagccgccagcggccgcggcgcagagcgagagcaacgcgagcgcgaggaaggaggaggagacggcggcagcggtagcgccggccattgttgtgtgtggcgcgctgtatagctggtgcctaccgtaccgcgcgctagctgctgccggtgcatcgtcctcggcggattatatatagagagagcaggagcagtgagcacagtttgataatgacaaaatttactaaatacattgtttactatcgacaaaatttgatcaaataacctctttgtgatcgcattgacgacataggaaaaatcctcaattctaacggaggtatatgaccaaatatttaatatactgtaattggaataatattgcaaccgtatcctgcttacggctactccagtagagtttacatagccgaggtgataagtggagcgcttctaaattataaatgaccattcctcaatcctaggatatatgatactccattcgtcccatcttaaatataactattgttttctgcgtctaattttaattgtttatcttattttttttaaaaaaaaattaaaacataagttacgagtaaaatactattgatttttatcatctcataaaaaatactgattataatattttttaaataagacggacgatcaagttgaacacggaaactcatatttacatttaaaatagaacggagggagtagtacaggatgtttgtctgacacaccaacagaatttgggagaaaacgagaaagcaaatctaaaaattaaggcctgggtatgcatgtacgacacatatacacgtaaatggtgccgtatctaaaaatactaatcgaatgaaattgctcccaatcagaaaaaaatacaaaagttggtttattgaggacaacggatcgaaatacatactatgtgtttggtttatttaaactttagtctaatactcaaattaaaaatatcccaatgcttggacttcctgaaactcaattcaaaattgtgtttggtttgaccgagcaggaattttagaagatttttagttgctataattaaaaatacccctatgtttggttttatgtactcttgtgctcactctggttataaatatttagtgtttataacaaagttcgctcatacctttaaaattccgaacaccaataatttctcacatgcttaaatttaaaaactaaataaatggtttaaggttgttattgaatgttcatactaaatatttgttggtgctatctatactacttataaaataacaagttttatacttgattttcatacattttaattctttttttgcgaggtcatattttatttatgtcacactggagtgtcttttttttgctttgattgtcactagttaaagccctttaatgagtacatatcattatttgctttgattgtcaaatactctgtttcatgttgttattgtactctacgtatgatgctcgctgcagttaatcacatactaaattcgttgctgatacgctttttttttctccagagagaatcacatgcagtgctttttcagtaatttgagatatcacagcattttttttatctcgtactgcaaagcaactattgagtggcaagcaaaaattgttcataacttgttttgagggcagtacatattcgaagctgtcatgcagatatcttccgtgcttgtttactaacttcaggagatcataaaagcagtctctgaacttgacgttttgtgggtggatttagcgtgtgcagctaacgagtaagaactgagatcagtgttttttttttctgtgtacaacatgccaaaacattgcatggatgacggaaagaacagtattattttgagattcgaagttctggatgaactttgcgccggcctgacagagctttgccggacaactttggtcttggcttcgtcgttcaaaaaaaaactttggtcttggcttcgctttttgtttcaacttaaattttaagctaaattacagtaagaaggtgtgcgtgtgcgcagtatgctactacatcgttttgtccgtttggaaattacagagaatgcacttccaagctccaggaatcgattcggcatttcggccggcacatgtctttcctgaatgtttttgttttgccaaaactttttttttacagaaaattcgctccctgcaatttaggcaatttggtaaatcttgtactaagacaagcaagtcaggatgcttaattttagagttaattttgatgtttaatttactttttttattggtttttaataagtcgctaaaaacatatatatatatatatatatatatatatatatatatatatatatatatatatatatatatatatatatatataagttacattgataagtcatttttttccattaataagtgtgacggctgatagaaaacgatggagctgttaactgtcaaacttgtattgggaagagtagggccgcatataaaaaaaaattcctaagttatcaccagaaagatgggctatcaagattcaagcaggaagcaaattctgatttggtcaacagaatgtgtttttattctatgtgattagattgaatacatctctctctctcgtattccgtgcaaaggatgatgatattattttttttaaaaaagagagaagtactataattctagatttcttaagatactgcaaataaatatttcttcacaatgtttgtacttcaaaaaaaaaaaaactccacgatgataacctaagaattgcacatatagcgacatcatcactgaaaatgtagcagtttcagttgtgacttgtgggcacaaaccaaaccattcttaaacttaataatgaagcaaaatgtgatttggcctgaatatgtttgttctagatggttaaattcaatactatatctcaaaatgtaggcggtacaagtctactttttatatttgacaattaatacacgtggaaaacatgtaatttggttacatagaaatagtattggccatcattttttttcttgagtaatacttatataccttaatatgctattataaattgtacttctaaaacttcgacaaaaatctaaaacatcctattatttgtaacaggtgaagttcagcaattaaaaacatcccttatgctcgaagcatcaggattctttagtatgttttaaagaaaagttcaagtaagaaattagatattcaaggaagagaaggcacgttaaactaacaagtcaacagctcatctcatatgccggaccatttaggcctggtttaattcccaattttttttccaaaaacgttacattaaatctttgaacacatgcatgtagcattaaatatagatataaacaaaaactaattgcatagtttgtatggaaatcgtgagacgaatcttttaagtctaattagttcatcattagctataagtgctatagtaacccatatgtgctaatgatggtttaattaggctcaaaagattcgtctcgcggtttccaggcgagttatgaaattagttttttcattcgtgtcaaaaaccccttccaacatccggtcaaacatccgatgtgacatctaaaaatttttttttcgcgaattaaacaaggcctgaatcaatcatgatcgtcatcccctcaagaaatctcattagttgttgtcagtatattgcaatatcaagctttgatcaggtggagacaaactccgaccgaaactaatccccaaacactagctttagtacaataatgtgtctcgttgtgctgttgctaacctattttatgtcaacacgttgcgacaaactgacagcaagcttgcttgttctctcaataatttggttttttgttccattcccaaatgagttggcaacttaattaactcgcaggaggatagatacttcctgtaatgataaacttgatttgatgctcttcatcaattgaatattcagctccaacagaaaatgaatattcactattcagcatgttgccaccaatctgaacaagtgatgctcgatgtgaaagcgaaggcacaattgcaaccccaaaataccggggaacaacacaagatttaatcctggagatcataaaatacattggccagctaacttggtggatagtcttcctccgagcaaaatcaaaatcttaaggcttcccggagtaaccatttgaccaaagtacatttcttatcatcttagcaaagaacagtgtgttctttcagaatcgattgagatagcaccagtcaccaggcaagcatattccaaggagatgagcagaaacacgtccatctgcagacagcaatacagcatggttcaatggagtgcatagtcagcagtcaacttgcatacatgacattcagtgaagcgggaatttcacggaagaacgggtaatgcggcaaagaaggcacaattagataaactttggccatgcactatagcatgagttcagttcaggacagatgagcaccacaatactggatacccatcatgatattgagcaacttgaagcagccctaccagcactactactactactactactctatatgacgatcatctcaaaggaaatcactagataagaaataaaagctgtatttgctcatctttcatgtttcagatgtatggatggctatagcaccactgcaccaatgaactaatatttgcttggcaaatgatcaagaaaatcaaactatcaaactactattggactctatgccatgatattctaatcttgaaatgccaaaactagctggcgaacattctaggacaactctagtacttgacagtcagattaaaaggtaaatcaattcaataaggaaataagttttgtacttgttacatataagaaaacaacgaaaggcaggcagcaaaaatgtcaggattcccttttctatgcacaaccatatgatagtacttatttagcaaccgtaatgatatatccataaccattgatgaattatttccccgtaagaatattgggattaagaacacatagttcccaggactaatgaccatgtaactggtagtttggtactcatattttttatgcattacaaaagccttgtgagaagagtatagaacaggcactctaccaaaatggtaattaagatcaaggactccagatgagcataataaaattgccatctcacttcagaagctaaatcactcccagttgcaatttgccgatcgacaccgggacaaaaataattgttagaaagcaatgcaggaagaattgttacaggctcacagctaagatgtgcaaaactagctccatcgtctcttatcctcttcttcatcaactgggatataccactctggtcgcttcttcgagttgctgtaccggtagttcaggaagagctcttcatcacatatggaccttgtactcaccagcactagagtcttcagaactggagactccccttcctgattaccagaacgtccagacttgaaccagaatgaaccaaatcgtttcattgtaacgggctcttcttcaccaccaaaagtaatgttagggatgtagactctcatgtccttctctgtcaatggaaaatcatatgggcagatcatgacattgggagttgacccttttggtggatggtttgcaaagtgaccaaaagcgagtgggtttcgtcgttcaagcacttccccaaaattttcagtgtgacccttcttcagaggcttgctgagcatcctccatgccctatcagagttgctctcttggcttttggatggcactgcattgtaatccaccaaatctgagccatcccatatttctctgctatcaccacctaattgccatggtttggcatcaattattgttccatcataccttgtgatcagatagttgttgcacgcgtcgatttttgggtatccagggatatatcgataataagcaggtgaatatacaactccagggtagatggctaggacagcaccagcattagtttctccagataagaacagaccttgccctgcatctttgtgagggatttgtgacggcctgatgtcaagggtgtattgaaagtgatccctaaatttatttgacaattcagcgcgatttaaaggcctagtagaagggacatctgcactgcagagtaaatggatcagaactaagcttctcaggattcaactcataaaaggaaatatgtaagtgtaactgtgtctccaaatgtaacaaacatgatgaacacaaaaatttcgctgcaaacagagatatggggttaacataatgcatatacttatttctgtttagcctacttcagcagcacaaaattgattaaggatgttaaatcatggtacgtaaaactgaagcataagcgaagtacacaaaaataggcagtttgctagccaagcaagtacttgtcatatctgatgaacaatattatacttcgtccctttccaacgaatgatcaagatttgaaatgaaaacacaggcactgtactgtgattgtcatatttgaactcagaagtatgctttggtgcaaaaaaaaagtcaaaagtatcagttactaatggtacttatgcaaacacataatgtactaaccaattttgactgatactgtatgcaagtggagaactgcggatgtactaattcaatgcatttagttagaacaaattacctggcttgtttgcagatgcaactcctgtgccaacagcgaaactcaacccactacgccgaggataattattagcttctgaagcaccattttttgtatcaggaagaagaatgctatccattgcttgacacatatttgtaagttgatagtgaacattctcctgtacttgcttctgctgctcagaaacagaagctttgctagccatgtcaataatctcctctgcgtccttctcttcagcattagcccccaaacggtaatagctgagcacacatcgaaaagaactcaggttaggaaaatagtcatcttcataatgcagttgaaaggctgtggtgaattaacattttgaacatagtaataataaatcatatattttagtgggatgatccgccagttgctgataacagaagagtttgaaagatgcacatgtctaaccaaagggtttcaagaagatcaagtgtgtgtagcatctaaactatgagaatccaacgactaccttaattgcttttattgcttattagaggtttacattatttaaactaaatttgaaatagtggtttcaggtgttcgttatttacggaaacacaaaaactacatgctgcatacacataactggatatccatctgcggcatattacagtgaaaaggaactggtatttttcttcagatattggcaaacctggtgtagagaaacaggcgatttacgtcagcttcgaattggagatgccttggatctcgagcaaacaatcgattgttagcaaacatcggattcttagccagtgttttgacagcctggaaatgcatcagttaatgaattggaacaaaaaaaaagtaccgacaaaatgaatatcataatgttgttcgatgggacaagcactgcattcatttagtcatttgagtcggcattagaaagagtgtgccgaagtcaagcacacatcacccgaatcaacacaagaaagtgaagaaattctacgaaagaaaggcagggacgacggagagcgcaacagaggtaaaacaatgacttgcaactatacaaactagattgcccacagcctagttacaatcaaaatgccaccagattccacaagcataaacaaaaaagaaatccgcgtgttaaccggatccacggcgcttctctcgctcgcgcaaggagcagatcgggatccggaggtgatggtttgcggggggatgtagacggcgaagagagaaagcgtgtgtacctcttggaacctgatgaagagggagcccatgcctgctttggcttggcttggctggcggtggcggccgctggccgctgtgcttgtctggtcgcgcgggccggggcgagaagagcgcgacgacgccagcggccggcgtagcggtgaggttgagagcttcgggaatcaggaggcggcgatcagtctactggtggtgggtgagaagaagggttttggcgtcgggaattgggccgcccccacatcttcgtggactttagcccgttactgtttgggtcggctctgcattttattttatttttactttttgcaattagctgatctttttccagaacgaacaattacctgattttaacatttcgggtctcatcggttacctaaaagcttattataggttgtaatagattattagaaaaagataataatttatgtgtaagatttttatatgtattcttagcaatataaaaaccaatatggaaagagaaattacgttgagaatatcttaaaattaagttttcaaatttaaattttgattttgggttattctttttagggtaaacgatggggctcgtagacatatgctgctttagtaggaaatccgtaaggtatatgaacgaacttctaaattggagaagaggatatttataaggatacttttattatgtaatacttcctccgttccagaatataagaaattttagcgttggacacggttactaagaaagtaggttggacacggttactaagaaagtaggtaaagtgagtggtggagagttgtgattgaatgagtaatggaggtaggtgggaaaagtaaatggtggaggattgtaattttattggtggaaaaattgttatattttggataaattctaagtgctaaaagttgttatattttggaatagagggagtagcaccttgcatgaagatgctatgagagggcatggcgcattttctacatgccctgatgcttagattccagtaccgaaaggaagaagttccatgtttcggacaatggtatttgtatccatatacttttcttgagccgtgcataatctcttcctaaattagttaagcatcaccagcaacagtgctatttcctgctcgtttgatacgacattgttcttcacataaccgatgttctattattctcagtttcctattcgtgcttcacttattttaaattagtctggataatgaaacttgctcttcactgaagcaaagccgcgacggcatgatagtcaagttgggaactcctcgtagttcatcaagccaagcgaacctctgtaatcggttaagtgtgtggtatgttcagggaaaccctgggtatgctccgatgatgaaactgctctgaaggacgtaatgtcctcattaaaaaaaaactaggtgttcagtgcaaaaggctaaagtaaccagacattggattaaaaaaaagtcattttaccagggcgaaaggcctaaccaaaatggcatcagataaatacacaagaatggaatttcaaacatgtcactatggaatataccggtaagaaggtatccatttacatcagaataggtggatatggtgaattggtgaatcctcaatttgaaggaccttacagaatctccgtctcatccaattgtgttcatatacaaatcgattacctgcatttggactaaaccaagtatgtgcaggtataattcaatgatccacccatccaggttgggatgaacaagtgatcgtggaacctctgctttcccgattcatacgatgatgctctgaagttataaaaagcatcaggctccatgcctgttaagccccaagcatcaattcattaaaaacaatccacttctgtaacttggtctagttcatatgcagatcatagtttatggagtactacataaatgcaacaattttgatcacagaatagtgaatattaaacaaaattatgcaagtttgtaatataccaaacttgtcatgtttaactactttaagattcagatcatctttcctagcttcataagaatcaaaagtcaaatgactccttccgctacaatgcccagaactgcaatgatgaatgtcaaaacactagtatggctgacatggagttccagctcaaaacttatccagatctaaattgattatctactatatgtctggtgaccaaaagatggtcaaacctttcagctagtttacatcataaacccttttcttattagtcgattactccagccatctatgaacactgtgctccattatctaaaaaatgaacactgtgctccattctgacagcctaacaaacaagtctcaagtaagtaacttctgaggccctgtacagtgctccccttctgaaatataaaaccagctcggctggcttaggtttaaaaaaaaaagtaacttctgaggcttcctgtgtagtcaggaaactgaaaataccttttagtgaatcagaacatcacagtatcaatcataatttttagatagcacacaaattcatattgttttgatagaaggcctaaaccaccagggcaaagtaagagacaatcaactcccttaaatcaaacaagaccacactgaatgatcaacatggacatcttaatgaaaactaattggtcactgagacaaccgaatgaacatatacgctctaacccctaatgttaggcagaacgcaaaactatgccttggcaaggaggaatttgcagttgagatacaacaatacaaaggaccttacgaagttatcagtatggaaggaataaaatttccttagatttgcaataaatatcagcagtagctcaattcaggcaatcaagacaacatgtaaggagccgaacacat

SEQ ID NO: 8156 - DNA, 2390 bp, Oryza sativa
tgtcgtagatcgcgagccccccggtgacgaccccgcccgggaagttgatgtagaggtggaccggcttgagcgggttctccgactcgaggaagagcagctgcgcgacgacgagcgaggcggtctcgtcggcgattggcccgtggatgagcacgatccgctccttgagcaggcgcgagaagatgtcgtacgccctctccccgcgcgaggtggtctcgatgaccatcggcaccaggccgaacgcctggtgcgacgagtaccccgccggctgctgcggctgcggctggtacggcatgggcgacgacgagaagtacgcccgcggcgccggcgccgccaccgccagccgccgcagcgcgggccccgccgccgagccgggcctcgccctgggcttgggggagaaggcggggagcggcgaggcggaggctaggtgggcgagggcggagggcgtcatggctgccgctgccggttcggattggattcggggatttcgagcgaagtgaaatttggggatatgagatggggaggaaggtgagttataacgaggaacggatagggcgaggcgaggagagaaggcgagacggtgcgcttcggcttggatctttttgtttggttgggggcttggggctctttcctgcggtgcctgtcgtcttgggccttgcttgtgtggcaagaaagaatttggcccatataagaatagtagtagtatattccttcttatgttcgtggcctttcccctctgttttgttttcttctgtcagtttcgctggattttggtcggatttgactgaattttgtggcgtttctgcaacaaatgatggaaagctcacaagttcagaccttgtagctagtagtgtactactagtgcagcgcaacctgtgcagtttgaactgagttaccgagcttgttgtggagcggcaggagccaaaagatgagattgttcagttcggcgtacacacaggcaaagtgagtcagtgacacggtggtaaaaacaagcacgttaacccgatgaaatccactcctttatcttccgtcgccaagagagatcgacggccgagacgggtccaagtcggcagggggtccaattggccgagaaagcgcagcaacctcgtggcgccggagcgtgcgatgtggcatgcggcggcggctgtacggcgcgaagctgatgcgtgaaagaaggctcctctcactttggctttctctccgacttggcgcgcgtgcgggtgacaatcgccgtcccacgcacactcctggcctcctgggctcctggctgctgctagtctgctacggcgatgtccggttagttatgcagctacttttcagtaatcagtggcttggtttacagccagagaaaccggttagatttttttcacttcgatatttttttcagaaaccagaacagacaaagagggcaaactgccgtttcatttcttctttcctctttctaggtgaaagctaagctcggaaactttcttttttgcacgtttgttgccgaaatttttgacaaattgatcctcaaaacatatttataaaatagatcgtatcgaaaattaattgtaaagaccattagcgccaaactaaggtggcacctatttgccatgtaatctaaactcagcgtcacatgcatagcccggctgtagagaccttttgtttctacccaaaggttcaagacttgaatctcctgtctccctttttttttcactaacgtagtagcgtggtcctcatctagttcaagttttaaagaatcatatgttatcaattttattgtatttttaaacttcgaagttaaacttaccttacataatatttatcctttttgtttctttacgttttggaacagaatcttagcatcaatgttttgatacgatgtaagttcttttttcaaaaggatatgtcaaaattttggcacttgttggcaatactctttttttctggccatgtcatgtttcattttccatctccaagaccctacatgggccttgctagtaccaccaatttatgggttttcagctaggaataagttcactttgtgaccctcaaaagtgatcgaaatctaatccgtgaccctaaaccgcaaaaccggatatctcgacccctcaactcttaaaaccggtgtcatttgactccctcggcggttttggagggcgatttcgctgacgtggcgcctacgtggcagtattgactcggtcttctttccatgtggcgttgacgtggcgcttaggtggcattagaaataaaaaatatgtgtgggacctatttgtcatccaccaaaagtatgggtgggacccattgacatgtggggcccacataaaaccatgctctcctcatcctccctctctctcatactcttcggcgagcggcggctgagggatgggggctggcggtggcggcaacca

SEQ ID NO: 8157 - DNA, 7896 bp, Oryza sativa
ccgccctcgcccgcccgcgtgccctcccgccgccacccaccactgccgcccgccgactgccgccgccgcttgccgaagagaaagaaagagagggaggatgaggaagcatggtttatgtgggtcccacccatactttggtggatgacaaatgggtctcacacatattttttatttctaatgccacctaagtgccacataggcgccacgtcagcgaaaccgctctccaaaaccactgagggagtcaaattgcaccggttttaagagttggagggtcgagatatccggttttgtggtttagggttacgaattagatttcgatcactttgagggtcacaaagtgaacttattcctttcagctactgcggcttatcctctgtggaccacactactgtgatcttctttcttaacatacagaggcccatttttttagggttctggagacagtttgacctccacacagtttgacagatcgcaatgtcttttgacacaatgtttaaaacatgcaactcaaatatgtgttcatatccaaatcggacagtacgagactcctctggtcactttcattacagatgaaagtcagacctggcagaactaattttcacgatactggaagattggtgcatatatactttattcattattgtattgttctggttaagagtttctaacatgtgttacatacttactatatgatacttgtatttttttaattagatacggagatagtacttgtaaaagaatttcaaaataatgagtacttatgtaactgtttaggttaccttcattgctcgtgtaaaaactaattaataatagtaaattacacctttcactaagcaaaatgtagtccatcattccactacatctactaggtgatatatgggcttgtttggctagttgcccaaacgaaccttacctaaaatttgacatattttacattaccaaatttagatgttgtttggtttgtcttactaacttttgattgtgtttttatgagaggaaacttccggaattactaaagtttggtaggataataatggtaatattatgtttagtttcttaccctacaaaaatttgatgatttaagagtaaattatattagtggtatataaattttataggcggatgtaatctaatacacaaacttgcaagatgcttatttcagtgcacagacttgcatggtctgtgtgaaccaaggctaagcatgcatggttaatcttactgagttgaacctttattaggatgcaacatatgtacacatatcaggatgatgccatctagaaacatgcatgtgctcagttaaatatataatagtagatgttgattatacaggggaataatatatagaagtatgaaggataaaatgaattgtaaacaataaaaaacacaaataaatactaagtagaggtcattcacaaatgtggtatgccttttatgaccttttgatgcgtgcgcatgccattgtaagtaggtttcaactcacaattattagtcatgacgtgtcgctccagtattgtttcgcacgtactggacaacttcatacactaaataggcagtttgtaagcttgtgcattaggtggcatgcacctacctgtaaattcgtgtacaaccagtgcaatttacttgtaatataatttaaaaaatttttaaggttgaaagtggcaggcgcagtgttctcataagatgtctactagctatatttattagctatatttattttctagtgggttatttgtttaattatatgtagcagatttgggtagttaaaaatttgatacaatacattatgtacaaaggtatatggtaatttaaatgtcacttaataagtggtatattaaaccgtctgtttaaatacgagtataaatgttcattccattatttaaaaaaaatacgagtataaacagcggacatcctcgcccactctgtcatcaggtgtaggattagcacacagtttcgacgagacctctgtatcagcagatggataaccgtgtcgtcaggtgccgctgataaggaatggagcgtttactttgcgttaagaaatgacaagcgaacaatgttttaattaagcgaatgtcaaaatgggtcttgaaaggaacgtgaccaaggaggagagatcgctagctggctaaaatcaaagccgagctccccaggcgcgccgcgcgccgcgccctcggcctcgatcttttaactcccagacacatcacgttgcgccacgcgatcgagttcatcgcttccggtcttcgatccgccacgcgatcgccggccgccgcccggcatgggcaccggacgcaagcctgtcgacggcgatggcgacggcgctgcatcagccgtcgtcttcctcgtgccgttcccggcgcagggccacgtaaccccgatgctccacctggcgcgcgccctcgccgcgcgcggcgacgtcgcgcccaccgtcgtcctgcccgatttcatccaccgccgcgtcgtgcgggccggcgggaacggcggcggaggcggcgtggcgctcgcctccttccccagcggcatcccgggcggcgacgacggagacggcgatccgggcttcgccagcatcgtgcacgccatggagaaccgcatgcccgcgcacctggagcgcgtgctcatgctcatgcgcgacgacgacgacgaccgccttgcagctgctggacggagggcagcgtgcctaaccgtcgtcgtcgacgtactggcgtcgtgggccgtcccggtggccacgaggtgcggcgtggcggccgtggggttctggccggcgatgctggcgagctaccgcgtcgtggcggccatacccgagctcatcgacagggggctcgtctcggaatacggtatgcgctgctgcaacgtccatgcatcccatttctggctttctgcttttttttcttctattttaactacaattctcgatctggtgcaaatgacttttgaattgtcataagcacatcacaaaatactgtactacgttaattctatagatggctagtactctttagtaaaaaaaaaatgttttgaacatcgaaattatcttcaggttgcaactttgaatgttattttttaaaatagtaaaaaaaatccaacaaacttataatcctatacatatcaaggtagtttttgaggtaatatatcacgcatacaattttatactcccttcatctaacaatatactcccaacatttctcaatagaaggcataattgttcctgatgcaaagaccaactaaacaagtaaatatttctaggttatttatcatggattaaggatatttaaggtcgaggagaaaaaaaatagtgctcatttaggatgaatggggggtttgagaataattggggcaaaaagggaagaaattttagtaattaagaagtggttgatgcgagaaatactagtgtagtaatttatatattattggataatatttaaatgcttcaattgcttatatttttggacagacaatgtacatctaatctaaaaattttaaataatggtgtttttaaaagctttgcatatgaaacacatctaaaatggcatgttttaaaataactaatagtatgacatcaaattgttaccatgacttatttaatggtactacccgctcacacatgtatataataacaattaatgatgtaccataaaagactttaaaatagacagatcgaaagtcttaaaaattgcattgacatacggatgcaattcaagcatggaagaatacaagtaggacaggccgttgggaacttgagaagcatcttactgtatttattcactatagcaattaatttagtatccttatttagcaatttgtatacccgtgtctttcttttaagaagtagcacgttgaatagtggtctaaccaaacctattattacatatttacatccactctcaatttttaaatttttcaagaataatttcccccagtcatgtgccaatgttcagtttacagctgcgattagggttttacagatcaatacctttaattttttcccctttctttttggaaacaggtattcccatattggcaaacggattcaacaaaaaccagggccaagtaaaagcaaacctccaggctgaaatcatcagcttattccccgaagaactagagctaagcaccacagatttgccatggctcgtcggcgacgcggcgacccagaaatcaagattcgccttctggctccggacaatggagcgcgtgaagaccctccgctgcatcctcgtcaactccttccccggcgaggccatcgccgccggcgccgaccagcaacagccattgccgcaggaccagcaaatcctccaagttggaccattgctagccaccatcgtcactgatcgagcaaaaggcaacagcaacttgcggtgttcgccaatgaagacgacgaagaacgacaccagcacgtgtcaggcagacgacagaaccagctgcatggaatggctcgaccagcagcgtccaggttcggtggcgtacgtctcgttcgggacatgggtcgcgccgatcgcgccgggcgagatcaccgagctcgccgtcggcctggaggccaccggccggccgttcctgtgggtcctcaaggacgacccgtcgtggcgagccggcctccccgccggatacacggatcagtactccggccgcggcaagatcgtcgcgtgggcgccgcaggaggacgtcctcgcgcacggcgccgtcgggtgctacctcacgcactgcggctggaactcgacgctggaggcgatacggcacggggttcgcatgctgtgctacccggtggccggcgaccagttcatcaactgcgcgtacatcgtcagggcgtgggggatagggatcaggctgcgcagtgccgaccgtggcgaggtggtggattgcgtcgggaggatcatggaaggcgaggacgggaggcgcttgcgggagaagctggatgagctgagggagagggttatggcgggtgaggcattgtgcgtagcaaagaggaacattgaggaattcattcgtgggattagtggacagagattacaataggggcttgttaatttgatcgtgaacgttattaattgccgtgaaagaaaaaggatagtttgatcaatatgaagcatcttaaggaattaaccgaagcgcttaatgagtcataaaaaaatgtgtcatgccgctgactcgttcgtgtaaacattttgttgcctaagagcgaagatgtacattaatcctaaatcatgcatgcttcatacatgtggtgctctattatattgttctacaaatttatgtttgtttatgtcttttgtattgtgatactgagagtctataccctagcggctagcggtatgacatttttcacaaatttcaatcaaattctagttgaacttggatcaatttttacgtttcaaatttgaattctcgaaaactgtagcacccgtattttatttgcttttatttaaaaatcttgtcatttaaaattttggagttaatttggttcttaattgattttgtgccaaatagatctcaaatcctctcttagaattgcctttaaaatttctgtgacatcctaggtcaaattcaaattcaaatcctttgaaatctcctcaaaattcaaactctacaaatccttgagaaattgtgaagcagtactgttcagttcgggcctcatcctctctttcttttcccctcggcccaactcctctcctccccagtcggccagcccagcccagctcctattcacctcttcttccttgaggcagctagccacgtgcacacaaggtgttcgacgaaatgttccgcccggacgccaagtcgtgccgagccgtgtgttgcaccaaaacaccctcccgtgcgccgcgcgtcgtgccaacacccgcgccgcaccgcctccgcaccaggccgaggccgcgccacgccaaaatcgcgtcgcgccaagcccgacctcgctccggtttctctccgggagacacggagccacgtcgcctcgcgtcaccccgtcccgtcgccgtccactccatctatcccgtcgctattgtttctctggtttgagcttgttttattgccttttgtttattagctttgttttcgcgttaagagcccgagttcgaggaagctccggacgccgctttcgaaggagaagaccccaaccctatgcaaggcaagcctctttgatcactttgcccctatatttgcaaagatatgttgtttgaaaagtgcattacttagcatacacgattaacatgtttaggcctcggattgtttatacaaccgacggaccaacctagtagtcacacttatattacataggttgatgtttctatacctttgatagctccacaaatgtttgtgccggtattgttacacgattaccgaggtagtttcgcttagccatgcttacgttgttgccgtgtgggaaacttgggttattccaaattacctgattaaagtagttgtgaaataaaatgtgttgtgaaagtggtgatgatgcggagtcaagcctttgtggtttggccacgtattgtcgttaaggactgattcctttgggaaatccatccgaacacattacagtgtgaccacacgggtatttatgggatgcctctggctgagtaaattgttttcacatgggagttggtgtgccaatggttgtgcaataccgaggatgaggagacgaagtgttacacatttattgcccatcatgggtgtctttttgcctctattgtggcgtggtaccagtaggagtaggaggcatcctcggtatttcctgagtggatgacggctgtcattgcctgatactcggctatggatctttgcccaactaggtggtatgcgattttcatgggttagctttggaaaggccttatcacgaacttccggtaccggccagtaccggtgtaagtttcgtgtcgtgtgggtaaagcgtgcaatctctgcagagattaatgaactgttttaacagccatacccacggtcaagggcgagtgtaaggtgtttctcatagcgtagatttgtttgacaaaggtttgtggaaaagtggttactgaaaagggaacgttaccagagtccgcctgtgtggcagacagctaacctttgtggttaggaacgggtctgtgtgacctgaggtgtcgtccgacaccgaggtgttgttagggccatgatggcgttgatgtgctgggataaccaggagatttgtgtgaactgtgttgttgtgaaaaaggaactaatagagaaaacaatttaattgttgttcgttaattgtgacaagttgttgcaaagcaacttgtggaatgggtcgaggcgtgagcctcctcccgacaactaaaacttgactcactcactaggagttttgtgaaataaatcattttgccaaaatggcagccttcacaaataaaaccgtagcctccttgttaaaccgacatgtcattcttttccctgatgtagcgcccgttccgtcgtggcgcctagcgggaaaattatctcttaaaaaccctagttgcgaaatttgtttccttgcttgttgtcgagtgaccgagccatctcagatctcaaatccccgatctatcgtcgagttcaatccagaatccaaatctctcaaatcaaatccctccgcaaaaggctattttgcctcccccgggttcgatgggccgaatctctctcggcccatctcccctttttttcccggcgctctctctctctctctctctacctctccccctccgctccgcccgcgcgccgcgcgcgcgtgcgcgtgagccgcccgcgccgagccgagccctcccctccgctccctcgctgccgctccccgcgcgtcgttcgcgcgcgcgcccgcgtggttgccgcccgtgccacgccgttcacgcccgccgggcccgctgacctaccgcgcctgcagccgcgcagccgctcgggcccgcggagccacgcgcgtgcccgagccgcgccggtcaa

SEQ ID NO: 8158 - DNA, 10846 bp, Oryza sativa
aggcagagcccctcctccctctgccgccacgcccccgctcccctcctcctttttcccaaagcggcaaggaggcaagccccttttctctccctcttttctcctttttccgtcaccgccggcgtcatcctcctccctccgccctgtcgccgatttggacgcgagcgccgagcgccagctcgcgccttgaccgccctaagtcggttcccaaaccgccattgccgcccttaaagccccgggcgccctccctctcttctccttccatcgcctccactccattgccgccacccccgtgctctgttcgccgtcgccgttcgtcattgcgcgtgtcggaggagccggcacgagcaaggacgcggaagaggactccgggcgcgccctctccttcctcttccccggcccgaggccggagagattactcccgcgccgtcggcctctcgtcactgcgcccgcccgcacggtagagcatctccccgttctccctcctcgctccatctccccccttagttttcggtagtagcttgtgtagcctccccgtatctagccggcgccgccccgaccgttgccgtcgctcgccgtgtgctcgccgccgtaaccgcccgagctccgtagcacccgctcgtcgccggcctcgctcggcgtagctccgcccaatccgacgctagcatcggattcccgtagccgcgtagatgctctcgccgccgggaatcggcccctcgtgacctcgtcgccgtttcccccttcttccgccgccggatgccgccgccgcaattcgccgccgtcgggcatcctccggcgaatccgagccattggctcatctcctctcatcctgtgcagctacccggtgtgcttgccttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcagccaaagaccgggtcgagccgatctcggtcagtccttccccgtgcgcgcgttccaccgcgagccgtgaggctgcgcgtgggcccgccgcatccgcgtccaccgcgcgccgcgcgcgtgcaccacgtccctccctcaccctagcgccgcgccgcgtgctccctccgcacggtgagccgagccgctgacaagcgggtcccacccgggaccacgcgtggtgagcccggtcaaccggctctctctctcctcccctcccgcgtgcgcgcgccttgggccggccggcccatttagctcggtcggaccgctccatttctctcgggccgcgccctagccgcccgaggaaaagtctattatccctccctctttcctttccttttcttttctttttcaaaaaggatttaattaaatcatttttcctttagaccaaaaatccaataatcttagaaattcaatatcttcccaaccgtaaacccgtttgactccgttcaacttccaaaattcctcaaatctcgagatctatctaatggcacgcttagaggtcattaatagggctttattttcgccgtttgttgagttgccccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcagacctacctaatttgttgcatttgatccttcctttgttaattgtgataccatgtccccttgtaaccatccagttgcgtctcgatattcgtgcaccctgcgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacagtcatgggcggatgtgaggtgattcctagcgtagttttgtttaactactgcttgtgaaattgctgttgtgaaaaggggttcgatgtttgaaaaatctgtagctaatggtatcagctaggcccgggtggccgtttgaaaagttgttggcccgggtggccgtttgaaaagctgttggcccgggtggccgttgaaaagctgttggccgggtgccaaccttgtttcaattctaaagactgatacattgcacatactccgaccggacgagatgcactgtctcatccgtgtcgtttgagaagcactcacttagttgtttcagaaaagagttcaaataaaatcaattgtaaaaacaacagtctctccttgaagcctgcattaaacacttatttcccctggcttgctgagtactcccgtactcacccttgctctatataaataatccccccagttgctgaagaagatgaagcggatcctgctgatgaagagttcttccaggagcaagccggctacgatgagttttagggtttcggcctagttcccaagtcgcgcctgtgatgtttggtcctagtcctggcttccgctttccttttgtaatgcagttgtgagctcggggtctgtccgcagcccaacatgactgtacctctactctataataaagagacctctgttgctgtgataatctgtcttcctgtgataccagcactgtttcctgggactggtatcgaataacaggttaatttggagcgtcacgggctagttccggtcggtactagttcggggcgtgacacctggcttgctgagcacgttaagtactcatccttgccccttataataatctatagagtttgaagatgaagacgtcgacccgaccgccgagaagtatctccaggagcaagccgagtatgaagacttttagatgtttcgtgcctagccccaagcctcgcctgtggaataagttagttgcctaggttctttgcctagtgcgtagtcacttagttgcttagtactccacgctgttcgtttctgcgccatcgcttttgtgtttttctgtaatgttgtgttgttcatctatgggcatgtccatgatagcaacgtttgtaaggactactacccagtgatgtaataaagcagtttactttgattccatatttattctgtgagtaccagctagtgtatcctgggactggtactatatcacaggtaatgcataacaccccggtgtgagttagctgtgtttatggctaacaaatgtcggggcgttacaaaaaccagtcaaaatttcacttggaatctacttccgtcccatgccaaaaacctcaaaatttcacagatttcagtctgcttaattttgtcgaaaacataaacccacatggtgggagggttataaaattatgatcgatataaccacaattagcttactttatcttcgttatttctatcggctatataatcaacaccgatcctataaggcaccatggcaaatccagggttgggattagtcaggatgggaatgggtatggtcgatccatttattcactaaacctatccgtaaatttgtcataacggatttttagggtcgctccaaaattataaatggatcaaatggcttaaaccattagaacctagatttaaggggttcgacctaaaatgacttcacatgtataaatgtttcaagaatttgtacaaagttacttctctatataataaatcattcctacaaaattcaactaaatttaacaagtttttatagtgtgaacgcgagtttaaaaattttgggtccgaattttacacacatgtaactataatttttgaatcttagtaatgcggcatatataggggggcatgtctaaatggcttaaaatttgtacaaagttgcttctccatataataaatcatctctacaaaattcaactaaatttgataagtttttaaaatgtgaacgcaagtttaaaagtttttaggcccaagttttgcatacatgtaataagaatttgttttgtctactagtaacatagatgatcaatttggatatccatgtatatcctattgatataatagacttatgatgaattgactctattaaaccatggataaatgaacttacttaaaatggttaaaccaacgaggctggcccgaggcggtcgccggctcgacagcctcccccacccgcggctcctcgacgtgcctctttccgccacaaccacagtcgacgacgtactcccctcgcgacgatgacatggtggtccggacggaggtggcaggggtccaggcgacggcctccaacgatgccacccgtgcaaaagagggtggcaagacggtggtcagcgcctaagcggcggacacggcgggcgttcggtgtagatggaaaattcgggacccccggtgtttagtgtttccgaagccgaatcggatcacaagttaagcgccgattccgaagcagaaacgggacgagacaacgggctatataaccacggggcaacgagtgcacgcactcagatcagtactacgtacgcacgctcgcgacgcgatcaacccaacccgatcctgcgacatggaggctctgccgcagatacggcaaaccctcagcgagatcgaccgccgcatccccgacgccctccgcgtcgcgatgggcctccgcttgcggcccaccgccggcgccgcgctggaggaagtcacgaggatcgccgcgtcctgcctgcctcggccttgcccggagggcggcgacgaccccatggagtgcgacaaggcggcgccggcgcgggcgctgcggatggaggccgcgtcgtgcttcctgcccgaccacgacgaggacacgcacttcgttcgccccgaggcaggcgtcgtcgccctggcggacggcgtcggcgggtaccgcgcgccgggcgtcgacgccgccgcgttcgcgcgcgccctcatgtacaacgccttcgagatggtcgtggccacgacgcccggcggcgcggggggcatctgcccctacgcgctgctggggtgggcgtacgagcaggcggtatcggcgcggacgcagggggcatccacggcggtgatcctgtcgctcgccggcgcgaccctgaaatacgcctacatcggcgacagcgcgttcgcggtgttccgcgacggcaagctcttcttccgttccgaggcccaggtccactccttcaactacccgttccagctcagcgtcaagaacgggaacagcgtcacctcggcggcgcgcggcggcgtcgaggtgaaggagggcgacgtcgtggtggccgggacggacgggctgttcgacaacgtgaccagcgaggagctccagcggatcgtcgcgatgggcagggcgctggggctgtcgcccaagcagacggcggacgtcgtcgccggcttcgcctacgaggcgtcgacgacgatgggcagagacacgcccttcagcctcgagagccggaagaagcaagggacgattttccggcgagggaagagggacgacatcaccgtcgtcgtcgcctacattgtctgatcatagggtcattggtgtacattctatgatctacacgggtgtacgtacgatctgtaggctgtagcatactaaattgcacgatcgatcagcttgtcgtcttgtcgatcgatgtctctcgagcaaaatccttgtattatgcggttgttaaaggctttattaagatttgtattaagtcttacggtgtatatacataatgatcaattccaggataattctgttgttcgttgttcgttctgttttattatgagaattcaattggatgatctaagataattaccgatactacttttataattcgtccactgcgctttaatatgagaaatacataatacaagaatttcaggggaacatattttattgtttgcatgttatccacataatcatgattttaaaatacagcatcaacttttttttttgtctaaaatacaccctcgaactttaaaataaggtattaccctctaactatcaataccgtgctcattactccgtcttaggccttgttcggtttggaggtgattgaaaaggattggaggggattgagggggaataattccacaccacaataggtgtggaataaatcccttccaatccatccctcatggggattaaccgaacaaggtcttattgtttagtatgatatcggggacaccacgtaggatgcacgtattaaaaagccagaaggccctagatgtcagacctacctctcccctatctttctccaccttcctgtgtcttcggctgttcggcatcctcagaagtatcgcggcgaggacgccattgacgacaatctcttcgatttgttcccagtcccctacccgttttgccgtcgtgctaaccggccaccgccgatgcaccgcccctctccttactccctctcctctccctccgctggcgaggatgacggggccagccccatcgactaagctcagataagacgtttttgacgacgatgtgtgtgtgtgtgcgtgtgtgtgagtggcggtgaaagacagatggggaggaagcgagagtggcgatggcagcggagcccaagcttgatgtagaggtgaagctcatggaggaggagcgggtgctggagcccgagttgacgttcttagctcaaggcgaatggatagtgacgacaaactttgacaacccaagcacgaagtagagattttgccatcatcgtgcacatcctcttctttctcctccgctcaaggacgtgctattgcagctcacccccgcaccttcaccgtagcgactgctgagccgcagtctccgctgctttctccatgccaacagctagacaaactaatctaattatttagaaccacttgtaaagagtggcaaatagttaattattcctcacatatgggcttggccaatgtagcgtccacatgcaccaaaacccaccttaacatctctgggtaaagtgtcatgtattgtgttgatagttgggtggtgtattatatctagttttgtagtttggcggtgtattttagacaaacgtaagagtttaggtgtgtgaaatatgctttttttttagaaaaaaaaagatagattaatacatgatatatcaattaaaatagtgcaagttaaaattcgagttcatcaagttgtagaaaaagaataaattaaattatagccagttaacttatatttttagtcaaatttatttttttctacttggagtaattctatcgcatattaatttatcttattttttgttttagttattttataaccatgtaaatcagtaaatgatatgtaaaatagtgagtgtgtatttccttgatagttcagatagtttcccaagtttcatgttgtgttgattgttagggcatatacaatggttatcaatagtggtctcttagcattgctaattagaaatatttgttgatatggaagaaagagaaagatgagagacaaaacatcgttgttatgcataacaacagcttaacaacgactcttaatcactataatatgtaaaatgaatacttttttagttaatgattagagtctttatcgtctcaactattataaagacacgtctctaaataatcttgtttaaaagaacatactcgcctctgccattaaaagtgcccttagccgtaatccgtctcgatctccgactccaactgcatatcggacagcatatcgcctgcagtgcgaataggactcgtataccgtttgccgcgctatttattaatggatcactgtctacgtagcctggcacgcgttccccaaaaactcttaaccaaagatggagaaacgtatggagacgttggagcagatcaaagagaccctgcgcgagaccagcaagctagtccccgacattgtccgcgccgcggtcggcctcgagcaccattaccagacagtcgagctcccccacgacgacggctgcgtcaaaagcttcgccgcggccttcttgcggccgcaggcgcaggagcaggcgcatggcgacggcgaggtccagcaggcagtgaggatggagtcggcgtcgtgctacgtgcccgaccacgacgaggacgcgcacttcgtgcacgacgcggccggcgtcgtcggcgggtaccgccgcagggtcggcgtggacgccggcgcgttctcgcgcgggctcatgacgagcgccttcgcgcagctcgtgacggcggagcccggcacgcccgtctgcccctacacgctgctggagcgcgcctacgaggagacgctggagtccggcgcgcagggcgggtccacggcggtcatcctctcgctcgccgacggcaacgtcctcaggtgggcgtacatcggcgacagcgccttcgccgtgctccgggacggcagggtcgtggtgcgctcggtgcagcagcagaggtacttcaacgccccctactacctcggcggccggcggggcgacgaaggcatgacggtggggatggtgggcgagatgaaggtgaggcgcggcgacgtcgtggtggccgggacggacggcctgttcgacaacatgtccgacgcggagctcgagaaggtcgtgcagatcgggacggcgctgggcttctcgcccaagaacatggcagacatcatcggcggcaccgcctacgagatgtcgcgctgcttgctgaaggactcgccgttcgccgtcgagtggcggaagcagcacgagaacgaggaggggcacttttacggcgggaaggtggacgacatcaccgtcgtcgtcgcgtgcatcgtctcgtcggattcatgacaattctctcttttgtttgctcggttttcgatcaccatcacaccatggttgatgtttggatgaatattaataccccgtttatgtaagtaaattctattactagttagggcgcataacagagcaaccgatcgagcaggccgtttagggctcattcggtttgaagggtatttggagaaaatattggaggattcaaattccttaggaattaacactactaaatcattaaaaatggaggattgggatataggaaaagtggaggaaatttttctacgtttttcatgtattccgaataaggcctaaacggccctgttgacatcatcgctaacaatggacagaaaagtgggactctcttcaggtcaggctgtcagccagccagccagtcagttgtcacgatgtcatcttagcaaaagagagaacgccactaaaaaaaaaggctagcccatgatgctccgattcaacattcaatcagacaccatcaactagcctcaaacaccatcgtcgtgcatgaattttcttggctcgagttacactttgctgatggcacgaagcatcaactatcatcaggggaactcaagagattttcataccatatacaacacttcagggataccgcaaaaggctggaagacaaatcgatgtttcagaacttgatagtgcacaaatttcctcccaaaatcatccataaagtgacgcacaaatctcagttacaacgcaagggaggaagaattaatctaagaattcaataacttgtacagcccaaaatatatcaccgagacttctgattcactcatcgtcagcacccatgaagtttctgcaaggttgacgaggggcagcatcaagaacagcagaggaaatccaggatgctggagcagcaatcgtagcagcaagaacaactgcgtacacaaaaaaaacaaccaatcaatcaaggagaaaacagagcaagatgagaagatcagggagaactaaatggcgcaggcaccctccttaccattcatccatggtcttgtccgtgaagtcgtcggtgttcatcgcctgagccggtgggggatccatcgccaagaagtccaagaaaaaaaatatgtgaggtgaggaagaaggcagaaggctataaaggctgggaagtaggagtatactagagtaagcaagagcaaagggacaaataggctggagggaaatgcagataagtgtggagcacatgggatggggtggtggtataaagaaaaggtttttgtcaggatttaaagtttgccctgtcgactgatgaattagcttttccgggttctgtctagtgggttcttaaaatgggtagcggtttggagttttgcagtttgcaccggcctatttggtgtcaggaattccgctgattgcgcatgccatgatcctcgattcagcttcggtgacattgctatggcaagtcaccggatgacataccgtgcatctgagccatccaaaacgaatccaacgtctgctttagttgggcccgcacgcaggcaaaaaaaccgccgttttcatccccactactggcgggagacgatgcccccaatttctcattgcgcgcgtccgcgagccagcggggagtgtcgccactgaatccgggagagtcgtcgccaccgtgaccggaaaggtgacaggccgacgaggtcgccgcgagtgtggagggggtccggcggccgccacgtgaggccggggccggggccctgccgtgccgccgcggcaggccgcgcgtgcaggtg

SEQ ID NO: 8159 - DNA, 54653 bp, Oryza sativa
agttcagatacatcagggtcctcgcgcagccgccgcccggtcccctccacactcgcggcggcgcggcggcctggcgcctctccggcctggcgcagcggcctaacgcgggcgaggggaggcgaagcggccgcccggtcccctccccagtcgcagcggcgcggtggtgggcgcctctccggcctggcgcggcggcggctcccagctagctcgcggcggtggcctgacgcgggcaaggggaggcgaagcgacgaggcagccgcccggtcccctccccactcgctgcggcgcggtggcctggcgcctcttcggcctggcgtggggaaacggcgatgcgagcacgcgagattggggcgagattgaaggagacgtcgtctggcaggaagggtaggcgcgtggggtgaaaacggagtcctgcaggtaggccagtgcagcggaccgttggattagttttcaacgccccagatcgatccaatatcacaccgtgccatgctatagcaatgtcaccgaatctgaatcctcttattttccacatgctgcttcttgagccgaaacgaggggtgccatagtaagaacgtgatcaggtgtaacggcccactgattgcttgctttcaaatgtctagtggagcaattagctacacatacatatcgaaaagagtacttcggctgctacgcggatgccaacgattcccaagtgccccaaaccaagcgagaagacttcggctgctatcgcgtagcccaacctgcaaatcggcccgtgcggcaccttccccagtcgcggactcgcgctgcgaccgatcccacccggggccggttcatccacccaactcccccaagtcccaagtcccaaactcccaacccactcgtgccgtgcacgagccgctcgcgttcgctagtcgccaccactagccgccttagcccggctaccggctatcgcgctacaatccgatccaccggtacgcgcagccgtgcaggctgcagccgcagcgccccgctcagcgcacggcccgcccgatccgtcaaaccccagtggaaaccacacgacgcacgcaccactgcacggccgctcacccacgtcaacgtttaacctggctcgcgtcgcgcgcacggtgcactgcaccccccctgcctttggccacgcaacacggggaacaaataccaacgcgaagttggcgagggttttttccgccgaaaaactgaaccgccgcagccgcactcctctcccgcgctcatccgttcgtctgtcgtctgttccggttgctttggcgggcagctagggtttaggcgcggggccctcccgaatccccgatgtacggcgtcggcgtcggcggcggcggcggcgggaactacgatggcgggggagggaacgccagctccctcttcggcggcggcggattcatgccctcgcaggcgaccaacgccgcggaggggaccagcggcggcggcggcggcttccccaaggtccttcccctcctaatcctacccaaatttctcgtttgtttgttttttttggatatctcttgcgctcccctcggactgacgccttgtggggctcgcgggtgtggtcagagtcggaacgcccaggcgctgctcccgctcaccgtgaagcagatcatggacgcgtcccagaccaacgacgacaagtcgaattttgctgtcaatggcatggaggtgtccacggtatcgatcttgcctacttctgtgtggtgattggtgttcggaaatgaacattgattgggtggtgattagactccatttttttttgggaaattacaaacagttcttgtatgcattgtacttgcgctggttgggccaaaggttgcctatcggagtggtagagaaaatatagttgggcaaaaaaaaaaaaaactccttggagctgaaactagctccttgaaaatattaaatatgtatatggtcctttcaaaatacgatgctatcttctttatgattttgtttagcgtaattatgtaattgtattttgccttttttagaatctaaattctcttggtttgaattggttttgcttcggtcagtttgctttctgtacatgttggcaaatatcgtatgttgtgtattgaatttttatcaccctggattgcaggttaggcttgtaggacgcatgttaaataagcttgatcgggttacggatgtatcattcactcttgatgatggtacaggcagggtacctgtgaatcgctggtgggatgccatgtaccgctttattgtgcttaacaaactttggataatttcttggctttgtactgacttctatttttttctcagggaaaacgatagcactgatactaaggagatggctgacattcagtaagggttacatagtatttgacttgtcttgaaatttaaattgctacgccccaaaattgataggtttgctttgttctatttgcaaggaatggtgactatgttattgtcaatggtggtctaaaaggttttcaagggaagcgtcaggtggttgcttactctgtgaggtgaatactttggtcttccatagataataacctgcaacgtggatttccaaaaactgatgcctgctttggagcatagcgaattgtctgcaatttgtttggcccattatattgaataatgtcaccctgtggtactccgtccgtcccaaaatataagcatctctagtttgtcctaagtcaaactagagatgaacaagaagatcagaagagtattaatatttaccacgtcaaacaagtaaactatgaaaatatatttcatgatgaatctaatgatgctcatttgatactgtaaatacttttatatacacttaggatagtttgacttaggacaaaaccggaaatgcttatattttgggatggagggagtaccgtaataaaacagctaatgctgatgtgatcccttagctacaatgatttgtaagtagaatactccttctgtttctaagtacttgacgcttttgattaaaacatgcttgctaaagcaatcatattttgtgcaaaaagtggcaaaaatgcaccttattaacaattaaggcacgggaatggagtatggagatgggttgaggtgaatatatctaatagaggaatttagtacaaattgcattgggatttgttaagttccaagtattataggtacaaaacagtggtcaaaagtgccctgtatttagaaacggggtagtattcatgcagaagtttgtgagtgctgaacagaactacaactaatcactaacggctatttaattggtgttaattaatgtgtaacattctttgttgttcctacaagcacaccactatattagattggaagtctgtcatatgacgtgtgtaaaagcaatagcaaagataaactcatgaatcaggatagctcaatactatattgctttagagacaggcttatccagaccagataaatacttttctgcattttttcttaatttatgcttttgttcatggtttcttgtcaggcgtataaccaacttcaatgatgtaacacatcactttcttcactgcgttcatgtgcacttggagcttaccaggccgaaggtagtgagatcctaaaggtttcatttgttggtgtttaacttgtgccatacaatatctattgagctttacggtgatgtcatgtttctgagttattttaatacttgacagtcccaagtaaatgctaatacagcaacaggaactcctaaccaaactatgcctagggatagcatggcgtataaccaaagtccacttactaatcaggtagttttggacatttcttcttattttaccaagaaagacatgccaacttttctgtctgaaatttttcattcatatctactcaggcctcaacattttctgcaccacaaaatactggtactggaacaaatatgatcgacttggtcttgaatgtttttcatgacccagcagttatgtaagttaattgttgataattctgcccatagatgtcacttgactagccagttttctctctttgatctattataattcacacgcataaactctgctgactttttttctttgctatagaatagctaacaatattccatgtttttgtccttaacactcagccgtttctgtctagtgtggaattgttaattagatatgcagtacgctttcattacttcttatgataaaaaaaaggtcagataaataagttgtagacatgaataatgaattgacatttggttccttcataccaccagaccttaaaattacgttctctgcaatatagaagttcccatgattcagtggtcagtctttcatatagatgtttgccagtaacttttacatgtttcaaagttttgtaccgatggttctccaccctccatgtcacacacatcaaagggcttaattttaaggtctgcaataccttaaattttcttcataattttacggcacacataatctacaatatctatgcagtaacttttacgtaatctgggagagggccacctctttccttctaaaaataacgccatgctaataccaaatacaagtttggtactgtcaatgttttaacatggtctgtagtttctctgctttagataatactgaatttgtgctatacaggaatgatgaccatggagtaggcgtagattatgtgagccgtcgtcttaatctaccagaggaaacagtcgggtatatccctccccatcacactgtctgaaatatattttgcttatttacataatcctactttctttcacaggaaaatcattatagaccaagttgatctgggacatttgtatgccactatcgatgaccaccattacaagtccacaatgaatggttgatcgtattcaatattatacgtatgcttcacagcttcaaggtcgcatggagccaagaaatgtgtgcactccgcgagagtagttactgcagagtgcctcgcgtgatttttctacaggagatcaccaggcaatcagcttaactgttcaattaagttgtttatctaaataactactcccttggcagtcaggcgagtagcttgatagcatgttagatctttaggagcttcttttgtgtttcaaacaactatgaacgtgtttgcaattgaagcatcttattttcttatgacagtacaggcaaagttactcatcccgctgtttgtcggtcttgatctacaattggccatgccttgtattttcaaaattttcaatgctcgttgcacttatgctggtaataaaccaacaataggataggatggtaaattagctcaagagaagatcaagtaaaatgagctcgcttgtagttttgattggcaaacctgtcagatgcactcataagctcaaaaggcagtttccaagtcagctcagttttgaaacctgacctgctagacctcacggattctcagttcaacatgccattttcgttaaaaaggataatctctacaggaatccgtgtcgagcaaatgataaaacggttgttggttgcagctgtatttttcctcgtttttacatttggattgtgggatgcttctttcctacgggaaacccagatttggcttttctacaaaacaagtgatctggaaatacatttggaggagataattacaggatggcgcgcactccttgcaaatgttctcttcaaagatcaattgatcacgatggcacgactaaccggcaaggaagctatccactttggcattggctgccctcgacaaaaatttcatgcaaatggggggcttcaccttggcaagggcaagaatggactggggaagagtccagatcccatcaccgcagatcaaccctgacgccaccgcaggtccaaacgcatccgccttggccttgttcagcttctcccacacaaagaggatcacgctgcccaggaacatatcgatcgcgaagtacgatccaatgtagaaagggatcgccattgccatggggagcgggatgaacctggagaccttgtgcggcgccaggtctctgatcaggttgatggcgatcgccgcggcgaagaagatgtagcagagagtgaggcagttctccggaagcgagttgaagccatcgacacccaggatggccatgttgcggtacacgatggcatatggcgccgggtactcggtgccgcttgtgccaatattgctgaaggccttgtagaagagccagaagacacagggagctatgacacagcccatcccggtgccgatcacctggctgataaacatggacctcggtgatgccagagtcaagtatccagtcttgaagtcttgcatcaggtcagaggcagtcgacacgatgctcatcatgacaccgcaagcggcaagtcctacgagcacaccaccgtgagaaaggcccgcccacgctccgaacacgaagatagcaagcttgccataggtggaggcaagagaccaatcagtgagaccacttccgtaggcattgcagaaggccagcacaggtgcaacgatgtaggcaaccaaaatgtagtaccacttgagctgcgggaagatctcaggaagggtgccaatcgatagagcagcaactacgacgtagcctccatatgcaactgacttaggaatttgatctttcaggaagatttcagtgcgacgctcatcatcgaaggatacctcttcagcagtggacatggacatgccattgtctgaaacaggaagcatgccttttgaattgttctgaaccattgatataaagcctgcaattgtgcggataagcaccttgaggaagttgtataaaccatccccaaggatcaaagcaatggatatgaaaacctgcaaaggtaatgaacttacagttaaaacattactcaaagcgctctctagccttttgaattctgtattgtatgatttagcttcataaaggggaatcagcggaaaggtggatgctaaccctgtaagcctgcagcccatggagactgttgtctgagatatcagcagggtaccaacttcctttcttcttggcaatgagaggccacatcacaccccatgagaggataccgccaagaagaaccgacacattcacgatatatgggcagatcatgccaactccaacatatgtaggagagaaatcaaagaaaaacctgaaaggtaacaggtcaagtcaaatatgggagaccaatggcttggaactaagaattaactattatccagatggtcagacactagacattagtaactacagtttttaccacagccaaagacgacagaggtagtgtttcaccagatattagctataggttaagctgaggcaacggacatcatagtcaacactgttgttaaaaccaatgttatgctatacttctgagttctgacctgttgttgtaagcttcaaggcccaatgttgggaagttcttgaatccacagtcatcaccagcagtgtagaaccactggaaaaaaccccagaagaagctaaacagaaagtacttgcccaatgtctttacttgtttcctgaaaaagatggttatttgtcagttgaattgcataacatttacggatatactgggctaataattggcactcatgaaagtagcattttatagatatactttgctagtttggcaccctctggtgtgtgaaaaccattgatgagataagcagttgctgtgccacttggataggtgagcttgtaatcaacaatcataatctgaaacaacaattaagttaggatggataagttttccctatatacagcaattcagtaaaactagaaggtaacaggtttaaggcatacttttcttaggggcacaagtgcaaatagcccaataaaactgacaaggaaaagaaaaccaatcatccatccaaggtgaggatccttgatattttgagcatctttagcctctgttgcttgcttggctattgtttcactcattccaaataaataactgccaaacccacctgatcattggaatttggaataaacaggtacaaaaatatgtcaattggcacaaatttttgttcatacattatgacattctagcaagggatacagtttcataaaggtaaacagacatcaaaagaaaatatgagatgctttgggcaaatgaggcaaggaatcaagcaactatctcatgcatggtgcattgacatattattaccacttaaaaacatagtagataactagttaatcattggttcaccactttcttggaaacacttacttgattttctttgctgttttggaatagaaaacagtaaacaaacttaattctggtgttaagaataacttatatccatctgatgcacatgggacatccttacgaaattcctcatatactaggcatctgcaagtaaacatcatgccttgccacatgaaattattcgaatgatcatcagtgtaccacgtagcatggttctcaaataatcctgcagaccattataattgtttatgccgatccaaatgctttcacatgcatgtgtcatgtctgcctaagcaaagaaaaaaagaagaagcatgcgccatgcatttattttaaggtgaggagtcaaaccaagcaagctggtccacttcagcttgtccttactcctgcaaacgtcgcatcctaaacgcaaatggcttttcccatcaaatgagagcaatgcagcgattttcttaccagcacagggaaaaatatagtgttgactatctatatccacaacttagctcacctaataaaccaacttccaaaaccaaaatcttctaaagattcgtcccgttgctacacaattcaaatcaggtgcactgaagtcaagcagctgtttcgtgaaatcagaaaaggtagaaacagcagagtccactcaactgcgacaaagcagcatcaagttgacaagtccgaatccaagaatgacaattcttcaagttttccagtacagttctcttatcagaaaccgcttttgagaccgatgttgtagtagttgttgtttttttcttcaggggcacaagaacaaccgattccgtgatgtctcccagctacccactaccgcgaaatgctacacttccccagcgactctcccacattcagatcagatctgctgcatcatactcccacataaccacaacccaaaatcgcaaccaccagtaagagtaacgttgtaacacgctgacgcactaaccaaatggattcctctaatactcgctccattcaattcggaggtagacataagcacacacagtacactcgctgcaacgaggagtcccaatccaacaaaggtggtgcagtagaagtcagagtaaagccgaaagcgtcgaagacgtttaccgctgaaggcgatgccgtaggcggagacgacgcaggtctggatgacggtgttctcctggcgcgtgaacggctgcttgaggaggccaatccgctcgacggcggaggtccagaggcggacgaagaagaagccaagcaagcccgcggagacgttgagcgacgggatgatccccgtggtgaggttcagcttcatgacgatcacgctgaacatgacggcgagcagcgcgctcaccacgaacgcccgcagcgtcagctgctccctccacgacggcaccgccttgtccgcgaacacccgctccaccgacgtcgcgtccgggtcgtcggcgccgccattgcgcccgccgccgcctccgcccgccgcctcgtgctcttccgcgcccttgcccgcgtggcggtgccggagcgtgctccccgccgccgccgccgccgccgcctcagcctccgccacctcctcgtccccgcccgccgccgcggcggtgtgctgcgccattgggttggctgcttcggcctcccggttggtgattgattttttttcgttcgaaatggtgggcgagaaaaaaatttgctgggtgatgggagaggcctgtgcgctgtgcgaaatttattgtgggggctttggctgggccccacttccgtgcgggtgtcagagaaaccgggtgctgtgacactgacccgtggggcccacctccgtcaccttctttggtagccgtcgagatgggatcggacggctcgggatcagtcggacgcggtgtgctgctactgagccgtggggtccccaccgccaaagctgctggtatccgtcgagatgagatcgaacggcgcaggagcaggatccggtgtgcggttttgaactgttgaccaaaccgtaacggcaggagttgtactggatgaatttattgggattacattttcaaaagagtatttcaaagttgtttttagatgattcactgatatggacagaaacggaatcttaacccaatcagaatcgatcggtcgtgcttagcaacttgtcctttttaaaaaaatgatgatccctcgttacggataagttgctctgatgaggcgatggtactagcaaattgcattacatggatttttgtttccgtctatcaagtggcagtctttctccctcttattgctcccaggtctccatcgttgtgtgattgggctcgaaacaattatataaaaaccacgtcattttctcgccgaggattattagagcaaatagccaactagtagctataaatcatctattgctaatataatactagctaattcatataataattgattcctatactattaatatctagtcctatttatcatacacacattacgtcttagagatcgtgctgcagctggctacagatatgtagcccgctgcttttctctctcttcttttatctgtttatagctagtttacagtacgttgtgttattgtacttctcttagcgagatcgcttgtgcgaggcgaggtggcatggtggattgccgcgcgaaacgaagctcgtgatatctctccgcctttttccgagtttcggcgcgcgtggctcgctgtatcgatcacttggcatggaccaccacgcgctagctcttggcaggcgccgctatccagctagctcgtcgcatttctgctgccccattccgcagctagcactagcaccaagcgtgagtgaccacaactttgtgtgatttctcagtttctttgccacgcaattgccatcgaatcattgatcgctgcttgagatattataattcaggttataagatattttaactttcatcaaagttaaactgctttaagtttagctaagtttatagaaaaaaatagtaatattttcgacccaagataaatttattataaaaatatatttaattattaatttaataaatctaatttggtaacgtaaatattactatatttgtctataaatttagttaaacttaaagtagtttgactttgaccaaagtcaaaacatcttgtaacctgaaatgtagggagtatatcttttatgttgtttccattagcacattttaaactgctaaacgatgtatttcgtacaagaactttgtatatagataaagcttaaaaatattaggtaaatctttttacaaacttataataattaaaactcaattaattatatggtaatagtttttttccttcattttcatcttcagtacgaacgaacacaacaataatctccggtattggagtattgacagaggcatgatacattggtagtcggcgaaagaaaaataaaatttaatttatttagctgaattagaacatattacaaattatttatatatgagtagcccgtgtccatcacgagtgaggtgtttcgctcttgaattctccgttttattggatcgtttagtagcggctagcttggcatgtgaatgcgatcaagcagcagcggttggatcctagttaggcacggggtgctaacgctacgctgtccatgatcgtgatctctcacgaagagtgacagaatactgctgtatcagtagtactatggatgagtggatggctaatgcatgataaattgccggccacgctggcttaaaagaagattcttttgctaaggattcgctttgtttagctagatttagtatttgaatcttttgaagataaagataaagataaaaatcaagtgttcctcgtaaaatgagatgataataacgtgtgattaattgaattttcattattacaaacttggaaaatatattaatctgatattttagaggaacttttatataataagttttcgcatgaaacgcaccgtttagtagtttaaaaagcgtgccacgaatatttaaaatttcatccactgtttttagtagaaacgaacggggctgcgacgttgaaattcccttgtttctgagagaactgaatttcctttaggacaaacttggttcttcagcctctgcgacgttgaaacttggaagcataaatttcaggtttaacatgtgcacagaatttgtaccagcatcacgggatagtggacaaacatgactcacatcaacaaatgaaatatggagcctttttacagaggttgctacaaaagaaacccactgtctcaattatgttattggcgtgctgacaacatctgcttaatctcagataagaatgacggcaacaaaacggtggtctaactctagtttatcgagaagttgtcattatgctattttaaatggacctttcatgttaaactcaagttaggaatccatgaccgcatatccccatgacagcatatgctgtggactatggtagtagtattataatggtggacaatttgtactacaggaaacgggacgtctgaatcagctgaagcgatacgtctcaagcactaaaccatgaatagtgtagaagtatcgtgtcatgctgaggcgcatgcatcctccgttccacacggatcttggttgctttcacgcatctgatctgctgaaagcaaccgttcatggcagatctgaaagaccgatacctgtcataggaacaaccgttttacatggaagtaatactagtatgtctgttctctctatctagaaaccctgtttgtagaaggaaatttgttctctcttgctggctctagagagacagggcaagtttagtagagtgcagagttaccagtactctagtagagtgcaggattcagcgaaaattttggctgccatcggttgaccgattgctgataatactccaaacaacatattagcgataaaaatgtaatttagggttgaaattttcatacatgtggtcttgatgacgtcaatgttaaaaaaactacgatgaaagtatcaaagttaactccaaaattaaattttaaaatttaaattttagcattagcatacatgttgtaggttaaaagatgtggccctctgctagtagagttcagtattaagagaaacctgcgatgtgagagtgtctgattgcactgtgttatcaacgggatttttgactatttgccatcttccccaatgcaacactcccaaatgccatcttcccaaaaagtttagataaattgccactggatccatatattagttgattcctagccattttatttctttttgatgccacgtcagctttggatggggcgaaatccctattttgccctttgcactgggagtaggagaaaaactccaatatttgcatcgcttcctgccccaggatttgcgtctctactcctcgttcgacttcgcatcgctccttgcttcatcgattccgccggcagtgtccaaacgatgacacaatcccaggtaaaagaacaatagatccttcatctttccctctctttggtttggcatcaaattttttcctgatattctttttttagattggtctgtctagcgtttgcaggttttgtctgtatgttccaagctgtgtttgcttgtgaaattattgtgcatctataagttatgttggttgtgtattatttgccgtggactatgttaaatttggactgaaaggacaggggtattaatgtcattttcttgatggtgtcatgaggtggctgctgatgtggcgtcaagaatggaccaaaatggtagaaaatcaactaatgtagggggaccaatggcaatttattcaagttttttgggaagatggcatttaggagtgtggcattggggaagatggcaaatagtccaaaatcccgttatcaacaggatcccagcaccatgcacatttcatgaaccggggttgcgacttgcaacactgtttatgtctttcacggaatagaggtaaagttagtttcaacttgcgtgctgcatttatgcaggaaactgtgagctctcccaagcatcgccgaaaggggattactcctacttagcttctcgttttgtgcaaactgcggccagctagtctagcggatcctggggacgatgatccccgcaaaccgagggtcaccatgagcttcatataggatgtatgtatgcattatggtgtgccgtttcataatgtttgtatacatcctaaacactactccctccgttccaaaatatactactcccaaacgggtgagacgcatcttagttgcacttaattcctccatgctttcttgttgtagtatttcacaaaaccccagtctcaagtctcaaccaaatagcagcagcctgtggatagttgatactgggatgaaggttgccaggaaatgacaaagtgaaatttcagtgacttcagagttcagacttgcaatgcaacagtaatgtttcgatcaatcaccggggatcaacgagtgttcccgcagcatggaggtggcaccggcaacttgtttcattgcttttggccttttgccatgtcttccttgttgctgatgcactgcaaaccttcgtctgaaatctgcaaacaagggttatactcatacaagattacaacctcgtcaacatgatttatgagcaatttcagtgggatgtattgggaaataggataaacaatatgacagcagcacaacctccgaaaccacaagcatcaccagcagcatattttctttcaatgctttacttgcataggcatgcatggaatcaaccaggaactattgctcaaaaaaaccaaagcaggaactgaaatgagaactccaggatagctgaagtttaggcagtgatgtgtttccttgtgaaattcacttcaatgccgaataatccaggcatcaacttactgtaagtttgtaacagttagtacagaacatgacgaaagctccaggatagctgaacttccggcagtgatgtgtttcattgtgaaattcacttccacgccaaatagatcagccatcacattattgtaacaattattactgaaggtgaacaccacaataaatccataacaacgaaattataagcattgtcagcccaatataactcttagtggctcaggagtccacatctagaaactaatgtttacctctgtacttgggagcattagaaattcttcctttgtagagaatgcacaatgtaaaaacatcctaaccaaattaaacttgaaatacataaataacatctgattaagcagaatcccgtggcatttcctcactagtggacgcctctgccatacattctgtttcatcagaagaaggatcttccagctcaagtgtctttggcatagcagcctcggcctcagaaggagtttcttcagatatacattctgcccgagtacctgcatctccgctatctgagttcaacccaagctccttctcgagtttcatccaccctgacagcaattgctctgggaacttcttcttcatcttggcaacaatattctttgcctcagccaccctgccagcctttgtcaatccctcaaccaatccactcattgtcctaaaatctggcaccttgttgctcctatagctttccttgaagatcaccaatgcaccgtccaaatctccatgggcacacagctgtgccatcatatgcttgtacgtggcagcgtttgctgagcaccccttctcgcctagtgatctgtacagctccttggcagtctccatcttaccatgcttgcagtagctagtcatgaggaaattgtaagtgatggtatccggcttcactccagcttcctccatttctgctatcacctcaagcacatcttccgtcttgccgtgaaggctatggtgcatgatctttgtattatatacagcttggtcaggcttgcgtccgctctccaacatctgcttccacaagcgctctgcctgctccatcttcttctgcttatacatggaatcgatcattgtggtgtagatactattggtcggcgtgaaaccctgcccacgcatttgatctaacacctcgtgtgccttggcgtctttgctcagcatgcagtatgccttgaccaggatgccgtaggaggaggcgtcaggtgtgatggagaactccttggagagctcgtcgaagaggaccgggacgcggcggtggcggcggcaccggaggaacacggagaggacggcgttgaaggggagcggggagatcggggacgggagggacggcgcggcggagcggaaggcggcgagagccttctcggggagggacgcggcggcgtaggagcagaggacagcggcgagctgcggctcggtgggggaggccgggatgtgggaggagaggagggcctcggcgtcggcgaagcggcgggagcgggagagcctgcgtgcggcgagggagagcgcgtggcgggtggaggaggccgagagggaggcgtcgtcgatggcctcgaagagggagacgacgcggtcggggtcgtgctcccggcggaggcgggtcttggccgccgacgccgtgagtggctgctctccagcggcggtagtgagcgcgcgaaggagagcgtcggcggcgtggctcccgccgcggcggcggagtaggaggagggaggcgagcgctgccattttcgttgcggaggcggcggcgagtgcagaagggtttttgggtttcgccgcgtcactaggttttgtggactagggagcggccattactgggcctattgagccgagcatttctaacgttaatgggcctattgggccgtgcaatctaacccgtactctttctgtatcatcggcaagcctcatcaccggaccaaagccggcgatccactactccccaccgcggccacaccgccggcaagcgcggcgagctccgcttcgcgtggcgagtaatcctcctcttcctccgaccacagagccctcctcgagcgcagaggcagatgcgaccgtagccaaaaccctaaacctcccgaaacaccggggcgcaccaccctacacgagccgcgggggcatggacgcgctcgtctcggcggcgctggaggaggtgtgcgcccgcctctcgcccggcctcccggtcaccgacctctggccggcgctccgcggcgcgctcgaggcggccggcctctctcccggcctcgatgccaagcgcgtcctctgggcccgcctcatcgcgctccccatcatcagcctcgttgtgggagagggggacggggcgcccgtcgacccggtggagaaggacgtggaggaggccgagcggcggggggtgcggttggtcgctagcgccgcgctcagggacaacttcctcgggatgtatgaccgcaggttcgcgaaatcggagttgagcgccgtccagaagggggcgcttgaacgggtcggagcaagcaggtgcgttctggcgtaaccgttgagcaaatcatcatatgagctggtggttctatgaactgggaggttttttcccaaatgctgagctactatgcatgattgtcttggcaaaccaaaattgggtggggttactcacaatttggcatagttataaacaccatttccttagatgtattttggtcttacctttattatttcgtgagtttaatgcaggaacctgcatatattctgatcattagcaattagcatgcatttgcaaattacataagaagcatggtcaaatagaatagcattatctttctgttagccatatatacattgttccgtaatgtatatataggcagagaagatgattgattttgaatatttgcactgtgatgttattttcctttgtttctcataggacttctggtgtaacgcaaaatgatctatgcaaaactttccgtatgaaaggaaacaacttccactttattgtaaagagccttcagtcgcagaagttaatcgttaggcagtcaactattataaaggttaaagatcatggagctgatgccgaagatgcttcccagaataaacaaatcatcaatactaactcattgtatctctcgcgatatgccaaaaacctgaatatgaattcacaacagagaattgagatcataaagcctgaactactgggcagcaatgaagagagcaatggagatgttttgcaagaagatggggcttttggtgtaaatgacaaaaatgatatatctattcatgattatcttccagcaatgaaagccatatgcgataaactagaagaagctagtggaaaggtcaactgttccttcttttcttttccatttggtattctcctggattttattttttctctatagttttctaactctctgctattatttcatcgatagactcttgttgtttcggatataaaagtagatctcaattacaggatgacatatgggcacagagcatggagaaatgtaagtttgctcagaatcacttactgcatatgctctctagtttctgctcttctggttttcctccttatagggtattactgagacactgtttgcttaggtactgcataggctaagagacgcacaacttattgaagaatttgatgccaaagttgatgataaggtgacattaatctttcctcctgttctgttggcattttcaattaataatgtatgctctattcagtaatagttttgggcttgtcagtgcttcctgtcaggaactggaaattagaaaagactttataatttaccatgtccatatgtacccctcttgtgctgttatctttcacctggtcatatactttgtgagccaacaagtgataaaggtattccttttgttcagtttattcgctgtttacgtctgttgaagaaattcgatccaaatgaatttcagccaaaaagtacaacctcaaactacaaacttggcaagaaaggccaggcaactgatcaagtcatggagcttccattagagaactgtatatacgatatgatcaacgctcaagggccaaaaggaataacccttgttgaggtacttcttgtaactttttcaggagttaaattatacatctgtgcttttcaatgacatattctacaaacctacaaactattcttttggtatacaggaatatgaatagttgtcttaatggcatatatgtacggcttcttgtgggttgtaactggttcatttctagtagcgtaaatacataaattttgtctctagcagcatggcctataacatatctatatttttgactaacttactggagcttctttatgatataaaatcttttctgatacattattcttctggttgaaatccctaatgaaaaaaaaagagcttcatgtgcaaaatgtcctgtcatgatgagactagcattgatgattatatagtgcagtaaagtgtcattatctctctactatgatcaacttgtttatctggatttaaatataattgcttttgcatttttaaagcttaggttagaagctgtcgtttacttatttgagttccatggcaatgcacatgctattgtcagtgtgatatggactaatattgtcagtgtcatctagtctcttactacttaaaagcacagtcatctgtcctccccttcccccatgttgtgcgctgcgtgcccctcttgaggaaaccagaaaatcatgtgctttttactctgtcccaacgcccagccttttcccagtcaccccacccccagcccattcccagccatatgggcctataaagcatccaatagcccatcctaatgcaatatcttgttgcaaagcatgataccttattagtgcagcatgttagtgttctgtatttcttgaagttagcaactcatgttttcatgtaacttccatgtagcttggcaaacgtcttgggcacaacaattcaaaaaggcttcataagcgagtgtcatccatgcttaaaaaatacaatttgacttgggaagctgaagttcaagacaagacatcacaataccgagtttggacttcaaaaaacttttcacactacaaagctggtgctgctctgcataatttggaggcactcccagatgaccacgagaagtgttctgatttgtggtcattagttccatctaaaggatcagaatctccaatctcacgggttgatttatttgttgataataacaagcttttgttggaagaagaatgccacaataaaccagcaggacatcccctccagagtaaccatgaagcttgcgttggggtttctcaaattgttgaacaaggtacagtgatctatgttcctggtagtttctatttattctttcaaaaaattgtgcttagtacctctttgggggagtgccatgctgttgtaggagcttgtggtattttatgctgcttaaaacttcacttattgaccttacttttgaacacccttagtcgcatatatccaaatggcttcacattttcgtccaagtaaatgtgcagtcatatgctctgtttaataagctcataggctcataaccaggtatgtaatctatttcataccctgcacctttttttttatcgagtattccaaagatcaaaagtaaaggcaagttctgacagtttgagagatttatacggctgagttagtgatttatatttcatccagttagtacagtgcattttttgagaactgtatgtgccaagcttcttgcgaactaactttgagttctgcgagttatttgtacttgtcatctgtgctccctgtgtttctttttcttaaggaattctttgagttagcacgatatccaagttgaactttgaccataaatttcttttaggatttcttatcaccacaaaaggcgatcatatgaaagtacttttgaactgaatctgtgatacaacttttatgctgcattgcaagtgaacctacatagttgtaattaaatgttgaaaaaagaattacaaagtttgaatgttgacatatatgagcaccattaaaatcaatgagcttaaccaaagtgagccccttatttctgttttagagaaacttgctttgggtcagaggaagaggcgtcgctgccctccattgacttctgatgatcgacggcataggaggattcttcacatgctaaaggttactaattgagtatacaacactcaaaagtttttaatatgaataatgtgccaaaataccttatttcattatcatgtgcatgcatggtgtaagtgcatccttgcatgtaggactgcatattgttatataacacctttcctttttccctttgcagaaaaagaaatttgtactaaaggtggagttacataaatggttagagggacttgaaaaagaaaatggaaaaataatggataggaagacattgactcgcactttaaataagcttcaggaagagggcagctgtaaatgcatcaaagttagtgtccctctggttacagactacacccgcagtcgtctcattgatgtaatactgcattcttctgttggagacttgtcaccggaacttgtggatcaaattaggaatagacaaaggaactttgatacagaaactcgttcaggtgcagcagctaaattgaagcaaaatcaacacacgactgctatacttggattgaggattccgcgcagagttaaagataacaaaccattaatattagaagctatgcatgccaatggattcattggtgcaaagatgattcgagctaagctgttccataaatttctgtgggtatatgttagtggtttgccaaattggtgtgacccatttgataatgacaaagaagggcatcatgacaagaaccttagtcaatcgtctgtgttgttttctatggtgggagctacaaaaaaaatgcctcttgaactctttctgcaagttgtgggatcagcaaagaagattgatcacatgattactaagtgtaggcttggaaaaacgctttcagaaattcctaccgaggaatacaaccaactcatggatactcatgccaaaggccgactctcacgcttggtaaatattctagataagctcaaggtaatgttttgtctgtgatgttggaattaacgttgtgagagtcttgaaccttaggcatgctctttaacattttttaggtctatattggcctgctgcatatctgtcttatgaattccggttaatgtttattgtaattcagcttgagaagaattgaaatgattagttctttcgttttgtttgctagcttgtccaacttgcaaaggaacttgtagatgattctggtgcgccatcagatgctttgcctacacattcaatagagctgaggccttacattgaagagcctacaccaagaattcttccatcatcccatgttaatgtgaaccatcggccaaaaattcggcatgattttgttctttcaaggcaggagtttgttgatgcttactgggaaacgttagagtactgttatttaacagctggcttggctgagccatcaagtgcctttcctggctgttctgtaccagaggtttgtcattgtcaacattcattattgcattgttacctaataataatgacttattactgttgatttatctgttctatttttaatggtcattttcgttttttatcccattattcacctctccaataaaatgtgtttatgtatactttcttagttctctctctctctctctctctctcctgtatgttttatgctaaccttagttcctttatttacataactctgcactttatggatatatcttctctcttttctggttgtagtaaaaaatgactctgcctattattttaaaaggtgaagttctattttgaatggccaatgctggcctgtatccatattatttgtattttcagggcatctgatctaccattactgttaaattactattcatgattgaacactgcaacaccatgtgcaaagagctcaccgttgttgaatcctgatgttgatatgtgaccgttttcttgtttctattttgtttttaactgtatattgtcaactgcaatcatgctactagttgtaaatgtgtttcaatatccatttagttattattgaagcccattacacccagtgtaaataatattgactggcattggctattttgctaatgttagaccattcgatctcagttgtgattttctcttgtactgttgtacagattaactatatgataccctatattttgtaggtttctcatcctcgttcatggagttcacttagagtaatgactactgaacaaagactggagttacaacagcgcattatgaatgccagtgagaatggaaaacttccttttagagattgtcgtataattgccagggagttgaatctctctgtacagcaggtatgtgtctgatctcgatatttccctccaagctccttagagatacgaagagctactctgttttattatttgacctttttttttaaaataatggaggggactgaaataaaaacactcattataggaattagtatttgaccttacttctgtatttgatatttcttcaacttatataccaactaatgcacccctattctttttctggttcagttctatattgtggaaagataaccctataacagattaattatatcccatgcaaagtattaaaattaaaataagggtaaagggtaaacacaaaaccagaaacagatcaacggaatttcaagacaagatgggaatgtttaatgtatcagcaaataccatgcaaagtgtgttcgtgaggttgtcctaatgcctactttctttttcttgaatgtggtgaatcaaggtggcaaataggctgtattgtgaattccaactcatgttgtaaagtggacatgtgaccgagaacatgtgtgggaaaggtgacatgtaatcgactaactggtagcaaattcgtgaaatctcaaatagatgaggtgtactcatactattctgagttgaattgatcgacaataattttatgcgatagcatctgggcctatggggaccagttaaaatagtaataactggactcgtttttctttttggactggggagcagtaacagagtctcatacgctatttggattatattgtgaggaatatttacaaagtttggaagaatgcacaagctccactggcagctcttaagggaaataatgcttaaacactatatagcaggaaacaaagtgataaatacaatatagccaagaaacataataatagtatctcatatctagttgcaatgttagccttattttcatcatcttagttgcaacattgttatggctgattttgtttactcttgctatcgtttcaactctgtttttatgttcggggccctttatgtttctgttatgtacatggtttctatccagtaacactgactggatggactgatttatgtaggtgctctgtgtatcgtcctctcagaatagacagcttcatggacagcccaccgtccctgctgcaagaaaacggcgaaaagttaattcaggatcaacctctaaaaaaaggaaaaggtctgctgatgagattaccctgaaatttatcaaacggaatgttgaaaccattgaatccactgaaccgagaccagcacagtctatcccacatgaggaggtatctgagagaatctctccatccacattccatactgattctctcccacaggtggatgaagatacgataagcagtccaaggatcagtcgatctaccatcttaagaggaagctgcatgagagagaaacgatttgtgtggacatacgattctgacaggtatttcttggttgtacatcaattattttgtttcaatgcactttactggagacaatgttttccatgatgctgggaacctgattggttatttttatctacagaaaattgctgatgatatacactagatcccgtgcaacacttggagcagtatctcatcgcgtagattggaactctctttctgatcttccagctccaccagctgcatgccgtagaaggatagcatacttgaggaaaaaaacaaacataagaccagctgtgagccgagtctgtgaccttttagggatacgatacgctaggtaccttgaaaaggaaaagagatggaaattgagaggattaccttccgaaatctcaaattctagtcatgacaactgtgtggatccagattctgagcaattcttttgggataatttcgaggatccagagataaagagtgcacttgatgaagtccttgaattcattcgagtagaaaaaatggagcagaccaagagagttgggtctaagaatgaaaggaacaatgatgataatgatgccaccaaggaagttccaaatgggcagaaacagccagtacgtactgatacatttaatctcaataaacacatattttatttaacgctgatgttttaccttgtaataatcaggttttaggtgcacgtgcaacctgtgcaagcactgcaattcaagaaagtggactccgtgaacatgcaaaatcctataggctgtcaaatgcaatccatgcaagtaaaaacatggacattcccttcagatctcatgaaaaggccattaaccataataaagatgatattgctaaaagagatgtatgcagatcattggcagttgcaaatgcattagagcttctgaagctggcttttctcagcacctcatcaggaccagaagtgcaagcttcgttagcagcaaccctccagctttattcagagactgaaatttttactgccttttcctttctcagagagaaaaatttcatggttagtgtttgctaattcatcttcccatcaatgtatcaaatttcttttgattatttcttcagtatgctctccccagttcaggcttttgaatctgtatttgttggaaaacacaatagaataatagatgtattaacaacattctgtgaattttaagatcctatgtgcactgctccatttctttggctgtgaacccaagaagtataaatgcgatgaggctgcattcctgcatcgcggatttctttgtgcagttctcggagctcgcaactacacatatctataatctatgcttgttgtgtaatacttcctccgtttcacaatgtaagactttctagcattgcccacattcatttagatgttaatgaatctagacatatgcatgtgtttagattcattaacatctatatgtatgtgtacaatgctagaaagtcttacattgtgaaacggagggagtataaatttttcagcttttacttgtcctgtagtacaagcatctgagtttgcagtggagctatggtgataatctcttacatttaaatgctgcaaaggttgaagtggttatttggcatctctactgtcattctgtttgtgctgatattaggaagaatcatttggccttagtggcatatatacattgaaccctattaggaatgatattgtacctctctaagacaaagggaatgatattatatgctcaatttttggtacttagtcagtatagttaagctttatgttttttttttaaagtgtgcttgcaatttaaggcagcatttttcaactgttcatctactttcctcctattttacaggtaactggagatggaacaaagccatacactctttctgggaaattcttttttaatgcttcgaattcacccttcccatttggttcagggaaaaaagcttctgaattttctcaatgggtagggcagcaaaagaataccatggatgatggagtttgtttgtatccagatctacaatgtggggaaattgtccagctcttttctcttgttttgtctggagagtcgttcatttcaccctcattgccaagtgaaggagttggtgaggctgatgagcctaatagctctagtttgtttgttgatgataacagtgaattggatgagagtagtcacaaacgcaaggctgatatggttaaacttaaaagcagtaagactaagaaacacaaacctttgcccaagatagaaagcgacttttgctatcgccgagagaaaggtttccctggtcttcaagtggctttgaatcaagagagaattaaaacaagtaatcttacacaagagttacatgataaagaatgccttatttttacttcagcctgggaaatggggagcaaggatgttgattcacaggtagaaagccacaatatgtcatcattgtatctaaacaactccagttcatgtcggcgtttactgtcagaatctcatttggagaactcttacagtgggtggccttgggatgctataaaaacatatgctgaacagtcaccatcattatgttgtaacaaaaatgaaccagacatattgtcttctgacctgttcagaaatgcattttgtgttgttcataaagctggcgaacaaggagttaatttgagagagatgtcacaggcactggatcctctaggtattctttagatttgtgtaacttatgttaaacttagaattgttagactatgcatcaattattttgtaagtatagttcatttttatattcttatcccctgcaggcatccagtttgtcgatctgattgttcatactctcaagagatttcagctggtcattaaggtaaatctgtgagcaagcatgcatatggtagattagtagcctacttatttgttctatttggttactggtttatcgatataattatcttaattcacttttgtttttcatatctgcctaattatgaatacttgcactgttcattcttttgcttgtcaaaatttaccagtggttttttgttgttaacaaacagatcttgttattactgacatatttttctgcacttgtagaattttatataaacatttaaaacatcattgggatagttaaatatttatgtcaaactgattaagagtggaatacttgcatataagatgctacacttactgctgctttcttgtccacatttttttatttccctactcatatataggtgtcactctattttcttgcttcacaggtcaatgcatatgatggtgtgcagattgttgactctatacataagtcaaaatatcatataactacacttgcagattcaagtcattgcagttgtttgcgagcttctgcttttgagatggccgagactggagatacagaaaatctactgagagagaagcatgcaatgtctagtgatgtgcaagggagtgtaaaaatgcttggtgacgggcacactgtgacggttcttaatgtccaaagcaagtcaagctctcctcagatacgctatcaaagtcctgtaggtcagaaaaggtcgtttactccagcacaagacaacaggggcagtgattgttgtcatgcttgcgaaaggcatatatatcacccaatattgccatggataaatggtgatggaagcatgaataacactgtctacgaaggtctaagtcgtcgtattattggatataccatgcaatatccaggagtagtggaggtgcgtgtttgttttattttttgtagctctttgttttgaattaggaaagtttcatgtatgccactgaaattgtgatttgtttatccatctatatctccaaaagttttgcattaatgttatatggcattctttactaattaatccttgttttctttaaatgtctcattttaaaaagaaaattttatgcgagaacttcagtatttgaaactttggaagtcttaacttttcaagcataaatctgaattttaaattccccggatcccttatttttggtttggaaattcaagaattcaaaatcaaggttgagacatgaaattccatattttaaaatattccttttcttttcaaattcgtgttattttggtagtttgacaattgtaattttagttttatttctaaatatctgaatggaatacttaaatcttagttatagctagcactacaatattaaaagattcatcgatacggtacaagtgaacaatggaaaattcaactattgtctaaatttaagtgttgtggaaatttccgtttgtgtatgttatggtttagcatgtcctgttttctttctgaatgtgactcccgtgtttgcttcctctatatcatttatattcttctttttacttactttctcatctcttactgttcaagttatttgaatccctccggttgcgtggtaaagttggtttgtcttaaattgatcaggcagttattttgaatgtacagatctaagatcgtttgattcccctacttagtggtgattccagttacggagttaccattatcagcaacaatattttaaaagttctgatctattgttctgctctaattatgccaggaggatatcatccatcggatggatgtgttgaacccgcaggtgcgtcacccctctactttctccttttgtacctgtatattcgatattaaaatgatagtggtttaaataataaatatttgtgaaaaggcatgtagcctagtggttgcagtgacctgagtagcacctcaaggtcctgagttcaattttccatatgagcgaatttcagattgggttatttgatggctaagtttcctatttgataggttaagtacctaatttaaaaagacagtcttgagttcaaatatccatagtagcaaatttcagattgggttatttgagggccgaaattctcagattgggttatttgagcgaattcaaaaaggctgtatatatccggttggatgtagaggctgggaaaaatacccttcttaaaaaaaataaatattttacattattccactcatggtttgttttctcctttctgcagacctgccggaccttgttggaaaagctgatgtttgataaacacctttatgctcgggtgtttgatgaacgtgccccttcggcacctacccttttgcagagtattttgaagcaagatcgctgtaaagaaccatccaagtgtaacaagcgttactttgctaacccaatgagtacatttctgctatagacagatgcgctaggctctctagtgttagttgatttgtgcatatcgtcactctcaaacgatttatattacagactagttgtacactttgtgattcgttattacaggactgtttatgctgttggtaatcagatttactacaagcccatcaacatagctacggctgtgtttagtttccttcaaacttctaacttttccgtaacataaaatgtttggacacatgcatggagcattaaatgtggaagaaaaaaaaccaattgcacagtttgtatgtaaattgcgagatgaatttttgagcctaattaaacatttgctaataacgaattaattaggcttaatagattcgtctcgcagtttacaggcagaatctgtaatttgttttattattagtctacgtttaatactttaaatacgtgttcgtatacgagagaactaaacaggcatatgataccctacagaggtatctatttttggtcgaatggagggagtagattccagtacagcgagaggtgtggaattgactaaagtcagggttgctccagtctacacgcacgacccggttcacatcgaaattgactcgttgggtgccccggttgtccgggagatgaataatgtcacatacggagaagctgtcagctgtagtcatcgccgaagaacgttctggttaattgcttgcaagtactgtactacctccgtctccatctaatcctaggttatataacatttttggatggaggaagtattatcttagcatgaacacaactgcacaaggcacaaggcacatattatcttagcatgagcacaaagcacatatacctggtcatacatggcatgccgtagtcatgcccttcaagtccaaactgaaagttaatgaaaagcttcggaagattttcagctaaaaatttttctcctgtcattctagctggttgaggtgcacgctttcgatctatgtggacttgcttagctatgtaatctctttctactctcaatttcaaaataaattaacccagtacgagatataatatatcctattgccatgtaaagagatctcgtactaggttaacttatttgggacgaagggattattacagtacatttcagtgtgttacattgatcacacgtggactcggatcaatcaacgccccacatcggtggatgaaatagtaaccatacacaagtatgcttagaaataatttggcagctctaaaagagtgatacatacacgcgaagaaccagactttgaacatgttcccacctaaattggactcatttcatcccaatcacatatatatttctttatctgtggatatactccaccccattacttgtccttgttttgcatattaagaatttcgaatagtttaagtaagaatatagtgggcgaattggcaagttgggtagaagcaacggagtgctaactgcagttttgaacgacttgacatgttacgttctttcaagaattctaacctgtacgatagcagaacaacctcccacaaccacaagtctatgtgcgtgtcttgtagttgtagtacagtcagtttcgcaacgccggccattattttcatcatctaatatgaagcaagatggtagcaatagcatctgtatcacgtttgtgtattatgatcaaaatagcattcgggcagtaccagtctttccagccggtagatagctactgaacgcgtggaaaaaatcggatgaatagggtgagtcgttgggtgagtcgagcagagaccgacagttgggtgagtcgttggccccagcaacgacgtgatatctgatgggagtagtgcccctggacttcgtcgatacagcgtcaacaaatacacagacttggtaaattgcaagaaaattgtttgctgccgatcgagcactaatcaaccgaccgcttgtgggagttgatgtcaatctcgcgtttacttacgaagtccacggacgagcacaaagagatggtgcgtctgaatataaattgaccgtgtagttaacaggcaccggcctgcaccacaaaggcaagtctcggctggcgcaaagatgaggtcgagctttgtggcagcttgtgccatttccttagtgctagtgtgctcggctgctactacgcctcgagcattagctgcagtctatggagatggcggagggctcttgtctatcccttctaatgattccctcgctcactgcccctctagctgcggggatgttgacgacatcgcctatccctttgggattgggccgggctgcttccgggaaggcttcgagcttaagtgcaacaccagcaccaaaactcctaagctctatatgaaagatggcaccacccagatcttatatgtaggtgacgatgatctttgggcacccatgcacttcaacattacaatgaagccaggtactgatacctacaacatatcctgggtgtctcccaggaagggagttactatttctcagcgtaacaccttctacattattggttgtaatattgatgtcaccttgttcgagtatggtacgagagacgctgttggttactgcgtgagtagatgcgatggtgaaaaggtaccaacagaagggccttgtaacgggaaaggatgttgctccatcaagttatcaagggatctgcggggatttcggtcaacactagtccaagttgatgctactgcagcacaatcatatcagctgcagctgcgccatggtgttatggcttttatgtcatacaatgactattatgtagataatgcgactgatcttttcttgagttggacgaacacaagcaatatccaggaagcattagttcagtttgcaatcatggaccaaccaagttgtgaaattgctcgaatgaaaaatacgagttatgcttgtagcaccggcagcaactgcctaaatatgtcatctggaggttacacctgtgagtgcgccaattatgatctttattattattatgcagaacaaagtccttaccttttggaaggatgcatcatccgaggtgattcctctctacctttctccacttaaatactactaaggcacacacatatagagagctttatttgcatatcgaattttcattccttctctctttctaaggcgcaaacaaaagtcttccgtatcggtttttcgttcatttttctctctctgtggagcagattacaaccccaagcggaaagaacactgtcggagatcatgcggaaacatggcaattcccttcccttttggtcttgaagaaggttgtttcgcaagtgaaaggttccaacttaattgtacaacaggtaacatcacacttttcaacccacgggacgcacgttataatgtgactgatgtgtcaattgaagaggggacaatggtggttagcaacttgttgaacgacacagaatatgggggagaggacataatatcccaggtgtatggtggtgcagaaataaagtgggcagtagccaatttaacgtgtgatgccgcagtaaaaaaagatgctacatatgcatgccgcagtatccacagcaattgcctaaacgtcacccatgggaacatattcatgggatatcgttgcaagtgccttcccggttttcgagggaatccatatatccaagatggatgtgaaggtttgttcctcttcattcccaccaatttgcaaatgtttaataattttatagaaattttatgtggatagtttaaccacggcatttcccctttaagcaggtagtagtgcctgtgcatttatattgtaccaatataaacaaaaaaaaaactgaagcgttaattgcagatattgatgaatgcttactgccaaactattgcaacgggacatgtcaaaatcttcctggaaattttacatgcactagttgcccccgcagaaaggagtttaatccaattacaagacagtgtgttgcatcagctaagcaacacaatcttattataggtaagtcatagctgacagattagtcaatcttattgcattaagataatgcaaagtggcttcacggcacaaaaataatgaatggctgtaggtattacaactggtattagttgtggcattggttccataattattgcattaggtgcgattattctagccaataagtggaagaaaagcatccaaaagagaattagaagagcatacttcaagaaaaatcagggcctactcttggaacaactaatctcagatgaaagcgccactaattaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcatgatcgtcttcatactgatgttagtgttaaatcctcattgtcatgggatgatcgaattaggattgcttcagaagcagcaggggcacttgcttatctgcattcggctgctgcaatacctattttccatcgagatgtgaaatcttccaatatactcttggatggcaactttactacaaaggtctctgactttggtgcttcaagatctgtttcactcgatgagactcatgtggtgactattgtccaaggcacatttggttatttagacccagagtattatcatactggacaactaactgaaaagagtgatgtatatagttttggagtgattctggtggaacttttgacaagaaagaaaccgattttcatcaatgatgtaggcacaaaacaaagtttgtctcattatttcgttgacagactccgtgagggatctcttatcgaaataatagattctcacgttcttgaagaggctcacagggaagacattgatgatattgcctcacttacagaggcatgtttaaaactcagaggaggagatagacctactatgaaagaagtagagatgaggctgcaattcctgagaactaagaggctaagaaaattccaatttctccccgtcccaggaattggtggagagattcagcaccttttaagcccaaatactggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcactccagagaatggtttttgcatgcttcacttcctgtatacttgcagcatgtatgtgtagcccatgtgagttgatagaatgacagttgtattctactataattatttgtgatcaatatccttgtaaggaatgacatggtattgtaatattgtatttaagctacggtggcaaagtgaacaagttcagtaataattttattactccattgccaatgtcttgctcagtaagggtcaccaataggtatctgactaataactcagtttgtagtatgctggatctttttttccacatagcagtgacatcgttaatacggagtattatagagcttgtcggaagtcagaacttggaactcagagaacgttccgaatgcctttacacaaagtataaatggcacggttgaaattttttatttcatcacttgtccaaaaaccctgcattcataatgggaactgtaaaattgtttggatttggtgggataaggtcataggaattgggatatatatagaggaaatctaatttatggtttgattgaggaataagggaaaaaagtgaagggttagaatcagtccacactccacaccccatcaccatctctatcccaatagcaaaccggaccacaagtagtagtaagtacctatgctgcaaacaaaaatgctattgtctttggctccaaattctctagctttgcaaaagacagtttagtttaccaatggtgataatttgactatggagttaaccataccagtacaattagacttaaaaaaagaattcaaacctagattatgcacacaaccactaacacaccaagcaaaacaatggagattgccgtttgacaagggagcgcaccaatttcggttcgaacagacgagacaaccagagtggcggcctgctggcctccgcgcttgggggaggcaccggccttctgatcgcgccggggaagaggaggagcccgaccgccgaggcggaccaggcctccctttcgccccccgcacctcgacaccgcggccaccagttgacggccgagcaagaggcgcggtggtggaggcgcaagggctctccgctctccgcactccgccgtccgcagcactctacgctatttgggctcatgggctttgtattctttctctctttctttttccattttccctctgttcggctttgcagttgtgccactttgtcgtgattgtgtccgttattttcgtgtcgctatttgctcatgctgcctgcgccaccgccatctcataaattagaggaccaatgttggcttgctcctgcatataagaaacacagtgctaatcaacttgtagggcagaacttctgactgtaagtagagagagcaaagagccgtaattttgacaaattgacccttctataaaacttagtttcaaaataagtcgggtcaaaaattaatttcaatactaggccgtgaccttagcgccattagggttggcgctgagctaagctaaaacgtccaagcgccagcattgttggcgctaaggtcatatccgacgtggaacatattagccacgggctaagcgccaaatgagttagcgctgacctcttagaaggtttaaaattagtgtgggcaataactgacacaagttaaatctagctcagcggttggtcagtgtggctgcaagccagagttccagggttcgtttcttggtaagaactgagaacctaaatcatacaacataaaattaaaaatacaaaattataataattgagctaagtatttaacattttaattaatgttttcaaatttatttattccagattgaacataaaataaaataaataatccccttaaaaagtaacataaaaataaatctacaaacaaaatatgtgattgtttggaaaaaaaatttcaatagaacaagattcaaagaggaagtaagaaaaaacctgaaaaccggctttcccggttcgaactgtgaacctgtgggctggagtagaggggcctgaccactgagctagcttctgcgttatgacacttccagcacacattcttttaaaccatgtaaatatcagcgccagcacacatgacgctgagctcctcttttgtggctaatccgtgccacgttgaacgtgatattagtgccaattagagcaagtttaatagtatagccaactactagcttcaattcatctatagccaatctaatagctcattcgtataatagttatatattatactattaatacctggtcccacctgtcatacacacattgtgtattgaagtccgtgctacagctggctacaaatctgtagcccgctgctcttctctctcatcatttatttccttaaaatatgtttgcagctgacttatagcctattattgtacttgctcttagggtggcgctggtacgttttatctcagcaccattggggttaacgctgaggtcggcctagttttgaaattagtttttgacgcggcttattttggaaataagttttatagacgggtcaatttgtcaaaattacgggagcaaagagtatacaaaagcaagagtatacaaaagcgtatgtggctttatcgtactaaagtaattctagtttggcaaacggcgtcggccttcttttgttcatctgtatgaattagtaggagattgtggtaattgtataacgctagtgtatcgtgattaggatttgtgttacgaactcttcctgggatttctgtcgaacaattggtgagcaagagcgagagagggagacaggaagaatagaagagttcaggacataaagaacaaaggattaggaggaggatgggatttgaattatagagaggtttcagtacaatgtttttcgataccgattcccataaggctaggcctttatatacacatgctagccactctcttacgcaacccagtctggcccaattatacgagtgttgggctgtcgctgtcttgagctcttcggcctggtcttgacagggttggtaacatcctcccctccttcacatccggcttgtccccaagccggagcagcagggtaacgctccttgagccgctccagatcttcccaggttgcctccgatgttggacagcccgaccagcaaaccttgacttgatcaacagccgctgatccccgacgtatcagtctgcgtgctagcactcgcactggaacaggatctgcttcttccaccgctggaggtagggtagctaccgtagaagaagctggttccgatgccttccgaagttgggacacatgcaccaccgggtgaatcatagaagaagcaggcagcgccaaccgataagccaccgcccccacccgagcagtcacctgaaagggaccaaaaaatcgaaaggccaacttctgattaactcgcaccgccaccgaggattgcgcatgaggttgcactttcataaacacccagtctccgacagcaaactgccgctccaaacgcttcttgtctgcttgatgtttcatgcgctggcgagcgcggtggagatgttgatgcaacaacgaagtaataacagtgcattccttcaaccattcttgcaaatccggcactgcacaggctgcgatatcaacaataccaaagtgccgaggaggatggccatacaatacctcaaaaggagaagttcccaaagctgagtgcagagaggtgttataccaaaattccgcaagagccaaccattgagaccatttcttagggcaagcatgcacaaagcaccgcaagaatgtttccaaacactgattgacgcgtacagtctgcccgtcagtctgaggatgataggccgtactcatacacagctgagtgtctgccaatttaaacaaagtggtccatagagtgcttgtaaagatccggtcatgatctgagatcaaagactgaggcagtccatggagcttataaatgttagagagataagcttgtgccacatcaaaagctgagaatggatgagctaaaggcacaaaatgggcatatttagagaacttatcaacgaccaccataatgcaatcaaaacccgaggaagtcggcagaccttcaataaaatccaaggataccatttgccatgcatgatccggaacaggaagcgactgcaaaaggccagggtagcgaacccgttctgttttcgcttgttgacaaacagtgcaattggccacatatgtctttactgctttcctgagccctgtccaagcaaacaaacgcttgacacgggagtaggtaacctgtacccctgaatgtccacccactgccccaacatgtaaagattgtaagatttgagactgcacgtgcgggttagcaccaatccaaactcaccccttatagcgcaaaataccagattccaaggaaaaatgaggtaatgcgtcagatttgagtgtcagttgagccaccagctgagaagaatgaggatcttgatcataccccttttgaacttcctcaagccaagctggaatacaaactgaaagagacaatacttctgttgaatcatcggccactcgtcgggacaacgcatcagcggcgctgttctcactacctttcttgtaaaccaaacgatactgcagtcccatcaacttggttaaggctttttgctgccaaggtgtggctaatttttgatctccgagatgaatgagactacgttgatcagttcgaatcacaaactcagcaccctgcagatacgagcgccaatgatcaattgctaggagaatcgccaagcattccttctcataagtcgacaagccacgattgcgaggaccaagcgctttgcttaaaaatgccaaaggatgtccctcctgcataagtacagcaccaacacccacagctgaagcatctgtctcaatttcaaatgtctttgagaaatccggcaatgcgagaactggagctgaagtcaaggcagtctttagggcatcaaaagaagcttgagtttcagcagtccaatggaaaataacattcttcttgagaaaattagtcagggggcgactcagaatcccaaaatggcgaacaaatttgcggtaataccccgctaacccaagaaatcctctgacctccttgacattagaaggcaccggccactgcagtactgcctgaatgttcttagcatcggttgacaccccttcagcactgatgacatgtcccaaataagtgagagatgaccgagcaaacacacacttagatctcttaacttgcaactgattggcagagagaatatcaaatacagcccttaacaagcgcacatgttcctccaaagtccgagtatagatcaaaatgtcatcaatgaagactaacacacctttacgcaagaatggctcaaagattgtattcattataccttgaaacgttgctggtgcgccggtcaatccgtaagacataacccggaactcgtaatggccattatgtgtcttgaaagcggttttatgttcgtcttctggcttcatacgaatctggtgataaccggctcgcaaatccaaactcgtaaaccaacaagctcgtgccaactcatcaagtaactcatctataataggcagagggtaccgattcttaacagtgatagcattaagatgtctataatcaatgcaaaatcgccaagtaccatccttcttctgcacaagcaacacgggagaggagaaaggactggcactgcgttgtatcactccttgtttgagcatgtcagcaacctgtcgttcaatctcatccttttgtgccggactgtaacgatacggtctcaaatttactggttgggctccaggcagcaagggaatagagtggtcaaaagctcttggtggtggcaagccagagggttcatcaaaaaccttggcaaattcctgaagcaatccctccacttctcttggcagaacaagactgattgcaacagcttcactggcacaaagttcaactgtgtgtaggactgcattatgatggaagagacccttaagttgatcagccgaaataaccgggcaacagctaacatccggcaccacaccctgtaacagaacctgcctgctgtccaacacaaattgtatggtcttaagcttccaatcaatttgcattggactgtgtttctctaaccaatccatgcccagaatgacctcataacagcccaacggtaacaccttaagattagtgctgaaggactccccttgtacccaccaatgacaattaggaaactcctgacaacattgcaagataccaccatccgcgattttcaccttcagaggagtcagcgagctgcgcacaccctgcagtttattagctaacttctcactgataaagctgtgagagcttcctgaattaaccaacatcaagacctcatgtcgttggatcaatccttacaaacgcaccatacgagaagactcaataccaagtacagcttctcgagaaatggccaataactcaccatcatctgattcagcagggggctagtagatgactccacttcctcaggaacctcatcagaaaaaagctgtagcacttcttcaatcacatgcagctgcacagtagggccacaacgatgatcacgactccacttttccccgcaagtgtgacaaagccccttcgctcgatggaaagccctgagagctgcaactttatcagtagcagaaacttcagtagttagcttatcatctccctttggcacaaaaggtccaacaccagtgtgcaagggtcctcgggctcccccagtcggctcaaagcgacgcccctccttgcgattctgttccagtacttcctcttgcaaacaagctaattccacggcagtatccaaatcggttgggcaatgtaaaacaacagcagatctcacttctgccttcaacccatccatgaactgagtaacaaagaaaaccgaattccacgagggatgatgcgcatgtaacccatgcatcaactcgttgaacttttctgcatatgcccacacagtgctagtttgccttaacctattgaactgtcgaatcaaactttggaactcctctctaccaaatttcccacacacccaggcagcgaattcctcccaactcccactaacttcatgagctcgggtcgactgcaaccaagtcaatgcagtacccgagaactggagtatcgccacaccaatccagtgatcagaaggagttccacacagcccaaaataagtctcacacttcagtttccaggccttaggattttcccctgcaaactctgggcactctactctagatgcagaaatttgacccccaaaactaaacccacggcatcccccactcgactcaggaactgaatggaaaggggaagtagagttatacgcacccttgaccgggggagttcgtggggagttgtttccccacacagccttcccccggtgattcgaagcctcgtggtggcaaaattgcctaggcgctcctttgccgaacgccgacgtggaaggtcggttttccaccgtcctcttcggcagccgctttgccccaggcggcgtcggaagacgtggagccatttcctccggcttgacgggatccggcttgacggactccgacttgacttgatttggggacggcgcgggctgcttcaccatcttctcgagctgagcgcggatgtcgcccacctcgtcccgcaattccgccaccaccttctctaccgtcggcttccatcccgctagctccacaaccatcggcttgatttcctcgatggattccaccgaaatcatgatagcctcgttctgcttctgaattgaagtcatcgtagtcatcagctcgccaagttgctgctccatctcgttcgccttgagttgcgctcgcgaatgataccgtggcttctctagataatccagattcgactgctctgataccaaatttgttacgaactcttcctgggatttctgtcgaacagttggtgagcaagagcgagagagggagacaggaagaatggaagagttcaggatagaaagaacaaaggattaggaggaggatgatgggatttgaattatagagaggtttcagtacaatgtttttcgataccgattcccataaggttaggcctttatatacacaggctagccactctcttacgcaacccagtccggcccaattatacgagtgttgggccgtcgctatcttgagctcttcggcctggtcttgacagggttggtaacaatttgcaccttgccactctttctttccagctgatactggatttgtggaaagaatcggcgagttaattggcctctgcaacggacgtagattttgcaaggataatatatagtagtaccacattcttaatagttgcaatatactccatccgttttatattataagttgtttgacttttttctagtcaaacttatttaagtttgattaagtttatagtagaaaaatattgtagtattttcaatacaaaagaaacatattatcaaaatatactcaatgctagatttaatgaaattaatttggtattttagatgtttcttttaatgacaagagcccaattttcactcagaaaatgttgaaatcatgagttcccaatgttttcatggggaactgcagtctgcgggactatatttacgaatctgctcgtaatagcttaacaagacgagcatagtgaccctatacggtgacaaatccagcaaatatcctctaattaattaagctagcaaccccaatttaatcactcttagggcatctcctcagcgtgcctccggtcgcaaaatataattttactaatgaccactcctacttcagagtgtgtttcgaaccagagcttgttatatacgcacacaaaagcagccattgcatcgagcaataataatattgcagtttgacgagggagcgtaccgatttcgaacaggaaattaatcggcgctgagctacagcggcgtgtcggcctggccttctgccggtgcctccgccatgaggaggtgctggaagctgaggtggacggcgccgcccccttccccccgactccctcccgaggctgtggcttagttgcttgcgatgaactgtggcccgcgcaccggcggtgaggtctgaggggagggcgacgagcggcgctgccgcgatgaggccgaggggatggatgttgctgccctggacgatgttggacttgaggtccagagttgagggctcccgttgcacgtggttgggcttcttgaggcccaaaaactaacaggccgggaagaagatcgagaattcacgccatacttgcttatgcacgtaggcaaaagtgggggccgctgatccgcgaccagtcgcgcgaggccccgcgcgcgcgatcagctgccccccctctagtgtgatctgttatcctatatatactactatacgtactatatgtatacgtactatatgtatatacatatgtatatatatagtttatacgcatatatattatacatacgtgtgtatatatacataattttttatatgtatgcacttttaatgtataaaaagatatacacatgtatataaagtttgtgtgtatacgtataaaaaacctaaaaaataagtgtatacaaacatatatatgtgtatacaaactttatatacatgtatacagagttggtatacgtatgtataaaaaccaaaaaatacacatacaaactttgtatatacgtatataaaagtttgcatacgtatatacaaagtttgtatacatgcatataaagtttgtatttatacgtacacagagtttagcatacatatactattaaaaaacggacaaacacaaaaatatacgggaagaaaaaaaaggaaaaaaataaaaccggaaaagatacggaaaaaaaaacaaaaaaaagggaaaccgtacgcccatacgcgccgaccgccgcctcctctgtcgtgtcgcgcgcgggagggctattagcccatttcaggaaagcccacgacacgaagaagcccaaaaaacagagacccgtgggtttatagaaacagtgttaggctagaagtagtaggggtgaactcgccgcgcgcgctcacacgcgcgactagtcgcttattagcgatttcgggcaaaaatggcttaaaattgggaaccagaaattacgaggccattcagattgtagataaaataaatcgtactacatagataagtgtagatcatatagataagtgtagatcgcagaactgattgcaatataaattcagagttgatccagatttattacaccacttccataatttgtgggttgtccttcgttcagatcggaattgacttgtatgaataatttatattcccagtcatctaccagaaacgtttcgcacgtgcaccggtcgttccaatcatcatctcgctagcttgtcggggaggaaaatgtcacgtacttgtcagctgtacgtagtcaccgccgaagaacatgttggtagaaatgatttcgacttgcgaggtcatcttaccgtgaacacccgggcatgcatatacctggtctaacacggccggccgtagtcattccctcgaagtcttagttcaaaagttaatgcagagcttttaaatgcttagaaataaatttgacagctctaaaagagtttgagacatacacgaataaacaaactcacacctaaattagactcaggttgtgtttagttcagcgcgaagtttggattttggtttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgatcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacattttacgttatcggttgtaatttcgatgctaccttgttcgagtatggcacggaggacctcataggttcttgcatgagtagatgtgatggtgaaaaggcaccaataggagggccttgtaatgggatgggatgctgtttcatcgagttaccaagggtcttgcggggctttcagtcaaccataattcttcggtcggatggcattcctgtagcacaaacagatccagtgcaccctggaatcatggctttcatgtcatcggactattatatatcaaacacaagtgaccttttcttaggttggacaaacacaagtaatgttgaaggcacagtactttcttttgctaccatagatcaaccaagctgtgaacgcgcgcgcatgaacaacacaagttatgcgtgtagccctggcagcaattgccggaatgtgtcatctggaggttatcattgttactgctctggttatgaacaggggaatccttaccttctagatggatgcacgggtacgtacttcctgcctgccccctttttacccccaaaacgaagcaaaatataatgcactgtcactaacctccttcttattcttattatatattgtaatttctatggtggaacagattacaaccccaaatataaagaacactgttcaacatcctgtggagacatgaagattcctttcccttttggagtcgaagaaggttgttttgctaacgaaaggtttagacttaattgtacagaaggtaacctaactgtttgcgaattaggagaagcacaatatcatgtgactgctgtgtctttggatgatgggactctaactgtcggaaacatgatgaatgacacaaactacgagaaagaggcgataattgttcagaccacagatactggccgtgattattcattctcaggccctgtggaagatagatttgatctctctatggaatacgccattgttataagatgggcagttaccaacttaacttgtgaagtagctgtgcagaagaacactacatacgcatgccgcagtagccacagctactgcctgaacgtcacccacaggaaagagttcatgggatatcgttgcaagtgttctcccggttttgaaggaaacccatacatcgaggatggctgcacaggttatttcctcttcacacctcctccagtgtgcaccagcaatgctcatgcctgcaaatgtttagaaattgaattatatcaatttaacttgggagaatcgacaaactaatcatagttttttgcagacatcaatgaatgcttactgccaaactattgcaatggcacgtgtcaaaatttacttggaaattatacatgcacaagctgcccgcatagaaaagagtttgatccaatcaaaaagaagtgtgttacatcagcaaagcaacgcaatcttcttttaggtaagaccgtaagaagtaatagccaacatgcaaaatgattttattatgacaaaatgaattgatgcaggtattgcaattggaattggttgtggtcttggctccatagttatcgtgttgggggcaatgatacttgccaataagtggaggaaaggcatccaaaagagaatacggagagcatatttcaagaaaaatcaaggcctactcttggagcaactaatctcaaatgaaagcgccacaaacaaaacgaagatattttccttggaagaactagaggaggcaaccaacaactttgatggaactcgtgttcttggacgtggaggacatggcacagtttacaaaggcattctatctgaccagcgtgtggtggccattaaaaaatcaaaaatcgttgagcaaactgagatagatcaatttatcaacgaggttgttatcttatctcaaattatccaccgcaatgtggtaaagatttttggttgttgtcttgaatctgaggtgccactgctggtttatgaattcatatcgaatggcacactgcatgaccaccttcataccgatcttagtgttagatgctcgctgtcatgggatgatcgcattaggattgctgtagaagcagcaggggcactttcctatctgcattcagctgctgcaataccaatttttcatagagacgtgaaatcttccaatattctcttagatggcagctttactacaaaggtctctgattttggtgcttcaagatctgtttcacttgatgaaactcatgtggtgactattgtccaaggcacattcggttatctagacccagagtattatcatactggacaactaactgaaaaaagtgatgtatatagttttggagtgatacttgtggaacttctaataagaaagaaaccaattttcattaatgaggcaggtgcaaaacaaagcttgtctcattacttcgttgaaggacttcaagagggctctctaatggaaataatagatcctcaggttgttgaagaggcaaacaaggaagagatcgatggaattgcctcgcttacaatggcatgcttgaaagttaaaggagtagatagacctactatgaaagaagtagagatgaggctgcagttcctgaaaactaagaggctaagaaaattccaactgctcccaggaaatgatggagaaatcgagcaccttttaagcccaaatactagtaactcttatgcacagaatatttatacaaatgctggtgatttaacatctgaaggaatcccaggttctggttgctacagtctggagcaagaattatcatcttcaattagtttgccacgctaattaggtataccacggtgaagtgatatctgatatgctttgtagttccgttctgaacagggtatgctgtattgttttatttcctgtgtgtaattttaggttacagtacgtatggatagcccacgcctgttgtatattactatcattatttgtgaggaatatatggttgtaagggattaattaaggccaggtggcaaagacaaaaatttgtataatcatgaacagatccattcagtaataatttcataactccatttccagttgcttacgcagtacttcctccgtttcatattataagactttctagcattgttcacatttatttttttttaccggaatcacattcatatactccctcattctctaaatatttaacactattaacttttttaaacatatttgaccgttcgtcttattaaaaacttttgtgaaatgtgtaaaactatatgcataaaagtatatttaacaataaatcaaatgataggaaaagaattaataattacttaaactttttgaataagacgaacggtcaaacatttttaaaaaagtcaacggcgtcaaacattttgggatggaggaagtatatgttaatctttacctattataaaagtttaagatgtttttgccagatgtttcgtacgtcatctgacttcgattcctactcggcttgcgcactctcgcccgctcgtgcgcatcagaatcaggtccgtgttagtgtccgacttctcccctaatacctgcgcgtgttcacatcctccatcacgagtcgttcgcacgcaccagccggaaaaaagatcgaagcatcgatatgtcagcaaatcgatcggactctaatccagaccttgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagactgatacaaatcacataggttgactcacggccacacaaataataaaatcagcatgggagatatatctatatctataactaatataaatattcatatttttccggtcgtcacatccttaacccacgtttttcgtccgtcaccgtcgccttcagctttgttcacaaaaactagggttctatttggagagataagctcgaaccgagctcgattccgcgttaatttctccgggataaggtccgattcttggggaaaacggaagaggaggataagggaaatatttcccctcaaccaattttggaaaaaatagaaaggggcgcccggatttggagtggaaagcggcgccgggtcgggttctgtctccggccagaggttgaagacaacactgtagcgacagggatgagatgtggactttggggaaaaaaagcctagcccgagaaaaaaagaaggaaggacgtgaaacaaacttttagcggtgcagctactaggccgaacaggaagaagtaggatgctaaagtggacttcacggattaggcccaagaaagagaggggatttttaattacttctccagataaattaaccaataaaatgatctttaaattgttaaaattatttcaaatgctcaaataatatcaagaaaactcttgaacatacttggataacaacattaaaaccagatcatttaatgattaatttattatttaaataatactgaaacgttctttgtattattaaaattagtagttgagctttgaaaaatccgagaaaaattccagagagcagaattaaccacgcatagaattaaatccatccatgctttatatttaggaaattttattatacatttacaacttattaatttatttatatataacattaattcaccaacaaatacatagcattaagtgtagccaagagcgaaaaaatgaggttggattcatcatgtcatctttccattcactacttaaaaaatatttttctggatgaccacccgaatagattgcagacaggccataagtgtttgtgcctacaaaaatttatcccattttcccatacggcttcttaagaaacttgtatgcaagaatcattttttccaaacggaccatttaaaatatatggacgtgaaaatgtggtgtttaactcaccggcatgcaaaaatacccccccgtagattctcactttttttattctccagtcctctctctttcccatcacccccattcatctcctccctcccagcggtaggcaagggcgacgacgatggcttcctcctcttctcccccactccttctctcccctctcccccctcccgacgcggtggagggctcgggcagtgggagagggcggaggagggatgcgacagcggcgacagatctggcggtggtgaggcgtccggcggcggatccgacggtggggaggtgcggcggccatcacccgcgcggatccgactgcggcggatccggtggtggggatgcgcggcaacagcggatccgatggtgaagaggcacgggggcaacggattcaactctccctcccgcgcgtcgacagtgatgggagcgggcggacccggccacccctagccccctacgccccacgacaaggacgaggatgaggatgaggacagcaacgacgacggttacaacgacgatgatgacgaggaggacggcgggcatccgtgatatggacaatattacatgacctaaaaaaataaataacttattgtagccataaatataggagtcaataaaaaacaattttatttcaaggtggtatcaatatctttcttataatcataaatcgagcggatccggtagtggggatgcgcggcagcaacggatccggtaatgaagaagcatgggggcagcggattcaactccccctccctcgcgtcgatggtgaagggagctggtggacccagccacccctagcccactaccccccacgacaaggacgaggacgaggacagcaacgacgacgatgacgaggaggacggcgggcatacatgatatggacaatattacatgacctaaaaaaataaataatttattgtagccataaatataggagtcagtaaaaaaacaattttattttaaggtggtatcaatatctttcttataatcataaatcgagtagatttaaaacaacaaacaattaggtatgagtgtagtgagtgtcaattcgttgcacaacaatagaaggttcgatttagtggagtcactttcggttgatatgtcatcgctttcgattccttatctactaacgtgcatgtacagagtatatatatgtaaaatcaaaattgacttcacccgtggcaacgcacaggcactgtgctagggaatataaacatatatatatatatgtgcctagatttattaatatttatattaatatgaacaatgctagaaagtcttataacctgaaacggaggtaatactcaataatagtagcagattaaaacatcaacgaggcatggagattgatgtttgagaaggaagcgtaccaatatcggttcgagaagacaaccggaggtccggagccgccgagatcacggcggcgcgtcgtcctggcggtgccgtcgctgggagtaggcaccggcctaacgaggtggaccacgcctcccgcttcccctcacgccgagtcccccgacaccgcgatccaccgtccctcggcggcggccaagcgcggcggtaagcgaggggagtccgctcgctgctcgatcccccctagaatcggaacgaattttgagctccactgcttcaagttggctgttgttgcgagggcttatgcgcggtggccggtggggccaatgggctttggcgctttgctatgctgaaatgtgtagtagagatcccgagccgtgggggtaatgcctctgtttatctgggaacaatggcgatcatgcataagagcagatacaatagcaatctattagccagctgtaaacatattttaacgagataaaatatgagagagaagagcaacggactacagatttgtaaccagctacagcgcggactccaaaacacaatgtgtgtatgatagatggaacaatatattaataatatagtaagcaactattgtatgaattgcctattagattggatataatgaattagagctagcagtaagctatactattaaacttgctctaacgacacgctgtagctccgtggactctgatttgcagccttgcaggcattgcaggcttgcagctcgccgtgtgcccgtgagtgcggcctgcccatccttcatggctcgctctctcatactccagcttgcacgttcgtcgcccaggcgcccacgaccacgagcgtgccaccatcctgtggttagtttttctctctggtgctttgagccgactcgtcctctcctctgtttcagagacaaacaccatctgcgctccaggtcgtagcctcccagatctgggcgtttggcattcccttcgtcgatctctgtttgcgtttctgtacagatacttgcgttcgtccacgctgtacggctatcgttccctcggtttacaaaacagtgcggttacttaacggttatcgcggttacaatacataaagttttttaaaaccacggtatatcttgcggttatcaaggtaaccactttaccgtggggtccgataaccacgccgaaaacggtaaggggaacaagccgtgcgatggcagcgagccgagcaatatcatcatgctgctcgaggaggcggtcgcagcctcgcaggcttaggctggatttttcacattttggttcttttgaaaaacttatttcgcaaatagacccctgaaaaaacttatcctagaaatggtcctttttggggcgccagagtggctggctccctcatccaacaggacgg

SEQ ID NO: 8160 - DNA, 16396 bp, Oryza sativa
  unsure (1)..(16396): unsure at all n locations
ctccccctagccacctcagcatcgccccgccacgtcggcagggggacggcgccaaagaggctggcgccagccactctggcgccccaaaaaggaccatttttgggataagtttttctaggggtctacttgcgaaacaagtttttcaaaaagaccaaaatgtgaaaaatccagcaggcctaggcatcagtgccgcagggcgatgctaagttgctaacgatacacacataattgataggttcagatgaaacaaacaactgcaaacaactcatggcagcaattagtaagtggatttcaaaatcgcacgataatggcatgcgggtatattgctcgaacgtgttattacatgtttgatgatggaggaaatgatacaaactttggtatatgaatgattgatgtatgctatatgctatgctacaactgttgtacaaagagtgatctgagaagactggcaagatcacacgagtacacgacagaagcgcaaaggtcagaccgtcagagattttatctcaccgtaataagatacaaatgtattcattctatataaactaaaaaaactggtacaactctatcagatacagacatttgcttactacaaacctgtgttcttgacatttcacctgcacaagcatgtccgttataatgtcagaagttgcaacaaagttaattactacaatcaattactggtacatatcaagatacactaatatgttcatgctaggaaaacgtcagtattgaacccacataagcgggaagacaccatccccaaatgagaccctttttcttaacaagtattcctattacaccactaagtaacaaaattcttcatgactagaaataacataaggcttcaagaaacaggcataaacaagctacttcatgaaatttcaggaaactgcaaagatcgatatctcctaaaaaggtttacttagggtatgcttgatcaaatatttagcatatgagatgtacttttatttctcagacatgaagacaatatcatattttgaaaacaagagaaggtttcaagcgttgaaaaggaaatgaaaaactggcatttgctagtaattgccaagataatattgtgaaaagcaattttactaatcttgatcataccttacaaataaaatgaacaaatcttcatcagttattgctccaagttccattcttctctctaaagcagtcaaccctccaccatctttaatggttgttcttgcacccctatggaacagaaatccatttaacattatccatgtagtcaaacaaaaattaacagtgactaattggttttttttgttgtcctgaggaaaatgggaggacaaacacaggattaaagggattgtaataatagcctgaggaaaggaaaatgcttttttgttgctgtttccctctctgttcctactaaactgttgaaatgcatcattgatgatctcgaaaaggcacaactcacagcacaagtggtatgccaaccaactgaatgccacctgataggcgctataggtatgatgagactgaaaatgagacaaacctccatagaccagtggaccttagacatgggatgagatgactagtatgaatccaagtgtttggcgaacaagtcatccaattgattttatacaattttggttatattgataagattactaaagacattgtcaggaccccagaacatatcatatatgcctcagtgtctcattctgtacttttatgctgaatgaaacaaaaaaaaaatagcctttatgtaaagagttcgatacttcagcttggcaacagtggaaggatagctgtaattatctatattccatactgctagaaattcaatcctacctctttagcagatgcttggtaagtgcatcatttttccttcggacacaatggtgcaacggtgtccgtccatggaagtcttgcttattaatatccgcaccaaaaagaagcagaagctctgccattatagaatggccatattggcaagcaatgtgcaacagggaacagccttgtagacaaccttctggtttcccagaatcatcctttacatcacaagatgctggatcaaataacttcccatctgttactgaaggatcatgatgaacatcattgtttaactcatcatatatcatgttagggctcacatcagccaacacaagaatgcgatatgctgccctcacatcattcgtccttacagcctccaatatatcaatggtaatttgattggtatctttggcaataagaagcttgtcgacatactgcatagatcatttacagtaattaatgatggcacaacaaacagaaggtcatcagaatcaagaaaacagggagctctaaatcttccattcatacatgaagttaatactatcaaaattagcaatagaaactatttgaagcaaaaaagaacttgagggttgttgcagcctgcattactcgacacttcgttgcatatggatcacactacaaaagcttgtggtttccggccagccattgatcaattatgcaagttttagagttgaaataccaagggttaattgttaagtatgcaattcattcatgttctatcaattatcttcagtatttgtaccctgaccgcaacagttccattcttggaagtctctctttacaaatgagattcttctgcatctctgcagaatgaaggatctcctgaagcaatctgttgttaattggttacaaactttatagggtcttttgtttttttctcttgtttcttcctgtaattatttcctataattattctttcaataattgaaaatcacactgctgggcaaagacctggcagtactttcagtcaaaaaaacagtacagtcagaaaataaaatgataaatcaaactacaaatctggttgtgaaccaatccatagactgagttctggctccaattatatctatgctcttataaaagaccatagtggtggtggtgagtttgcctccgccaccaccaactaacatgtgggcccatgagattggtggaccccacacgagcaatttgattgctctcttctgtttaccatccatttgaaatttgagcaagacataagctacactcttttaattttgccttttaagatgaagaacatcgcttcacccaagtagaggcaagatattcttttactaagagaactcataattatgttttatattaaataaactgctgcaacgcatggctattgtgctagtaaagtgtaaaatggttacatcataaagatttcccatgatccatacaactgctgctaactatatataatatatgtgcatgtgaacatccccagcctcccaaaagatttatgtgatatcagtcatgtgagtcgtagctacagaactgaagctggatagcaaaacaacacatttataaaataaaaggcaagggttacattggaattcaatcttcaactagcacatgactaacaaggatatacatcaatatcaagaaagcattgctaggttcagcatataaaaggatggacagaataatttacctttgtctgtatgtacctttcctttattgaaaaagcatcagtaggtttaggcttttcaatgaaaagaatagcatcattaaactcgtttattctgcatacacatcaagaagaaaatagataggagaaaggagcaaacttagtttttccacacacaatgaacatgtctgatgccaatgccattaatgtatgaaatatattcattggcactatcagattaaaagagagatcttccaactcatctgtagaagataataaagctaacctatcttgaacgtgtgaatgaaattattagcattaacatttctaaatgatagaacaccttccttagctacactgattatattcacctaccataatgaaactgatccatttcagtgcaagacagaatatcccattggaaatttcaagtctgagttaagtcaagaatgctatagtccattacaaatgcggtagtgcagtattatgctccttaaattgacaataatccaatgagtaaaataaaagaaaataaaatgactaaccaatacatgcagaagtacaaaactannnnnnnnnnnnnnnnnnnnttggcaaaaagcatattggctgatgtttgtattagtcaatataccactacttacaaatttcagaagagaggtgtaactaggaagaaaattgtctaaagcatgaaggcaaaacatagttaagaaaatatacatttacatacacttcaacatacccttgatcttctttcggaagcatagcttcccaaatggaattagtgtagtcatttccaagttcatggaacaagtccattatcactggctcccataccttgacatctaatcgcaaggatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactttaaatggttccactattatattacagttttatactactaccgtggctaagttataacttttatgagtttaaaattttgaagtgctttcctgtgaaagacagggtcaggtcaccaaaaacgtaactttcaatgaagtagcataaattagactcaaaaagaaagaacaagtgacagagttcacaccttcgaaatatggactccaagattcctgtgagccccagaacactctatacaaataagaattcctaaatttagagatgcccaatcaggatccggtgaacgacattctgcacaactgtcatttccaggaatattcctgagatgattgaatatatcatcatgtccctctggacttttgttctcctcaagagagagagaatcaacagaatttgcagaaccatgatgttccgcctctagatttccatacgacacctgggattaactgaatcagcatacgattatactaaattatcctgaacaatcgatagctcgaatatatgattaaaatgcactaaaatggagctaattttaaggggcagaacaagcactattactatattaaatgattattatgcaatggagatgcaacttgcaagcagtgtagcatatcaaagtttttcttcaaaaagcacgaaagactagaaatgaagtgttgccataggaagtatcgaaacctgtcttgggaatggtaaattaagcagtgatgcaataactccagtaactttctcaatccaatccttttggtcagcaccagattctgcctgcgattgacaaagtctatagtattaatatataaaacaatgcatgtatcatcaaagactagaaatttggtgtcacagaaaatgtgacatccgagtaacagactaaggctgtgttcgctagaacacgttcccaccccggaacagtgatcacggaaaacggaacggtccattagcgcgtgattaattaagtatttgctaattttttttcaaaaacggattaatttgatttttttaagcaactttcatatagaaattttttacaaaaaacacaccgtttagcagtttgaaaagcgtgcgcgcggaatacgatggagaagggttgggaacccttgggtccgaacacaccctaaaagtgttccaattacctgtaaagtgtatgctttcatgggagagattactctgaagcaaaatcttaggtcattttcttctgcatcaatcttaattgttgaagttcttagatcaattttgtggcacgaaagtgcattgtcaccctgagttggagccttttggttcaagaatctgaaacgactaaaaacaccagtcccttcaccagctgtttgctgtgatgccgctccttgcttcccacatgaacaaagagataaatataaaatacagaacaaacaacatgcaattgttcaatatttcaggtatattatgtaacacaattaaggtataaattcccaaataatacattttaaacaatccatgacagcccacaaatcgctaacttttattgcataccgattgtcctttattcccgtagtagaaaagagtcccgtgactgtcgagaacaaagaaccttctcttccattctcgtgaattttcagaacgcttaaagagataaccttgtttgattatttgaacctgccagaaaaataaattagtgaaagaaagcaacaaagcttaactaaaaaaaaggttgcatgttatatataattaaaatgtagtctggtgaattataaatgggaataacagggcattataatactagaatttgaaccaaagggataacaccatcgatctctttgcctagatacctaatttaggaatacatgaagaagcaatcaccatcttagaaataaaaggtgcttcgctcttaaacatcatcaatccctctgaagcagaacattgaacagtgatgcagcaagcttagccgtccaggtatcctagcctattatttatgattgtttactcaacagtggataatggaagtacctcgccattggcagttgactgcattagggcttcaatctttttataggattgaagaccaacaacatggataccatcaccactggtagatgtgtccacattactagccattctcaagttcgcaatttcctcttgagtcctatattcttgaattctctttgcaagtttatcttgttcattgatagccatttcttttgattgctgtgcatatgttagaacctgtatcaaaaccttacagttagcatattaatggttaacttatggtcaatggatccatgctgattgaaataaatgttcatcggtttaagaccaataggtcagataagagattactaaacctggtgaatgaatggttccatttgactcagtagttcatatccctagatcataaagaacaaaatcaagaagaacccaataaaccaaacaataataatcaatcgaattatagagtgaccatgcctgcttgaaatatctcaaatgggcatccatcactgcacttattgattccaagaactcatacttcttctttgcttcaatatttgaaagtgcgtgcacctgaattccttacagccaaggagaattattggcttggcaaaatcaataaaattagcaacactatataaaaaaatgttcatacatactaggttaaagcggcatcgttcgaaagctgacttggcattgtgtagatcctgcaaatttggaattagagatgttgtatagaaattaaataaatgatcacttacggaaaaaaaaacaagttgtccctgttcacctcctcaagtcctgtcactacttctgctctagtccctttccgtactgatacaaatttttcacgtgcctgacaagcaagatagcaacatatattcttatagggcaccacatgccaaaatgaagaaatatgcaaattgaaaactaggtaatcacatagctagagtgcaagatatcacctgatcataccccactgtagccctatccaaacgctgacgacaatcctatatacagtgcaggatgttagcctatagtattaactaattaatgtgttaaaaacttccacatgaacatcaagacagtagggcaggtgtattgtatttaagacagaaggacatccatatattgttcccattacccaaaatggaagtcagtgaaactcgaactacatttctaagatcacttcatgcaattttttcattgtcagaagcaaaaggcttgaaattcggatccaacaaaaagtcaagcacgcaagcaagtatccatgaagaagagcaaaacctgaggtactacctacataaatacagatctcagtagtgtgcttaattttttggggcaggaggttgtcaccctcaccttcacgccatgcaaatccacatcaatgaattgcatcaaacgttcactaagcatatgatcaacctggttgaggacacatactgattagaatgatagagattcaatctgttaagctagtaaaaataaaaagaacaaaaacggttcttctttgcaaataacccttttacagtgtcacagtgttatttgcatcaaaagggaactcctagtcccattcagcaatcttacttttcaatttcattaccgatgagtgacatggacgtatgaaacaacatatggagaaggagaatcctatgtacctataaagttcattcccactaactgcaattaaagctattttcctctactctcatcgtgccatgtcacctcaatttgtatatgccatgcaaaaaacctacatgttccaaaaattcctgattaagtcatcaacctgcaaatgatccggcccaactaccacgcttccttacatgctccattctctcatcctctcactaatcaatcatcatcacatcctcttctgtaaccgctgatgcaatggcaaggaatctgagtggaccgcactggtgcagacaaggtaggatgtgaggaatttaatctgcatcttcagcgtccatcccctactatatgccttcctccgttcctcagcgcacacctgccctcactctggtgctccatgtctggcataatgcgtagcccacaagtcctccacaccttgacacccaacaccatgggtctaccagagaagtaccgcacgtatgcttgagtttatcatcccatcaaatactacaataatcacaggtcataatacccacctcattcctctcccctatgcttcctcccgttgaatgctttggtgagtcagaatcaactgagtcttgtcacaaaactacagatttggaaacaaacaattgaatatatcttacttatttttttcttgtttccaagtgtttgcattaagcaattgaaggaggtacattcacttcgatttgtatttcatggaacatttatgttatgatgaaactggacaatctttatgtagagtcctatttattgcagttcaaatttggacaggaagcattttttatctaaaattaaatgcacattctttcaccaatgcaatcagaatgtatcaaaatgaaaaatgttactatgctatgctctttttttcgttccatcacccagctaatttttcatattaacaattgatcagcgtgttgcagcgcacagggtgccaattactccctccgtcccacaaaaaggatttctggaggagggtcccagaaaaaaaaacgatctgtacacaaaaaagtgaaacattcaatgactgactacttcacatcggtggtcgagaaggaccttatctcttcccaggcacacacccatctcgctcgagtctctctcattcaccatcgtctcgcccgttcatcaatgcggcgctccaacgatctccatctccatctccatccccatgcccactgcgccactgtctcgcgctcccctctcgcttcttccgacgaccttatgcgtccaccctgatgctgcaacctggatgtgacggctgcatcggtggcggatggatgcggtgcacaagagattcgcaagaggcaaatccgatgcttgcaacgacgttagatggaatgcagctcgggtgcccccccgaagagggaggcgcccgtggatctcccagcactgaggtggtcaatgagttcgagaagcgtgccattagaatgaaccccatttgtattctttttccatctattcttcttttccaccgaggtttctttctgcccttcgaccttgttaactgtattgaattcttcttgcccttaggcgcaccgtggatgactgccaccttggtgaaggcggacaacctttctcttctctgttcttggttcttgttaatttttgcaggttaaataagagcatttcttgccagcatttatttttttcagatgggagatgttctcttttctttctgcaggtactagaaaatttcaaatttttggcgcttatttttgtgccagatgcctctttttttttcttatagtatgtgctgtgtgaattaatgggtggatgaatgaatgtagtaatgagggcactttggtctttctatgttattactaaatttgcattgggaatccaggattccatattttgtgggacagagggagtagtacataaagaattcaatggcatagaatagattttacctgagaacgaaggagttccttgtatgttccaagctccctaaaagcagtagtgaacttggacattacaggccctgcaacagaattcagaatttggatcttccacattgaaagctgaatgtgttcatgaacttcactttattaacaaatttgcattccataatttcagtgaaatggcattgcattaaaccattacagttaagaaacattgtgttatcatactacaagcctacaacatattaataagtaaaataaaagaagtacatagtatgtgcttgcttatgtctgcatttatatatattctaatgatctgttactgtgatctttccttaagagagggaacagacataaaattaaagatgtggtacataatcgataggagacaaaaggacaccaacgtggcaagatgtttagcaattggcaaggatggactcagttgtttagctatctatggatgggaaaccaggaaaaattaagcaacagatataacagagatttgatgaaattaacctccaatggcaacactaacaggatcatcttgaccagcaccaaatgcttctagagcatcggcaaatgttagatctcccgcgtatccttcatcaagtgatcccctgaaactaaggttatcagcaatactataacaaaacaatatatcgaacatatggttttttattatcgttgtctatcctaggaacaataggaactacaaattattacatgtaacatggtaacaaaaaaatattaatcctgaactagaaaagtaagaaagaagaatgcaaagtcatttattgacacaattttatccaataaacatttttgtcgatataaacttgcagacaattcatattggaccatagaaacagaaacaagttttgaaatcgtgtaattgtgtgcattgcagtaaaaggttgtatgctacagaaacttgatattgacttacatcggcataaacctagagtgatgtctttcttaaaccaaaaataataataataatcatgctacgcattctgcatcgagtgtacgcctgtgctgcaaagttagtagctcgcccaaaaaaaacagtagttgggagcttaatgtacatgaatcttttgcatcctttatgaagatttgaacaccgttgtttcagttcatcgcttagctgttccatagaattgacctgcaaatcaatggaaataagccgcaatcaatagcatatatgcatgtaaaggtctgtttaagatgaaaacaaaaggatttatcaggaaaaagagaagattcaacttgatagcacaagcaggaagcttgcagtccaaattatatattaaaactactaaaaccaatctacacacagccttcgagtctaaggcactgtttgattcagcttagaattattataatctggattattaggaataagctgaaacaaacagatagcttattatgatagattattacaatctataagccagattactataatctagtaatccactctaaaggtgtttttttagattattggatggctaacagctaacgaacagcttataatccagagaaacaaacagctcacagcttattctatgtcggcttattataattcagcttacagtaatctggctcaataatgtagattacaataaacttaagctgaaacaaacagggcctaaataataggtcactattttttctatggcttctaataacccaaaccagccatttgaactggaaaagaaaatcgtctagcttatttcgtccctaagtttttacaggattttatctcgagaaattagacgatgaattaaaaaattgttcaagtgtgtgatgcagcaataaaaataaaatggcaccattacaatcagaaatgcagcactgctcaaagatgaaaacgatcgggaaaggaacagagaacacacaataaatgtaaaataatattccttttgcaacctacaatgcactcatgccggcaaatcaaaaccaacctacggtattcgtcgaaaccaaagcggaatttgatatccattctactcaggaacaatcgcatttccgaaccaatcaacggccaataaagcatgcaatcaggtcgagatctcgccacacagaatgcgcccaacctcccaaatcccagcccaaagctaccacaatcaccccaacctccagctccaccccccctaaatcccccaccacgtacgatccaaataccaacgacgcggagccggaggcgagatctcgcccgaaagcaacgaaccctgagaggaccggatcaaaaggtgacacctcccgcgggcagggagagaagagagggttcggcggggcggcgcacctgcttgcggaacatgggggagtcctcgagcttggtgaaggccgccatgcctggcgtcgcgcgggggatgacgctgcttgctgcggcggcggtcgcggtggcggtcgaagctcgcggagatctggaggcgtgggcgggaggtgggaaggaggaggaagaggaggcgatcggtcgggtagttgctgcctgcctgtctgtcgcggtggcgctgttccgctttcgcgtaggcagcctgcacggttccggggtgcacgggctccgggctcggctgggccggctgcgtttctaacgaaggaataagttcagtttgactcctttaactagtgaccgaatctgatttgtatccctaaatagggatggcaacgggtcgggttggtcacgggtagagcaaaaccatgcctgaccccatgcccgtcgtcgcccgcccaaatcctacccactagggttagtgggtaaaactctatgcccgtacccatgcccgacgggcacgggtatgcccgtcgggtacccaatggatctcacatgaataataactcgaaagatatataatttaacaaagaaaaataaaatcaacaatttaccaaattatcaattatcaataataatttgaattacatcgcaacttattattagttagtatcacaaatgaaccaagagaagggggtataataattaagagataaatcgaaattagctaatacaaatgtatcgggtcaggcatgggttacccacaggtaaaaaatgaagcccggctgttgcccacgatgtctacgggtcttgggcggacaagcccacgggtaaaattttacacccatgcccgtgcccattgggtcgggtatccgcggatacccgaacccatgggcaaaactgccatccctatccctaaaccacaataccggatatctcaacccccgactattaaaaccggtgcaattgattccctcgatggttttgaaggacggtttcgctgacgtgatgcgtacgtggcggtgttgacttgggcttcgttccacgtggcgttgatgtggcacttatgtggcagtagaattaaaaaaaatatgtgggacccatttttcatccaaaaaaaatattgtaggacccacttatatgtgaagcccacatgtcatcctctctccttcccttcttcctcctccctttatctcccttccctccctttctatcctcctttctattcccctacggatgtacgcggggaacgggggccaaatcggtcgtggcggcggcgagcgggggccggaggggtggcggcaggtgctatagcagcgacggcgtgtgtgcgggcgtccggtatggggccatcaagtgagttgtgtgagagctcaaagacgacaaggttgtagctcctgctgaagccgaagcaggactgcaccgtagcaggtgaggagtgggtcggcggcgagctcgcggaggtgtacttgataaccgtgttggcatccgaggagcggtcgtcgagggggacggagtactgcacctggcgtctgagcttgacgcgcatgtcggccgcggcgcgggtcgccgcgagcaccgcggtgaggcctgcctcttgccctgaccctaaactagctccaccaccgcgattagaagggagaagcagggatgagaagaggagaagaggggagagaggagctgggctcctgtcgcccttacttgtcgccgagccaccaccaggattgagggagagagtcgcgccgccgccatcgtcctccttcttcgtcccctcccccctcagggccagggtgagaggaaaagggagggagggagggaggaagggagtcgccccgccgctaccgtgccttcagggaggggcgccattgctgtcgacggcctcccttcgggcagatctaagatgaaaagggagagaggccgggtaggagtctgcgccgaggagtggcgcgcctgccacaccaggggctcggagaaagcagcggctccggcaactccgccgctccgcctacttcccttcccttccgcccacgacaccgctccccgtttttcatccgctccgccgctccccatttttcatcggcatttcgttttccttccgcccacgatgctggcctccgtactcgaaaaagtgatgggaaggatggaaagagtgacgggaaggacgaaaaatgtgatggagtggcatggatctaatttctcaaaattccagtggcacctagccgttatcgcgaatagtagtgacatttttctaatttatcacatttccagtggcatagatccaattaaccatatatttttgtgtggatgacaaattggtcccacatataattttaattatactgccacatcaatgccacgtggaatgaagaccgagtcaacaccgccacgtaagcgccatgttagcgaaactacccttcaaaaccatcgtgggagtcaaattccaccggttttaatagttagggggttgagatatccggaattgtggtttagggatacgaatcagatttggcccctagttaagggagtcaaagtgtagttattgctctaacaaacccgaaactaattgggccatacttgtaggctgtgtatgaacgtgcaactactcattgtctacccctcattctccgtgcgtaccttgttcgagcggttaaacgatgtgtttttaaaatatatatatataaaagttgctttaaaaattatattttttttaaaaaaagctaaaacctaattaactatgtggtaataagttgctccattttacgtgcacgggaagagagttcccaaacctagctaccgaacatagcctaaagaatccgataacattttgatagttgggaacattgttttctagtttttcttttagaactcatgcactttatttgtttgaaagttttaaaaacacaaggcaagagtgattcttacatctccttttcttgatcggacatacactttgttggcaaatatgagtactattactacagtcaaaggccatctgattttgctctgaagtttgtctagttgctctcgcaggaccatcagcaaccttgttcatttctctaggaatccatttgatttgatttgcatatgttgaccctacagaatgttatttattttgtaaaatgcaggccttagggtccaatgtcctagctcattgatgaagtcatctattcgaattgcttcggccaccgtctgtcatcagatagaaatataggttgatgataatgatgaatatttggagcttcagacagaccttatatttctgtaacaagaggagctcctgctttggagctgtcttcttcgagggatgtgaataaaattccaagcggccttttttccttctcctttcttctgcgacaacctttttcggcttttcctctcagaaacaaagctcacaacttatgcggaaagcctctcaaatcccagtccaagtacttcctaggcctcattcggctcagccagacagccattatgcccctgtagccacgcccacgtgcacgatgaagaacgcgtgtccgccggcgacaagctttggggtgggacgtggatggtgggcccgctgccaccatcgtttgcatgcctgcaggtcgactcta

SEQ ID NO: 8161 - DNA, 3191 bp, Oryza sativa
cgagtgcaatagttcagggggtaattcatatttttttcctctctagtttcacaatgccggcaattattttcgtcatctgtaatgaagtaagatggtagcatctgtatgagtactagctaagatataccttatccgattaaaatctcttactccctctatcaaaaaaatgtttgacgccgttgacttttttaaaaatgtttgaccgttcatcttattaaaaaaattaagtaattattaatttttttcctattatttgatttattgttaaatatacttttatgtatacatatagttttacacatttcacaaaagtttttaaagaagacaaacggtcaaacatgtttaaaaaagtcaatggtgtcgaacatttaaggaaggagatagtatattttagtacagatggagtatatatatgattattaattagccttcctgggcagtaccaatctttccaattggaagatagctactggacgcgagagaaaatcggacgtagaagcgagcagcgaccggcagttggacgagtcgttggctccagcaacgaccgggatatctgatgcgactagtgcccctggacttcgtcgatcaatggcaaattattgcgataaaattgttttctgccgatcgagtataagccaatcaattcctccatatatgttttatacatagcgcttggggagtggctggtattaatctggcatctatacttataaagtccacgaaagcgtgagcacaaagagatggctgcctctgaatataaattgatcggtagttaacaggcaccggcctacgtacaccaggaagggcaagccggctggcgcaaagatgagctcgagctttctggcagtttgtgccacttcttttgtgctggtgtgctcggcagctacgccacgagtattggcttcagtctatggagttggtggagggctcttgattgtcccttctaatgactccctcgctcactgcccctctagctgcggggaagtcgatggcatctcctaccccttcgggattgggggaggctgctttcgggacggcttcgagcttacctgcaacaccgccaccaaaactcccaagctccttgttgccaatagtacaacccagataacagcaatggaatatgacatggctttggctcctatgtacttcaattttacgacaaggcaaggtatggacacctacaacatttcatgggtgtcgccagctaagggtattaaaatttcagatgagaacactttctatgttgtctgttgtaattttgatgccaccttgttcgagtttggtacgggagatttcgttggttcttgtatgagtagatgtgacattgagaaggcaccaatagcaataggacagccttgtaatgggaacggatgttgctccatcaagttatcaagggacatgcggggatttcagtcaacacttgttcaagctgaagctgcagcacaaatatcagatccgctgcatcatgggatcatggctttcatgtcatatacggattattacgtacgtaatgcgagtgatcttttcttgagttggacgaatgtgagcaacgttgagggagccgagcttcagtttgccatcacggaccaaccaagctgtggaagtgcactggtaaacaaatcaagttatgcttgtaccaccggcagcaattgccaaaatatatcatcgggaggttacacctgtgagtgcaccaatcgttatctacaaggcaatccttacattttgggaggatgcaacatgcaaggtacttcctaccacctttaatttcctgcaaaataagacacatatatcgatatatatctaactttcatcccttgtcactctctttgtgggacagattacaaccccaagcataaagaacactgtccgacatcatgcggaaccatgatcattcccttcccttttggtctggaagaaggttgttttgcaaacaaaaggtttcggcttaattgtactgtacatcagatcatatcacagttttggaaacaagtgaagcacaatttattgtgactaatgtgtctgttgaagatgggactctgactataagtaatttgttgaataatacggaatatgggagagagatactaataactcaaggtgaccaatatggtgatacagtgatttatggtcctgttgaagatcgatttgacttctctttagaatacaacattgttataaagtgggccgtagccaatttaacttgtgataccgatataaaaaagaatgctacatatgcataacgcagtatccatagcgattgcctaaacgtcacccacgcaaacatattcatgggatatcgttgcaagtgtcttcctggttttcaaggaaatccatatatccgagatggatgtaaaggtttgttcctgttcattcccctcctatttgcaattgtttaagaattttagagaagttttatgtggatagtttaaccatggcatttcccctttagccttgttcggttaatcccatctacaaggggatcaagcgggattggaattaatcccctccaatccctctctaaccgaacaaggctgtactagtgcctagcctatgtctatacgttgtaccaataaaaacaaaaaaaactgaagagttaattgcagatattgatgaatgctcactgccaaactactgcaatgggacatgccaaaattttcctggaggttttacatgcactagttgcccccacagaaaagagtttaatccaattacaagacagtgtgttgcatcagctaagcaacacaatcttattataggtaagtcatagctgacagattagtcaatcttattgccttaagataatgcaaagtggcttcacggcagaaaattaatgaatggctgtaggtattacaactggtattacttgtggcattggttccataattattgcattaggtgcaattattctagccaataagtggaagaaaagcatccaaaagagaattagaagagcatacttcaagaaaaatcagggcctactcttggaacagctaatctcagatgaaagcgccacaaattaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagttt

SEQ ID NO: 8162 - DNA, 6233 bp, Oryza sativa
  unsure (1)..(6233): unsure at all n locations
atcacatattttctaggaagtgttatgttacgtagttcactacaaagaatggtttttgcatgcttcacttcctgtatacttgcagcatgtatgcatagcccatgtgagttgatagaatgacagttgtattctactataattatttgtgatcaatatccctgtaaagaatgacatggtattgtaatattgtatttaagctacagtggcaaagtgaacaagttcagtaataattttattactccattgccaatgtcttgctcagtaagggtcaccaataggtatctgactgataactcagtttgtagatgctggatctttttttccacatagcagtgacatcgttaatacggagtattggctgtgtttagttccttccaaagttggaagtttgggttgaaattggtacgatgtgactgaaaagttgtgtgtatgataggttgatgtgatggaaaaagttggaagtctggatctaaacacagccattatagagctagtcggaagtcaaaacttggaactcagagaacgttccgaatgcctttacacaaagtataaatggcacggttcaaattttttatttcatcacttgtccaaaaaccctgcattcataatgggaactgtaaaattgtttggatttggtgggataaggtcacaggaatagggatatatagaggaaatctaatttatggtttgattgaggatcaggggaaaaaagtgaagggttagaatcagtccacactccacaccccatcaccatttctatcccagcaacgaaagggcatgtagcctagtggttacagtgacctgagtagtaccccaaggtcctgagttcaaatctcctatggagcgaatttccccttctctaaaaaaaaaaatctctatcccagcaaaccggaccacaagtagtagtaagtacctatgctgcaaacagaaatgctattgtctatggctccaaattctgtagctttgcaaaagacagtttagtttaccagtggtgataatttgagtatggagttaaccataccagtacaattagactaaaaaaaagaactccaacctagattatgcacacaaccacaaacacaccaagcaaaacagtggagattgccgtttgacaagggagcgcaccagattcggttcgaacagacgagacaaccgggagcggcggcctgccggcctccgcgcttgggggaggcaccagccttctgatcgcgccggggaagaggaggagccctactgccggggcggaccaggcctccccttcgcccccacacctcgacacctctctgacactgggcctctgtcggcaaacaccctgcaactccaccgcggtctctgtttggctttgcacttgtgccgctgtgtcgtgattgtgtccgtcattttcatgtcgctctttgctcatgttgcgccaccgccgtctcataaattagagcaccaatgttggcttgctcctgcatagaagaaacacactgctaattaacttgtagggcagagcttctaactgtacgtagagagcaaagagtatacaaaagtgtatgcggcgttatcgtactacagtaatcctacttaggcaacggtgccggccttcttttgttcatctatatgaattagaagactgtggcaattgtatcacgctagtgtatggtgattaggatttgcactttttttttttgaaaggagggcaaaagctttgcctcatatatttatagagatgaagaaaaaacagatcaaaaatatgtacagggattaggatttgcacattgcaactctttccatctggtactggatttgtggaaagaatgggcgggcgagtttattggtccctgcaatggctttagattttgcaaggataatatatagtagtaccacattcttagaagttgcaatatactccatccgttttatattataagttgtttgattttttttctagtcaaatttatttaagtttgattaagtttatggaaaaatagtgtagtattttcaatacaaaagaaacatattatcaaaatatactcgatgctaaatttaatgaaattaatttgtcattttagatgttgcttttaatgacaatagcccaattttcactcaaaaaatgttgaaatcatgagtccccaatgttttcatagggaactgcagtctgcgggattatatttacgaatctgctcgtaatagcttacaagacgagcatagtgaccctatacggtgacaaatccagcaaatatcctctaattaattaagctaacaaccccaatttaatcactcttagggcatctcctcagcgtgcctccagtcgcaaaatataattttactaatgactactcctacttcagagtgtgtttcgaaccagagcttgttatatacgcacacaaaagcagccattgcatcgatcaataataatattgcagtttgacaagggagcgtaccaatttcgaacaggaaattaatcggccttgagctacagtggcgtgtcggcatggccttctaccggtgcctctgccatgaggaggtgctggaagctgaagtggacggcgccgccccctttncccccccccccccccactcccttccgaggctgtggctagctgcttgcggcgaactgcaggagaaaatggacattttgccactttgaaaacatggtttcgctgaaatgctattccgaaaacgtgtttcgctaaaatgcaaatatagagcgcgccatcacagccactttgccattttctccatttttactattttggatattattttctctgcaaagcggcttgaagagacgagaatgcccctccttctccaacgacgagttctcccgtcgagctgtccgacgatgccaccccgatcaacgacacgtccgacaccgccgtcccctcctcctccacaaaaaacccgttcacctcctcctccacagccgccgccttcccctttgccatgcggaggaccttcacgccgagctcgttgcaccgcgccttgaacgccgcgttgcccatcctcggcccgccgtaggagaagacggtgaccgggcggcggcggcgtcgccgccgagacgctggcgacggcgaggtcgtatgccaggagcagcgcaagcgcgccgcccatgctgtggttggcgagcgtgacgctcacgtcctcaccaccggagcgggaggcgacgagtcgggacacctcgcgaaggagctggttgcggcagctgtcggtgcagccgaagcggcatgtctcgtcggcggaggtgtagatgttgagcaaccccgactcgaccttcacgtagccgccgccgccgtcgccgcggcgtggggcgaggcgcgccaacacgagggagctcctgtggttggccatccactcggcgggggtgacggtgccacggaatgagacaagcacgtcgcaccgcccgagccgccgcgtcgtctcgtcggtggacacagcgacgtacccggcccagctggcgcggccgctggtcgacacctccatgcccggcacagcggcgtccggcgacgagtagatgtacctcgtcacctcgtacccggcaccggcgtcctccagcatccggagcttgccgtacttgcagttcatgtacctcggcgacgaagggtcctccaatgccgcgtagcatgcaccgacgagctcgccgtaccgcgccacctctccgcggagcaacgggtgcagcggcgagcatgtcatcccagtcgccggagccctggaccttcctctacacgcgggcgacaaagcccgccgctgccgccgtcatggaccacctcgccacgctcgtcctctttctcccatgaactggatcgatccctttcagctagctagcaaggggcaatttggtaccatcaagccgaaaatacaattgaaaatacacaaaatggtaaaaatggcaaagtggcggtgagtacacgcttcgtattggcattttagcgaaacgcattttcagaatggcattccagcgaaaccgctttttgaaagtggctaaatgtctattttctcgaactgcggcgcgctgcggtgagggggaaggcgacgaacggcgctgccgctacgaggccgagggaatggatgtgctgcccccggacgatgttggacttgaggtcaagagttgagggctcccgttgcgcgtggttgggcttcttgaggcccagaaactctaacaggccggggaaaaaagatcgagaattcacgccaatgcaaaagtattcacaatagtactgtatagagaagtgcagaccgcagaactagattgcaatataaattcagagttgatcaagatttacaccacttccataatttgtgggttgtccttcgttcagatcgctagcttgtcggagaggaaactgtcacgtagtacttgtcaactgtagtcgtcactgccgagtgccgaagaacgtgttggtagaaatgattgcgacttgcgaggtcatcttaccgtgaacaccagggcatatacctggtctaacacggccggccgtagtcattccctcgaagtcctaattcaaaagttaatgcagagcttctaaatgttttaggctaaaaaagtttctcctgtcattccagctggtcgagaggtgcatgctttaatttcgatttatgtggactgactcagctacgcggtggtgttcggatccatgactaaactttattcctatcacatcggatactcatatcacatcggatacgtgtacgctaatttagagtattaaacatagactaattataaaattaatttcataaatgagagctaattcgtgagataaatttttaagcctaattaattcataattagcacatgtttactctagcatcacatagcctaatcatatactccctccggtttcattttaattgacgttttggacaatgacacggtctacaagatatatctttgaccttatttttctattataatatatataataaataaatacatgtttacttttattatagtactttaaaagacaaatctatatatgttgttctagttcctttaaactaaatatttttaaagttattaatggtcaaagttataaaagtttgacctcagccttgtccaaaacgtcaattaatatggaaccggagggagtattaatttagattcgtcgaacgaattagtctaaagttatggaatgggttttgtcattagtatacgtttaatatttctaattagtatttaaacattcgatgtgataggggttttagtccctgatccaaacagggccgcttctaatctctttctactccagtacatttcagttgctttaatttatgatatgtgtagatataataacctaaaataagctagataggaagatttggttaatagtgaccaacatgtgtttaacgttgttttgtttaagccatgctgcgggcggcgtggagccgtgcatctatgtcctgttcttttctcaaaaaaactgtataaacttttagataaaaatggtacgttttttaaattgctaaacggtatgttttgtgtgaaaactttctatatgaaagttattttaaaatataagattatttttcaagtttataaaaattaaaactcaattaatcacacattattatcacttttttttaaaagacacattattaccacatcattttacgtgaaacacttaatttttatctcatctccatttttgggagatttaaacaccaccatagtcaaaagttaacgcagagctcctgaaggttttcagctaaaaatatgcttatgctttcgatctacgtggacttgcttagctatgaaatctctgtctgcacattccagttggttacgtcgaaatagtagccccatattggtggatgaaatagtaactatatacaagtatgcttaaaaataaatttgacagccctaaaagaacgagacatgcacgtgaagaaccagactctgaacatgttcacacctagattagacccatttcatctcagccacatatatattaattttatctggggcaatcaccttgaatttctacgttgccttattttcattccacaccatacttgtccctgttttgcatattaagaattgcgaaaagtctaattaagtaagaatatagtgggagaattggaaagttgggtagaagcaaaggagcgctaagtaagtgtagaatgattcaacatgttgctttctttcaagaattatgctcccttctttttatattataagactttcaaacattgctcatatttatatagatattattgaatctagacacatatatgtctagattcattaacat

SEQ ID NO: 8163 - DNA, 571 bp, Oryza sativa
ttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctctgaacccgccagacattgcttaccctaaacctttaataccggacgaattaacaccctcaacccattccagagcggttttgtcctacgtggtgtacgcatgacaatcccatcaacattttttttaaaaaatggtgggacccacatgtcatacatcattttcccctcttcctctctctctcttcacactctctctcgctctcacgaggcggcgcgcaggggcaggaggtgggctgcggcacgagacgcggaggtggaggcctgagctgggtggctccggctggcggtgagcgctacgggacagtggcagaagcagcgtggaga

SEQ ID NO: 8164 - DNA, 1066 bp, Oryza sativa
tggcgccgtcctcctgccatcgtggcgcacgtgaaccgacgtggcaggaggagggcgccagcatggctggcgccgccccagggaggagggcgccagcatgctggcgccgccgcctccatcctgtttttctgtatggagttacaacggtgtcatttttattttattttttcggatgttttttcacactcaggatcacgatacaaccaaccacaaaaaaaaaatttaaactcgaactaccacttagctaagtctgaaaatatctagcatacccacttagtctactttgcaccttcactaaaattagaccataactcctttagtaaaaccctttgatcagcatgttaaacataatgcactctaccactatatgaaattacttaatctaattcaaaatataaccacattaaatgacatatataagttaaacagtacatagagatataattttttatttttgtttcatttttttgatatttttttcacacttaggagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcatggacatctacagaaaaagttacatccgattctcctcagctttgctgggttcggcgatattaaaacctccaaattccgcttgcaagattgtgttttcgaggagagaagtttttcggtagagctttggaaaatttcacatgccacatatttcgtccgtttgagtttattttttacatggttggttcctgtgagttcctaagtgtgaaaaaaatatcaaaaaaataaaataaaaataaaaaagttgcacatctctctcctctgcactagttcggagagaggagaggaaaaattctacatgtcacatattacgtccatttaagttcaatttttctatggttggttcttgtgtgtccctaagcgtgaaaaaaatatcaaacaaataaaacaaaaataaaaaatttcggggaggggggggg

SEQ ID NO: 8165 - DNA, 312 bp, Oryza sativa
ccatccaggccaaggagattctcaagctgcgcgaccgcctcaacaagatctaccagaagcacaccgcccaggagatcgacaagatcgagcagtgcatggagcgcgacctcttcatgaaccccgaggaggcgcgcgattgggggctcatcgacgaggtaattgagatccgccccgcgtccctgatacccgagggcgccactggcgttgacctcccgcaccacagcgccgctggcgtcgacgaaagggacagagatgtcgaggagccctccgcggtgtgagctgtggccgcaaaggtgaaacctgttcgtgtcc

SEQ ID NO: 8166 - DNA, 7260 bp, Oryza sativa
gtggggcggccgccgcctccgtagcaccgctggatgcacatggggggtgcccgccgccgccggatccgcgcgtggggcggccgccgtcgccggatccgtggggccgagggccgccgccactgtcgcgtcgccagatccgtgcggggggcggccgctgccgccatcacgcagccggatccgcgcgggggtggccgccgctgccggatccgcgcgtggggtggccgccgctggatccggcgcaatcgtcgcgcgccacctcgtggtagccgccgcccaccatatcccgtgcttccacggccgccgtgcactgccgacgctgtcgccgtgggccgtcgtcgtcgcctacacccgccgcacgctgccgtcgctgtcaccgagggaggagaggataggaggcgtgacgcgtgagagaataaaggagagggagggtaccgaggaaatttcgaagtggataggagggaaaagaggatagaaccgaacgggaaatcagtttattttcccgtgcgggcgatagcctggcgccggttttctatttttccatacggtttcacttacgaaccgtatagaaccaaaagggggcagcgtccaggaaaatcaatcgtgtactagtgttacatatgtaaatacttacactaggtttatattataattacatttgatatacttttacctaaaaatatgtcgctatatttttagattaacccgtacttatatactaatcgtgaatacgcctcctaatataactcaaaaaggtaaagttcaggtatgatcatgatatacaagtgacctaatatttcgtagataccatgatataaacccataaatcctttcgactatgaaaaccaacataaatagttaaccggtactaattcaacaatagcttacttattagtgatgttcctattattatggcttggagcgtttggctcataaattaacaaatcatatggcttgaagcatttctcaatagaaggatttagaactgagttttgccttttttatgcatagagcaaaagatttttataaactgcatatccaacaatggctagaaaacattacacaagcaattttgctatatatttgttaacattttttctcctaaaaagttgatatacatggattgtaccgcagtataattatactataatttgcatgtaactttcatgtaattttgaatcgttagatttgtttcaaaatttgtgcaagtgaggaaggaaaagattcacagcgcgcgcacatgtgagatgattcattcccacgacctcagcttcaccgaaatagcatcttatggagatatttttgaaagttacattatagttacagtataatcatatcacgattgtactataattgtatctgtcaaatttttgaaaaaaaaaattatcgacaaatgtataagtgatcccttacacaagtatatactttacagttattatattgaatctagaatgagtttggagggagttctttctcttcaaaccctctactattaattcttcctcttcgtacgtcttattccccctcccctctgtttcttttcatggggatccaaggaggatgctcgagcccccgatacaaacgttggatccgcctctgctgttcgattctttcatactaccatgcataattttctaaaagaacaacttcgtgcaacggtgcacttaatcaaattaagtaattagtacccttggtgactaacagtttaattagtactaccgcgctatataaaatagagattacactctcatacgtgcactacacgtcggtcacgtacgaacccatagagttcgctggccttagtaccaacgcatgccccgcgcatgacgtcggcgatgacgattgcgaaacgagcgccgcgcgcgtacccccgacgtgaagatcccgaacaattcctattctaatatccaagctatctcctctaccccctggtggtatattcggcgcgatatgtctcgtgccgccagccgagaaaggaaaacgggatcacgcattcaacggctcgcgttcacattacgtatgtgcaaatccggccaagtggaacggacgcgcgtcgcgcatatgcacatgcaacaggttcagcgtatctcgcgttttcgcgtggtttgcacacgccatgcctgcctgcccctccaccgaggcgtatcatatatggatgtgttgaacaaactacaaatttcaaattcttatcttgtcggtcaagtattaattcaaggaagacattgctttctctaactagctaggtcaagagaggtgcagagcacatggccatgtatagtttccaatggcgcagtcaacctagcttgttgttatagatataaatatagtcaatataggagtatatgctggtgttacaacggtatatatgaataaccattggcagtgatgtcaaaggggttgatgtggccaccactcttcccgccttgaactgctaaatttgtttccaagagctagcatgctttacatgcacgttagttttaatatgtcaattagcttgtggaggtgtttgtatgggactatttttttagatccggcaaaattttttactatgtcacattaaatgtttgaatacatgtatgaattattaaatataaataaaaaaataactaattacacagattgtgtgtaaattgcgagatgaatcttttaagcctaactgctccatgatttgacaatgtggtgctatagtaaatatttgctaatgacagattaattgggcttaataaattcgtctcgcagtttacatacggaatatgtaatttgttttattattagtctacgtttaatacttcaaatgtgtgtccgtatatccgatgtgacacgccaaaacctttcacccctcgatctaaacacaacctatgttttcaaagacacacaatctcgcttgttcggtccatccatactttatgttttctcatccttatcgaacattcttcctttttatctagagcatgtactctattttatatgcgcacaattgctctgtaatatggtatttcgtgatgagaatggaatagctagaccaattctatctcggccactactttgttgacttggcagtaactgagtaatctatgggcgtaagctcttggtctcccttaatgcttttttgtcacttttttgcgagttgtatgaagtagtttatcaattctaagtttttgttaggtcagttagtttggtctcaaaatctttgagcaagttatataattcttgcaacatttaatactcccaacgtcatataatattgtccagaggccggagtacctacttaattaaaccccatcgaacaacacatacagtgaattactaccaagaaaaccttgatttgtaataacatatattgtgatttactttatatctgtttataataatcaattcaaattcaattatgttcaacaaaaaaattccaagacaattgttcagagagacttcaataaaatttttaattgcttttatcaacatgacatagcatgtattttaaggctaaaaattcttttgaatttaaatatgtaaatgacttaaaaaatatcatttatcccatatggtatgtaaaacatctaatacattttgtaagcaataaaaacaatatttggtgcacggaaaatagtattataatttgtatgaatacatttttttttcttggaacatcctccgttttacaatggctccaattgatttaggttaaataatgctaatatgcaactgaaagttttttatagattcttttgaagtaaaatataaatttggaaaatacaaattaaattgcatccatggtttatgtacttgaattttaaaaattagtaacataattagaaaattcataaagaaatacttgttacaaattggaaaaaaataatttacataaatttgatccaaccaaaataatgtttaattctctcttaaattttgattttattcagattcaagcactatttttaagtagtcaaattatattttatgttcctttcaaaaaaaaatttgtttttaatgatccataagagaggtgataagtttttgattattttttatggggacatgtactaatatttgttgaaataatatatgtactcgggactaaataacattgccacatcagcaccttgtcattaatactacttcaaatttagtcaaaagatgaaaaataaacattatagaaagtttaggaatatacatagcatccaattaaagtttatgggtggattttttaccttaagggatacaaaatggaccatttgcttaaaacaatatgttactgatcagaaagttctttcctcgtgtcctagatgcacatgaacatgtagggaaatggaaacagtccactctgccttcattaaccataagcatagtttgattcacgtacttcaaccataaaaccaggtataaagaccccctcaattgttaaaccgaatcaatttacctcgctggatagttttaatgatgattggtcttatatcgcatttacatggcgcttatattgatatttcttaacgacattagtataaatataaatttccagcaatggcgctagaaatggtcctggtatatatatggttacaaaagaaatccgcaagcacacggatataccattaattataccatttcactcgagagtattccaagatatcgtatttatttaatcccaaggaagattgtaagagagaactgtgctaataatatatacatgccacttgtataatcaaagtctaagcatgggttaaaatagttataccggtagggtgacacaaagctaagcactcatatatctcatttaatcattcctaaactaagtgaaagaagaaatagaaaagcaatcaatttatataattctaatatacgctcaactttagtccacatctggtagtatacaaccatataaccaataccccgtaacaatgccctcctggtgcttcgagagaccactccgggttaccgagtttcttacgaaaacctgtcatggccgtccaaccgggggctaaatatggaggagtaccctccctaggaaagttttttaggaatatatactatcatagaggaatacccgtactgagctgtcactatcagcggcccacctcgactgacccgtagcatatatgcccagataatgctacttaataatctagacaccatgtccacattattaaatactactctacatccctcgagatgacatagagtaaccgagtaatcggacattaaacccacaccactgcactggtaggctaactatacgactgtaccgatacagatataaaacaaagttaatacttagatatactaaagtaccgagagcatatagagaatagtatttcattaattccgaaagtcttacaaaagaaagaaggaaaactactgtcataccgaaattcctccgaagattccgaggactccgagagctattctattctacttcacttagcactagaatactaaactaaagtgtagaagagatatttgagcttgcttgagtgtgttgtgaagtgaaatgagctcctccttttatagggtcggtatgacggttgtagaaaaggcgaaatgaccattctaccccgcaaccatcattgagagtgcatccggagtgtacatgtggaggtccaggctgattgggcgccgctagggttcggccgaacctaggctggcccaacaggcctccagcttcggcagggtcactgataggttggtccttataacggttgtggcaattaatgcagtttccaggacggttacacctgtcttgtgggcctatcttatccatatgcttgcttaggagtgacttttcctcatttctctttattttatttgctcaattcctgcaacaaattattctccaagcacaagtggaactatattattctaaaacaaatatgcattataagcatagctaattctcctttattggtctataacgaccgtcaacagcttacactaggttttttttatgtgacatggtgacggagtcccttcaacatttcccgagtgggcctctacgcttgctcgatgtgcactgttgccacatgcttgatccatcggaccagaccactcatgggggaagcgaggacggtgccaatctctctttctcgctccttcctcctccacctccttgctaggccacctcctccctcttgcttcctcaacttagtggctagcacaagctcgagcacgcagaagagctcaaaactctcccgcttgatgacctcgccgaccaccatgagcattgcatgtgcccctcccttcatcccctcccaggcttgattgtctgataggagagaggagattgagctcgagctctcctacacctagctgcagtggtcagtattggcggcacggtgtttaggggaatagtggagcccaatggcactagggttgggttgcaaaaggtgcatgtaccttcttcactgcgaccgatactgagttctttgatagcgagccctcgagctttttcatcgcgaccctccaagtcctcccagttcagttaatctctcccagtacctccgcttccactggtggcgaggttgccgctgcctctggctcttcttccatcgagcatcgcccttgaaggtcgccaagagagaggggagaagtgtagagagatggggaagagatgagagagaagggagggcagaagaaaaatatagcggtcacttactgacatctgggtccactattatatttatttatttgctaatcaactttaggtcaacttgtcacgtaggataaaaccaacgtccaaactgtttggaaaagtaaaggggcaattatgtttctacccttgctttacaattcaattgtgattttacccctactttttagggtttatgattttgcccctgctttttaaaaatgaagcagccgtctacctctgattttgacagaagtttggtgggcccataatttcctaattaaatgaagaaagataatattattatcatttgtgaatgaccattctacccttggttcaatgagcaaaatccccaatcccttttactgtcccggttgcaagtggcggcggcggcgcacgcgacaagcggcggcggcgacgcgcggccagcacgcggcagggaggagcggtggcgcgggccagcacacggcggagtcgggcgcgggcagggaggcgcggcgggcgctcgcgcagggaggcacggcggccccgcggctgcatgcgaagggacggcctctggaggcgccgcgacgaggatgacggtgaggaagacgactttgccgtcgacgagagggactcgctcgggctgccgtcgccagtggtgagca

SEQ ID NO: 8167 - DNA, 5148 bp, Oryza sativa
catgcaactgttcggttatcaagtctaaatctctatcacgagcaaaaatgcaaatatctgtcactttttacctccttttttctaatcatcagacattagtgttcgttttgctctagaaattatcattgaatggcaaaacatgtccaggggtatatttgtccattcaccacaaatttaacaccgttaccattagttaacagagtaggggcacgtggctgcttcgtttttaaaaagcaggggcaaaatcacaaaccctaaaaagtaggagtaaaatcacaattgaatcgtaaagcaagagtagaaacacaattactccaaaaataaaacgaacctttttatagttaagagttactccctccttctcaaattgtttatcatataacaaaaaccaaaatttctcaacttgatcatcatataaccgcatggacacggattttatcagagtacaattaatgcagcacaggagaatttttgcatgtcaagagtgcaattgtgcattatgttttaatagatgcatgcattgtgggagaatgtgtgcataatattgtgcatgacgtcttgatccatgcagtttaaattatccttggtcttggtatataaatattatatgatgattaatttgagatggagggagtatttggttttgtggttgagtgcacaaaatgagactggggtcgtagttgagggaagacaaaagaacatctcctagggaaattgtgtttcttgtgaaaattttgggcccaaggcctcattttgcaggaaggggtggaaccgtaaaatcatctcatttcttctgctggttccctactctagctcgctagtgtcaatcaatgaatcaagcggccaccaacctacctaccccgaccatctcccaccatcggaggagacgctcaaactaccgagctgcccaatccatggcggcggcggaggcggaggcggccggtcctctccggcgggctctcttcgtcctcgccgtgctcgccttgctgctggtagcggccccggcggccgaggcgtggacgggggagatccgcggccacgtcgtctgcgacgtctgcggggacgccgccatcggccccgaggaccacgtcctcgaaggtatccttccttatccgacagccttgcgtgctcgtagctcggtccttgatgtcgatttcgtgcgtgcggttcctagagtggatctcgagttaagagtcggctgccccgcttcccctgttctggatcttgccttgcgttggcgctcatgattgacctagtggaggaattggagccgttcggtagagctggaggttgcgttgcatttgagaggggcggggcgcggttcgtcgatggagagcgtagttgcttgctgccgttctaacgaattcgaagttttactttgaactggtagaaggaactgtaatttgtattcccagtattagaaggacataggttggggatggatttgatatctgatcacgtgaagcacggtgaatcgacccttttcatttgtcttgaaatgaaatgaattgctgccttgatggtgaaatttgcaatcttggccttttgcccaattcaccaatttgtgttcccatttcccaaatttgtttatgtactctacccacgtcctgttctgggaatttggaaaagtttaaccatattgccagattcacccatacatgacagttgattcagagaaataaaaactgaaaaacggttgtcaatgttttatttccctgttatatattcttctttgaggggtcaaataggggttatgtcctactcgaccttgcaacttgcaggaacttgtttttactaagatggaagaactgaagtcgaattggccgatcatatgttcaaggagtttaccctgtaaaattgttgggtccatttttggtgtccagtacttccattctcttgcttttgactttcgctccccagtaataatcacataagcatggtactatagtatttggctcctgagctaatcaaagtagcaaaaatattgagtattgctcgtgatgatgcctgtggtttgatataattagataataccaaatgctaactgcaaagaaatgcagtgaagccatagatccttcatttggatggtaggattaaatgttgaaacatcaatatcaataaggttaaaaagtccatggatattgttagtggtctgcaggtcgatagctttcagatcaagtcaggtgtgtgttctgctcgttgtctggacctagccttttctttatacctggtcactattaagtattaagtagccggtttctatcctttgcctacaatattacccttggcactagagtctggcaagtggcaaggcggtagtctggcgcttagtacctaaccacagacaaggaaggctaaggtttggtgcgttgaggcttgcactgagtacctatgcactcctaggaggacttggtgattgccaaggagtgtactgcttgcacattgtaaactctcgaaattatcttctgtttgttagccgattcattctgctatggtttgaattgttcattgaaaaaagaaactctcagcaatgttgggatgctaaatgaaaacctatagatcattaatgttgttgtgcttgtgggttgctaaaaacttattaggtctggcagaaccattggtagcaatgacaaaaacaaagcgttggcaaagggcaagcaaaatggtcgaagcatgatgtggcgacaacccatttagccatttctttctttaggtctgaatatccagaatcggtctgatgggttttcacaattcgttcattcatatttcaataaaagagggttatcagtttgtttatactcatatattccagttttcaatgaacaatggaatcttatcccttgatctatttttagagtacattcacaaatgacaactgtaaaagtctataatgaaaccatacttttaagttatagtttcagcaaagcaaacttccatttgcactacgaatctacacttttacacattgccatcatcttcggcaggcctagtaggttagggtgacttcttggtctcaggatatgtttctgtttccatttatgtcatatggaggttgttgcaataccaaattaactcataggcgctctattgcttggtggggtgggattgggactacaactactaaaaatccctcctattcaaccccagatgccaagcaatcatgatgacatgctagcacttatccagtgttgcaagaacctccatgttagcaaaatttttgatgagtttgtgaaccgacgagtggagccagccagtaggatattacggcaatagaaaggctcatgtggttcagagattttgtgtaaaagtgtgattttgtgattcttttttccccaatggtagtgcagttttgtgaaatttacttcttcaataataaaagctgtaatggaggggcaagtgcaatggggcttgcttttggcgatagctagaaacctgttggtttgagtataaagtctgccggttgaacagatagacctgctagggtttttccttgtttccactttccacctagtcagcaaacactagtacaagtacaatggtagactggtagctgccttaccacaagctagctttgtttttttttggggggtgcgcaggcatatacatgtggtcctattgtttagtacttccactttgtgcatttcattttgttttcctcacttttcattcctcacttatgtttacctgtacactgtaatcaaagtactaaaagcttattactctcccattcctcttgcttgtctttgtaccttgtataggtgccgaggttgccgtcctctgcatcacgagatctggtgaagttatcaactaccaggccttcacaaactccaagggtgtctacattgttgcggagacgatgccagagagtgaccgttgggagtcatgcttggcaaggcccatcagcagctttcaccagcattgcactaagaggggtgatacacactctggggtcaagttcacatacagcaagccttcaggaaactctcacaccgtcaagacgttcctctacaagcctgccaacgcccctttgtactgtagctaaacgtgttttcatttgtttgcgaaagaaagaaaagaaatatatagaattgatatggcttcctgcctggacatggtacaaacaaactgtaaacaaggtgtaaccgtgtaaagtatggatagctggggtgcttgtaattctcatatggagctcttaccgaacatcagtaactggaagaaaggggattttgcatgtttttgtaactatggatctataagtatgtttatactttataatcttggaccatgttgcgtccgttcaaatcatttcgagcaaagacttgaattctgttaatacaaatgagccacaaggcccaagggaccaggccttgccttgaccaagtagctgatgttaataaaaatgtccagttgacccctagctgatgttctggtaataataataccttctatgtttggccgcaaaatgagaaggcaaacattactgagtctactatatgtgcatataattgttttttaataataaaaatatattatatccttggcctctgtttgtagcgcatttcgtttaagaaaacaacccccgctcagatgcgtctatttcgcaggtgtgaggtagtcgctttatgattctaccttacttttaaacagggtcgtagtgtcttctatcgagcgatataacagcggtaacctgttttagaacacacaaattgtgctacccttaagagtttatcagtaaaatcaagaactttatttatgccctgcaagttgcctcataaaaagtagatgttagtacccgactaaaaggagggaatcaaataaaaggtaaagctctcgttttaaaaagtaaagctatcgattaaaaggtaaagctatcatttaatttgttaaaggtatattgcccgtagcgaggttaaggtaaacctttgaccgagtgaagacgagctcgataaaagcacggcacaaccaataatggaaatgtgcatataactgttaagggcttgcgtggattaatgcccaaataaaccttagctaaatcctaaacgatagcaatactattggatttcagccatcatttaagttcgttaccaaaatattttatcgcgtacttgagaaaaggcgcccaaaacacagtcaattcagagttttggc

SEQ ID NO: 8168 - DNA, 24658 bp, Oryza sativa
cactactggcaggatcaaaccacttacccatcaaccggtagaagcgtagaaggaatcgctccttggttggctttgtccagttgtttccccctaatgtactcctcctatggtcctaccacttggttattcaaataaagtcagtttacttacgatgctcgatgatgctcttcttgtgtctagcatattgtgtcatcaccttgatttagcacatttggcccagaagccagattgcggtccaccatctacattctagtagctccataaaatccatcttgcagcctccgagctgcattgtatagaacaacaggcgagtaatcaaaatggcctctccttgtatcgaattagagatgcaaagcttttacctgtccagatatttgctataccgattgtgttgtgctccgactcgggctagccattgccccgccgctgccaaacctctttcttcaacccagtcgccgaacctcgctcagcctcaccgcaccatgtctacacctccctgcaacctcgttgactcgttgtaatggtgctgcaaccctagtcgcgacacctcgctgcgatttgggagaaaagagggcgacggaagcgagcggtggaggaagagagcaaatgagaaagaagataggggcctaaaagaaaaggttcacaatgcaggtggtgtcacacatgacacatggtgcacgcgagcgagaccgccagtctggatgtccacatgtcgtgttgcggtcaaatggtgctttggaccggggattgtacatttagcaagttcagtagtctaaatgtgtgatttacaagtttgtgaacttagaaacacttgtttacaagtttaagcgttgctagtatattttactcttaaccaacacacatccaatctgtattattataaaaattgaaagtgtcttcaccagtggtttgctatgtcgagtgtcatgattacatcggggtccgattcacatttcagtcgcgcggggtaatcgtgttcaattcagcagccatgcggggtgattacgcctgcgacgactgtggcacacgttttctgttgtccgactctcttccatcatgcgcgttgtgcatccatgtcccgtgtcataagtgaagtccaaatcggtcgctcccacgtgcgtgtttactgcatgaagatccacacccagatcgctaagacatgcagtcccacgcgcggtgaagtccttctcccgactcctcttccacgtgcgcgagacggtctcatgattgacttctaataatatgttcgttgagtaatttgcgatggccctggcaacctctttccaatttgtttccgtcctgttacttcatctttgttatggtaatcctcgtgtgcagtcatgcatgacaatagcaactagtaagcataacactggttgatgcgattgccgctatgggtaagtaaggtcagcttggaaggatcaattatcactagttaaggggagagcttgtgatgcctaaagtggtggtgcaggcatggaagaggttagcagcaacgtgaccgtagacaatatgatttagcaagaccatcactgtgtctccacgctccagcctcactgtctaaacttaggttctttattttgttccatgatcttattggtgtcagtttagcaagataattcacatatccttgcaaataatggaaggatatgtgaattgtttgcttggtagaatcaaacaattcgagcaactaaaatagaactatagtttaattttgctatcttaacatccaatatgctagacaacacgagatattgatccctgaagtcaaatgaccaccctctctcttcttctaagtgccacctctctatctaccgactatgatgttttagttttttttcttgtaatgtattagcatcttgctagtaatgttctattaaaatttgtaacgtgaaaataaaaaaaatagtaatattgtaaagttgtggtgtatacaatgttttaaatagcgggctaagacatttagcgttagcttctcaaacagctatagtgatagttatagcgggctaaatagagttatagcggttaatcgtatatgagagcaaatagtaagaacccttctcaaacagctatagcgggagatagtgcagctatagtgggagatttaaaaccttgggtgtatatgctcgcatattccaatagtgtcatataccgagacccggtaggattccttcggatagacagggttgtgttcttttggaggggttaggaacctctcccctccgcacgtaaaacggagcggtaaattaactcatgattaattactacactgtaaaaaaaaaaccaactctagctatgaacctcattggtaggattaggttttttataggacggaggggtaagcattacctaaaataaacttgaaaaatagattaatatggttttttaaaacaattttcatatgtgcgtgtgtgtgtgtgtgtgtgtatatatatatatatatatatctttatttttatctttatctttatctttacctatatctttacctattataaaagtttaagatgtttttgcccaaagttccgtacgtcacccacatatggaaatagcacccggtttttttcacacggtttttttaacgcccgttttttttgtctgagcggtttttttatccgactcccaaaaaatccgctcatcaccggtttttttaaagcccggtttttttgtccgaataccaaaaaaaatcgcccggttttttcacacggtttttttaacgcccggtttttttgtctgagcggtttttttatccaactcccagaaaatccgctcgtcaccggttttttttaagcccggtttgttttgtccgactaccaaaaaaaatcgctcgtcgcaacaattggaaataggacgcacagtttttttttcgcatgtttttttttccgactcccaatagcatacggtttttttagcgcaggtttttttctcgcaaagtttttttttctcagatcgcatccgtagcgattttgttttccaactccgattcccacccagatcgctcttccccgcacggtttttttctctttctcagatcgcatccgtagcaattttttttccgactccgattcccacccaaatcgctctccgaacaccaaaagaacccccaattttacatccgaacaccacaagaacgctgcatacatcctatcctcctatatatacaaacaaaactggtaccacaaataaaattcgttcttgtggtgtgatcaaaagacattctaagagctctgctccatcaccaaagaagccatcgtgccaagagcagctccgtgaacaacttcaattgtattgaggatcacaaattcacaatgcctgaacatacaaaatgcatttgtaagtattctcagggccataagttcatcagcaaccatcaacaaagacacaacatattttgatgcatttgtgtaatgatttggaaggacaatatcaaatattctaagcagttttcataaactcccaacaaaaaatatttagaggaatgcggcattactaaccattctagacatcttgatctcctgtcttggtagttgaagtttctgagttcctatcacaatataaatgcactacaacagaataagatattttcagtgttcaaaacaatgttagcgattcagtgctaaagaccgactcaatcaagaaaaaaaaatgcaataattcagtggctgatgtcataatttcgttttcagtttgaaaaataaatatggaagcaggttgaaaactttctgttcctagcatttttcatcctaatctctacagaaacttcagcaacctaaagcaaaacagtaataagtataaagtatgtgataagagaagatttgctatatgttttcttatgaaaataatataacacagacaagtctttaccaaacaatagcagattctcagatctatatttctcccaactcatgcatgttatgtgatagacaaattttgctatgccctaccttttatagcagtcaatgtcagattctcataccaatattttgtaattcttatacactttttattcttaccagctccatcacacatgcttgatgctggtaccacgccatctgcatcaccatccccactcttggatcctaatgtaagaagaagacagagataaggagcggtatgcgcggatgacagacaaagaaaagcaggaaactctagcaaagcgtcgtgaagcctataagctcaaaaaggagtcaatggcccgtgcaaatgctgatgaactacattgcatcacttttcggggtgatcaaccagggtcattgcatactgcacattccgaacaagaagacccagcagtagacccaaaagttatccaagaaaaacacacacgtgaaaggatgagatatagaaatatggaactgaacaaaaaacaagttgtgatagaacggatcaaagataagcgtgcatcacggcgcaacaatccaagtaaatattccatagcaatggagaaccctgggtatatcacgacggatatgtcaccccctgtcccaacaagatcaccaaaaaaaatgtgtaacgcatggagaaagacatgcattgatggcacgtcgcaacgaaagcttcatggttagacgagacaaaagtacttctgccttgttagaattagaagatccttccataagcgcccaaccagtcagtggcgtagacccttctaatcaaccaagcgtaatgaacattggtgaggatcctagctatatacacttactttatgttgtactgcaatgtatcctggtgtactactaaccatcttctttcaatagacaataacatgtctacaatatctaaaggaaccaatggtgtagagcctccatcacagtcacatcaatgatgatggtaacattgtcatctctatttgattttattttgatttgatacagttagggccttaatctacatatgcacgtactgattttttatgcagccgatggtgaggtcatatttgacgatgatactgatgaggaaagcgacatgcttgatgatcaaggtaattttgtcgctgttcgccaccatcatgtcaaacgtaaacttatatcttggcactaaaactttccaggttgggaggaagatcaggacatacaaatcatagatgttgtcgatgccatcactgagagccctagcatccctgatctagacaagatcgtgtacagcaacttaccacaaagcactcatatgctgaaacccgtagaaaattgtggattttgtggtgcaaaaagaagtttgagtatgagtcaaagggcttctgttgccgaagtggacaaatcaaactagccaatcaagacacacctcctgaactcacgagactgtggacgagcgaagattcagatgcccaacatttccgcaacaacataagatttttcaatggacatttctcattcacatctctttactgtcaccttgacagagagataactgacatcaggaatagtggtatttacacgttttgagctcatggccagatgtatcacaatatacgttcattcggtactgatggttcaaaccctaagcgtctggaattgtacttttacgatgatgatcctaccctagagcatcggtaccgtcattgtcggccagatctatacgaacaagatcaaaaagtaatcagcactataactaacattctacgtggtaatccatactctgagcagtttaggagtttggggcaagccgagaatctcgaggactaccgtgtgatattgaaccttgaccaatggttggatcagaggacgtataacgcgccaataacttcagaggtggctgcagtttgggtcgagggaaatgagcgacgaaagacatttgacaagagtgtaatcctacaagggaacaacaatgaaacaatgaaatagaaggcatccggtcgtactatggatgctatgatccattgtcttatccactattctttcctagaggtgaattgggttggcataccgatataccaaagtttggtgttaacctggaagatgtgctgaaggctcgtcgtaatcgcaaaaacaacgacaacaatgacaataacccaggttagtatttcatatatttttgccttcaacatcatgttttgttaccatacatgtttacatatgtcgctctcttctaatgtgatgttattcacagattcatgtatacgacgacatccaaatggtgaaaaagataaagggaacaatatcaaaacactatctagacatgcaattttgggtatgtttttacaatcacgtgtattattccgttttgcaattttgagtatgcctttataatcacatgtattatcccctttgtctcatgttgtatatcatttttgcacaattatatacaaagatgactaccaattttggacaacacccaaactttcgtcaaaagctcgacactgaacggctagcaaagtcagtttgtaattggcctgggattgactacaatatttcaaaatgcagattggtaagttctcttccatttgctcatcatggccatgatttttttctatcctaacagttagcttttacagattcttatgccaatagaattctataaatttttcattttgatcgtattggaccaagataccagaatcgtctatatattagacccgactccgcttgaaccaatttatgagaacaacccaaatgcaagatatgtcaaaaaactactatggattgccaaacacttgccaaaagcaatggcaaaagcatgccttgggtcaagatggaacgaggatatcaacctatggcgtcaaataattctaccaaatgttccaattaacaacgggtaaactttcttttaaactccattgtacaaccagttaatttatttccctaaaacaaaattaattaacaattaaatttttcttagcgaactatctggttatcttgtgtccctcttcatgcgcaaatggaatgatgaagaattgcagttaccaattataaaggcaagtatcgtgacacttagcattgactatttaaatgctactacctttttacacatacagtgctaaccttgttcgcttacataaataaatgcatatacaggatggatatgagctaaggaagcatttcttagtagaactattggcgtaccaagagaatgaatgtgagagcagtatgcctcaaggtgtaagagacatgcttctatgtatcacctcaaagaaatagataattgactacctgattaatcagacatgtatcttttcatgattatctaaataacttatagtagttcaagagtccgtagagcttaccaatttcgcgcggtgaaaacacataatcagcttctggtccacgcccactatccacaacacaaagcaccccacagcaggcctacaaaaggatgtggttcagtaccttgacagaatacattgtgtcaattcaaaagtctacagggaaaaacaagttgcttcttctgctcacaaaaagttccatcgctgtgcatgctttacatgagcttaattagttaatgtgttttataagcagaataagaattgagttcaagtattctcaattaagtagtggaaaggacgaccttaattagttcgaacttaatttgacaagattactaatagttagtacaaacttacaacgaacaccacgaagctgccgtagctgaaccccaacactgtgcaccctccatgccgagacgccgcgatgcatgttgcctggaaccccgtggaccggtcgggcgatggggacgagtcagcagacgaggggtgattattctcaaacacacctccatcctcgctccaaaactcccatcaaccgaatccaggcgcagaggccccagatctggtgattgccaccgcaacgacgaagcaggagagggcatccagccgcggagaccccagatccagtgattaccgctgcaaggccctagatccggacgagaggcttgtcggaagtagatccggacgagagactgaccggaagtataccaccgtcgccgagtccaatccgtgccgctgccgaggccactccaccccgtcgactgctcgagctgcgctgtggccgaggtgcatgaccagatgccgccacgaggtgaagatggggagccagcagggagagaaagagcttggagatggggggttgggggaccagcaggcatggcatggaaggaccaggcgatacgctagaggtggccggtggtgggaaggaattgggggaaacaggagtacatgagtacaggacattgggggagaggtggtggggaaagtgaaggagaaagtgcttttgggacttatctggtggtgccgtggtgctctggttttctttctctttcttttttcctctcggtactctctgccttgtctgtttttttttctcactcaatttgagatgaaaagtagtactatttgtagaacggtgtgttcgccgattccacttgggaaccatgtgtcatgcatgacggaacagtctattagaatgtgaataattaaatattattaaaaaataaaaaatagattaatttgatttttaaatcaactttcatatatttttttttgcaaaaaaacgcaccgtttagcagtttaaaatgtgtgcacgtggaaaacgagaaaggggagtagagaacatggggaaataacacagcctaactaatagtagatttaacttatatacttattggaagtgatgaatcgatgagaacatttttgaaggtttcacttaaaaacccatttacctgtctaaatttatatacttctttgtcttcttccttctctctttgcatcatcttgctttgctatggcggtgatagcagtcagagcaccgctggtgctgcagaggaggtcagggtgcgatgatgtcgacggtgggcggtcctgctagccaccccctccttccctgtgccctaccttgcgatgcggttgtgtcggtgtaatcaatgacactctccacgaaccgtcgagacctcggcaatgcacgcgagcgtctccattgcatccactccgacgctccattggagctggtgcgacgcaggctagcggcttgatgcgatgctctactatcctttttaattatttattttaaaaattctctagttcaaatatgctaccatcatcaaatggccgatattcaactattttttctcaacaacaaaaattttaaataatcagaaaaatatcaacaaaattttttttctcaataacaaatatttaaattaacggtgtcactcttagatggtgtcaggacaaggcgtgtgacaagttagccctcaaccgctatggtgatgtgcagtttaccatcatcccacaaaggataaaaaaatatgtactgttgaggacaaatgcattttccctttttcccattacaagaattaaaattgtgttcacccgttgtaacacacgggtatttttgctagtatacatatacatatacatatacatatatatatatatatatatatatatatatatatatatatatatatatatatatatatatatatatatatatatatatatatattacaaaatacgtaacgtttagtagattgggaagtgtacgtgtggaaaaaatacggaaaggctaaaaaactgtcgacgcatttttctttagaaatatgtcgatttctgatccattagatcaactgtaagattcgtgctattttggttgacgaaaataaaattgtactgcaaagaatcgaacctatgatctccggtggcttatccagcggtcctaaccaactgatcgagcaaagatgttggcttaaattgaaattacatactaattacacttaaattatatactatttacatatgtaatttaaagacttacattgtaaatacactaaaattacatatgtaatttataaacttacaatataaatacatgctgtagctcctcctaaaaattatgagtcgggaaaggtggtgtaagattgtaagaacactagcagtcatcaaacggacgaaaaccatcggacgtcgtcatcggacgggtcttgactcttgacccttcacatttcggtcagctcgtgtcccaacaacgttcaacgcgttctgccacaacccacaaagccacaagtgaagcggccgcaccgatctctccgtgagagggacgcgtagcaccctccgcctccgcgcctaaacggcttcgctctctctctctctctctctcggcgtccccgcctttacgcgagaataaccctcccgaaaccctccttccccgatcgatgccgccgccgccgcctcctccgccggagtgggccgacctcccggtggacgcggtcctggcggtgttcgagcggctgggcgcggcggaagtgctgatgggcgccggggtggtgtgccgcacctggctccgcgcggccacccgcgagccgcggctctggcgccgggtggacctcaccgcctgcttcgaccccaccgtcgacatggaggccatggcgcgcgcggccgtcgaccgcgccggcggacgcctcgagcacttcgccgccgagcgctttgtcaccgatgagctcctcctctacgtcgccaagaggttatggtctttcattttttaccccttctttttctttttgtttctataaagcctggggtttggaatctggacgatattgggttgtgaaaattcgggagatttagggtttaatctacagtgttatttggtcgctctgattgtgtttttcttattagagattagcggggttttgtatgattttacggtatgatgatttaagtagagcaaggagtatatatagattggagtttttatgcatactgcatcattataaagttgcagcaaaacgctgcaatgtgccacaacgacacaaacaaagcataagaaaatatactgtagtggattagtggctctaagtacacatgttgttgatgccttatgggttggccatgttaagggttagcagggatttgagcatacataacaccttgcagacttttttgaagcacggttctgtctccccaggtattgatgctgggttgatttgtttttgttttcggcgtcaccagtccattttattaaatttggatcttgtgttgcattcatgctcgacaactgcattgtcgtcttctccattgatactacatataccagttaggtttctgtttcactagttctggactgaaccgaggccatcatattgctatcaaatttattccaggcacaaaagaataatcaaacattgttatatgatcaattaatagtaataataaaagaagttttatgcctttatgcaaatcattagatgtctcgatgctaattcttttaacctttcgatagcttgattgtttggttatttcttcttttctttttgggtttcatttccttaatgaacattttttgtcaccttattatcaatacttctggctaactttttttagaatgcctgaactattgcattatatgcctcagatctctatattgtactcagtcaaacaaagtaaagtataattgaaaagcaaataccagtttcttagatgattatattgatatgacatgacttagatttggtagttgtcttgtaaagattacagatatggagctgtggagtcttttattggtatagagccagaaaatttccggaatgcacactcctgtctcacaaaagtgaccactaataatcccatggtgtatatgatacttgctacgaaaattctctcttgagatctctagtataattccatggctaaccctaactttgagctaacatctctggcaaatattatgggtgatgaaacttgagattgatcctgatatctataatttataatttaccccactgaacagaaaatattatttaactatgctagctttttatatgacctgatattatgttgtctgtaatcatttccaatggaccccaatttgtagggtcctgcttgatatcatcagttgtttttatatttcatttgtttatttttaaatcatttttttatgaacttcctttcttccaaggtgccatggcatcaaggttttcactttcggtttgaaccggaatttcagtgcaaccaaaattttcggatgatttggaacttcttttcccgaaattatttgaagatttaacaaaatgactgaacttgaagaaattttgaccaaattcacaaaaatttggaaaaagaaaaacaatttgggtgagatatttgcttgccggagggaagtgaaattaccaaaatttaggaaatttcgaacagaaattggaatccctgcatggcatatgcataagatgagaattgatggcgaaattcctcctaggccattgaatgctatctagttcccttgtttgccataaaaagtttgtaattcttccgtttctcaattagttcatttttatctttcctttcttgcctatatcttggttttaacctaggtcagatggcaagacatcttttctcttctcctttctccactcctttctcctctcttcctctttctgttcaatgcacagtagactatttctgttcgttcgcagcctgtcaagtcagttaaggccaaccctggcagggaagctgacaatcctgctgcttctgtgccagcactggtaccttgatgaccgacttcaagtccatcagagctggacaatgcggacgaagcagtatttggagttagctgtggctgtccttgcatcctcatcttctggcgacatgatgattccaatgtgaaaaggttgggcatgacacgggatgtcttctaatggtacctagagctaatggtgttgacttgagtggcaaataagggaacaacgttggaaatgtttagcataggatgggcacaatttttgtagtgccatataagggaagctaattcaatgggataggaggaattctctttcagataaagacttttatgcaaatttgactatattgtttcagtggaaaacataagtggaatttatttcttctagtaagactcagctaggctgtcatagagtgtaaggccaaaggaagaatctaaactattcagcataggtgtgtgcaatccttcagataaaatgtatgtactttaaccttatgggggttagaggtgatatcgtatatgtaagcaggtctttaacatgagttttgtgtaactaggcttttttggtgtcaaagaagagaggttagtctgcatatattcagacttaacgaccagcttagtgtactgatcaaagtgtgcattgggaatctgtagaatcaactagattgtttttctccaacccagcccttatgtttctaaatattctctaggagccttgcttgctgtttttcttccaaaaaaaaacttaatacttggtttcagatgttgtttacaattttcaacactgatttactattatttattggatctaacctgccaattgcgttgctcatagatagatgccaatcgtttcatgatcatacatggatttaggatagagggaactcgagcattatattgaactaatgaacatgcttgagttcatgagttctgttagcaatttagcattactgaatgcttctatatttgacataggatcactttgttctgtgattttatttcacaaccacaaatattgacagtctctacttacaagttgtgcctttatttttttgttagggaactagcctattgttcttactgtcaggttgttgattaatgtcgatttctctaacttatgttttaatatgtgcagaactagctgcttgaaaagtcttcggctacgtgattgcataaaaatctcagagaaaggcttggttgctgttggcaagacatctccctgtcttgaggaacttgagctcactacctgcaccatcagtattttgctgaaggctgttggcgaagcatttccgaacctgaagtgtctgcgactgaaccatcgttggtttgatgttcagtttgatgagttcagagataacttccatgcccttggaatagcctgcagcatgcacaggctacgccatcttcagatctttgccaatcggctccgcaacaatgcacttgctgccatccttgacaactgcccgcaccttgagtcccttgacttgcgtcagtgcttcaacgtcgatgtggatgcagaagtgagagcaaagtgtgcaaggctgaaggatgtgaggttcccaaacgactcaaccaaggactatgagtatgagacttttattgagacaccatcactagattcgctcccacttccatttcccgcagcagttcctcaatggcccttccatgggaatgacgaggatgacgacaatgatggtgatcaggacgatgacgatgatggtgatcaggacgatgatgacttgggcggtcacagggtgacagagtatggttttatcatcggtgactaccatgtccgcggtcggatcatccaccatgagtaactcgacatctacatgccgtaattagcaggttttgatgtcccagcgtctgagtctcaggaaatggaaggtaggtgttcagaagtaaggtaattcgctgagcgctgtaagttatttctgttgtagtagcttactacaacagaagggcgcatttagaacggttctgtatccaactgcaagtctgcaaccggtctagtgacctcatgtgtagtggtaaaacctttgttcctattctgcgtgttgccatagcgcttgtggaagtttcttggtttgtgtacgattgtgatggtgaaatatgtttatgtcagcggaaaggctcccgcgaactggtttccagcccacgtgcgtggtgcgtcgggctcatcgcttgctttctttcctttattatccggcgtccagcgacaagcttaattgcaagttgcaaaccttccggcgttttgcgcacttgtggacttgcgatgaatgaattacatcgtatgtcagattttcgttgtgaaaactttgtacaattaaacttcctttgtagagatcttcaacattggaacccttgaaactttgtacaattaaacttcctttgtagagatcttcaacattggaaccctttcaatataggtactttccgcactgaaaattttggtggaaactcaaaacgagttcaaaaaataagttgaaaaaggaaatggtatcctaaatactctctgttagtgaattttaaggaacacaaatgttagcctatttttctgtgaactttgttaaagtcagaaatttgacatacgacagaactaaaacaccagacaatataaatatagaacggagggaatacaaaccattctactcttcattttctactccctccgtcccgaaaaaaaacgaatctaagacaggatgtgacacattctagtataatgaatctggacaaaggtatatctagattcgtaatagtaagatgtgttacatctagtactaggacggagggagggagtataacacttggggagaaattgcaacgcagaagcaatcatggaaactatcattagcacttgatgagataaatctgagtacaagtattatatcatattcaactattttttccgtcacaattacactttattatgagtaaaaggtaacaattacatgcttcaacgtacactcgcccaatcctcaacgcagagaagttttaaggagtcaaaagataaatgatttacttgagcagagatcttgcaaggtgctccctagcagtggctaaagcctgagatatcgtctgcagagaataggccatgaaaattaatgagattatggaactagaaaagcaaattttctccgaatgataaagaaatacctgctcagagaagggggcagaaccatcaacagcattggttgcaaccttcccggcaatggtatttgcatctgtttccagaattatgctgcaggaggactaatggtttcagtttatatttacaaacaggatggcatgtgaaactacagcttcacaagagagctgcggccttaatacatgaaattggcagcgatcatgctttttcccaacaccccatgtatgcttttaaacggttttgtccacaagagtaagttgtgaaagaacttcagggaatgtacagcagtacaaggatgagaaagtagttgtttctactgtcctccacatcagaagacaatttatgagagatgagagactactcatacaaagagttctgtctataagcaataggtacaaaataaatactacggcgtcctctcattcgtggatggaggtagtactcagtgctcaaaattttacatgtttttggcactagtttcctcgaagcaatacaagctctcgctctgatatcatatcttttgccccaagtcgtttgtttagtaaatagatgatcttaatctctctcctccacatcagcaaaaaatctatgtggcagtgctaatcatttactactcctattaaatatccaactttcttatatgcatttattgaatataatgcaatatttttttatctctccttagtctagaagtatgttcttggaagacaaaaggattatactgcaacgatgctcacagaacatttaaagttatcaccatgaactagttaagcataaaatggtttttcgggcagaaacttcccaatagcttcagacatcagcgtttgtcattatgcaaaaggttgtcaacttgacatcaaatgacaacacctatctaaaatattatgcttctcttgtatctgcccacatttgtcaagagttacagttccatcggttattctgacctaatagctacaaccatagtacattcatgtgcaatttaggcttactaatggcatgtcaaactaagtctctacagacaatctgttgtgctgtttttatgcatcaaaagaacacaatgaacagtttcttccttcttttccatcttaaaaaaattgatattacacaacagatattgatgtttgcctttatgagcataacatattttatgacagtatatttacatgtttaaaaaaagttcaaacaaataaataaaatggaatatcagatactacttaattaaaaaacatgcaacagcgtgtgtacgaaaaaaaaaagtataatagtcaggaatgcttgcatgtgattttttagaagaaacaggtggtacaaatgtagcatagatcacaagaaaccattacccgccatctacaatttcatcgatgcagagaagtatcaagtccagattctcgagtgcagtcctcttctcaacatcacccctaaagcacagtaagctgactttaaagaaacagccttaccaacattaacaaaatacaagttcatgtggaatactggaagaagtacaatacctgagtaaaagaccaacagaatcagagaagccctgtagtacatttgctataatgagctcattctcatcatcaccagcggtgacaaaaaaatgaaggtcttgtacaaacttataaacgacaatatagccatcaaacaatgttatctcagctggagagaaccaaaaacaggtatcaaaggaaaattccaaattcaactaaagaataaagatcagaaaagtggatatatcgagacataattataacattgagcataaatatgaagatttttgttcataaaaatgagttgctagcaacagcaaactaacataatcataacagactgctggatgatttcaaaccattgaaacagtatcattttatatgaaggatatctttccttgaaagcttggaaagggaatccaaggtattttgctttagttatccttgggagtaaatgctaggtgtgttttttttttaacaagcatggctgagtagtctatattttgctctttgtatattctttcttctcccttgtacatacatccttttattaatatattttcagtagggaagggatcttccctcctgtttatgtcgaaagacagaaaactgacatgtatcttgtactacatttggttaacctgaccgatccattacattcaacggataaaacaatttgagtttcctactaaaatgttttggagtgagacttaaagcacatccagttctaatgaacatccaaggagatgcaagcgtcttacagagtaatataagcagtataatgattgatgggctcaacttaagactggatctagatgtgtgtgaaatttcagttaaaggtgtcaaatatgaatccactctatataatgacagtacgacatattaggctatattcatgaagcagaatgtgtgatgtgccaaattgtcaaagtggcaaaagcatgtgccatggtatggagggataacacatgcaacaaagctaagaatgaaataccttctgagcgtgcatttgtcttcagagttttagtaaagacagacttttcaaaggccaactttgacgcattactagaccaatcatccgagaagtatttcacggcaacacgtttcccttcagaatccagaagcaaaatgttcttcacagaagggcaagattcctgtgtaacgaaaatggacaatcatgaatcattacatgagcttgtgcaaaggacagaaaaagttacttaatgctgcatttcatgttcatcaacaaaagcatcattgcatggaaaaacaaagttaaacattgatagaatgaatcaaataagaatgctgattcagtaaagagtacaaaaataaaaataaatgatatgtattttttttttaaaaaaaacaataaactggatcgataagggccacttgaacacccaagcaaatggattgaatatatcatatctaatagcaatcctactgggttccatttctcatataatagtgtttcttaacaaaaagcttcgattaccacattttagtttcgacatgtaaatatgtaatacaggattaacgagcattctaacatgtactcaagctccttagctccatacaagagagatttaacattgccattcaatattaaggttgatcttcacacaaaacattacaaccatactctggcatgtttggcattgccgcagtaataatagtttcactcattcatgatgaccagatctccaccgctagtaattaacacccagtacattttgcaaaaaccggttaccaagcaactacatattaacaaatgataatccacttaccttggagaattctcccatggcctcctctagatccccggtgccttccttcctgtggaggagacacggccaccgaaagcagtaagatcaaccacttgtttggcaagatccaggctcaaaactgcaaccagcaaaatattttttttaatttcttggaaacaaactgctgctgctagtcagggtcgatctagagaaggttaaggcgaattaagagaaaaactgccagatccaggggagaagacaaggtgaaggcaaagagaaaatggtatgggcagagagggttgagagaggatgcgtgtcgggggctgatccaacatttgggttgaacaaacagactgttacttgtattaaggttaacacaagcaaattcgagacaaaagtacttccggttggggagagcgatggatcagaaagaggatgtggatgctcaccaggatgcagcgggacgatggcgcacctcctccgctctgctctgctcgccggatggagatgggcgcccctaccaaccctgctctgctcgcgagtcgcgagatggagatcggcgcaggcgctggagcggaacgggacgggagattttcaatgacgcagaggggacgggggaaatactccagtactccagatttatgtgtttttcaatttttatcatttgaaacatatttttcaaatatacctcaataaaacttattttaaaaatggatcccctagcctcctgggatatttaaccttttacctttttaagatgtagcaattaattatttgctactcactatctatgatatgtggggcctcatgtgtttatgatatgtgggtccagtggtaaaatcttttatcaccactcataagattagcaaataattaattattccttgggtagatcttattttgcacatcttcgtgataaaacttatttcaaaaatggatcccatggcatcccctagcctcccatgaaagccaagatcttgtttggcacggcttcggatctcatatccacgatagatttgaagtttatatattaaattacaatggtttaaaattttaaacttcatctgaaatgtgcgcaaaataatttatctaaatattatcaacataattgtagatcttttgtggagctagaaatacccagctctaagaaatcttggatccagaattgtcccaaagagagcctaagccacgccaatatcattagcgctgatgacctatttgtaaaaaaaaaatacttatttgtgataaaaaatatatttataaataggtcatcgatgtaagtgtcagtgacactgataaaagaacctatttgtaataaaagtattaacaaataggtcatcggtactaatgtccaacgatattggcaaagtccccctccatataagtgacttagcatccatggggaagccgggggattgcgccaatgtcattggcgttgtcatgttggaccacgacgccaatgatgttggtgctataaaaatgatctattgttggaataaatttttttagtttgtttgtaaaataagtttttaaagatctaaaatgtacggcctaagatttcccttctctctcgcttaattaaccaagtgttactttgaaccgccttgttcacttaaagccaactatattatacattatttacgatgacggctgacccacatgtcaatagtacttgggaagaaaaatataaggaactaagttagggatgttggcaacaacgggacatttaactccttgccacttttaagatgtggcaattaattatttgccactcgttgtctatgacatgtgggccctcatatgtctatgacatgtgggtccagtggcaaataatttagcaccattcgtaagagtggcaaatagttaattattcccaacaacaaactcaagccatcggcaaccactaacttaacattgtttaggaacagcgttaaaagtgatagctccccggagatggtccgctttatgattctcatgtcgccgaaccatgccaccatgctggatgtcagatccacgtcgatctgcgccagcttgacggcgttgttgggccgcaacaatgagatgcagtcgtcataccagtacagaagacataagacatgaagaattaaaatgcaaagccaccaagcattattatgcatgctggaattaaaggaaataactcaatattccatgtcaaagtgtcatatacttgagcatctccattgcgggactacaacacgtcaccacctcttactctgtcgtctccgtggaccatagagcggatgcgctgtgccaaaatgggggcgaattgggtaaaggcagaaggggaaagtgaaaaagagaggggtcgctacaggtggaaaagtgaaaaagagggagcttgaggtggacaatacatatggctacaggtaggtctcattgtattctaggtgatcgtctagaaatagacaatacattcgatattcgttgatatacttttgggctaattacttgtaggcatgaatcttggagtgatctaaacttttctaaacctaggtgtgcctgcacctaggtttagaaaagactttctcagctgcccatcctcgtaggcctcgagagaaccagtggatcttcatgctctaccccgatgacgacgatgaactggtcagcctctacagcttggtcatcctctctctcatagtctcatcgcttgcaaagtttcacgatgttcttctgggatgccatggccgacacgtactcctattgcgtcagctatggtggtagcaagtattgttgctcacaaattaagtgtgcataggttttactcctaggtcgatggttttagtttgttaagttgttaggaaggattatccattaaatctagggagtcatttatctagagaagtagttaatccccctttgagttataaagggggcactcgattgtattcttcggcaagcaagattaatccagtcaagttattcgcacgttattaagagcctctcactggccaggaagagccctgctttcggccatagggtgattgtgagcattgtcgctatcccctctgaaaccgtccactcgagcacttgttgcttcggcagccgctacaatatgatcttcaccgtgcgcgtatcacttttattcagacctaggcaacatctaaatagaaaacatacctactagattttgtaaaatgatatctggacaccacattcagaggccacatattaattcttgtagaatacaagaccatatctaatcctttatattgggttaaacataccataactgatgtcttacacaccgaaatttttagaagatgagtggaaacaaaaaggaataaagcagcaacatattgtcctgtcattcctcctgcatcctgagatactgagcaatatacctgacctctgcatcttccacatgtgcgttttgttgacctctacatggtgatacatgtgtaaacagagggcgatgacggaaccatagaggcagagtgaccatagcaagccatcaaagaggcattcggagggacatggaaacaacatggtagtgaatagcccctgccagacagcaaacatctgttagaaattttcgattagagaaccaacataattcactgaaatgtccaaatgtaaattcattttaatattccaatggttttaataccttagaatggtccatattattggattgaagccgtaacacaatggatctgaattacctatcctcattcatgtttttttgctcagagatccatctctctagttcatcacctagggcgaagacatgtttgccaacttgtttagtcagcctaagggtgttgccacaaatttggctctgcttggtgctaagatcaatatagagggcgtggtctcccaggcttgcttctagcctgatgcctttatacactccgcctagctccataagctcgaccgcttcgtcgttgctctgtcacaaatggtgttgcacccggatctagagaagatatgagagaaggagaaggagaaaaaacatgtgcagattgcactaaatctatcaaactcacaaattgatatatgaccatataaatgggtaaaaaaaatcacatcaaatacggagtactgcaagggaaacgagaaccaattaccatcatcctccatggccatgcggggtgcttgatgagcactccacgtttgccatcaccacctctcctgagaaggtccctaactaactcgatggtgctctccctctcgctgcggttgcgactaccttctcgacaaggctgaaccctgggcggaggacaacacagtccatctccctgttctcgacgggttgctaggtctagtcacaggtgtgatagaggccatgagttccatggtctcaccgtcgatatagtagacatgacaaagccaagattccaagcacaagtcggtgatgagacaggcacatggattgatggtgatttggtaggagaggttccgcgaggcaacacggcacgtggtgggggcgatggttagggtttgattgggtagggggcacgagcgaagctgttggcgggttgaggggccgatggcagggagaagccgatggtagggtgcggtggagggagagccaatgtaggggagatctcgacgacaggttgggaagggagagcagctggtagcactctgctgttttgtgggagcagaagaggaacacaaggatttacgcatgtcttttcacggtggtaagacatggggcactcaagagagatggggtggatcatgggatgaatctcagttgctggatctaagatcctgagaaggatgtcagtgtttgaagggagaatcaccatcattattacggtctttttagagcaaggtcgataagagagccaactgatagctgcactggcttgctacgtcatctatagtaagcactatagcaagtctattcaatagaggttctgtatcacaaatattatttttactattttcatgggatccactatcttctctcattctttctctttcttcctcccacctcttctctttcgttcttccttgtcttctttgccttcggtgggtgctagttcaaaagacggtgatgtcgccgacggttgcgtcacggtgtatgatgacgggggcggcaggacatgatggacaagtgcaacgatggtagtgtatggaggtgacaagagcagttgaagcggacgagaacaaggatgacggcgacgcggcaaacaagggcgatggcctgtggaacacaatggtgatgactaggggcggcccctcgtccttgagccaagagtgcagctcgtccggttatctctatcatagatatcatttattattatacctacttttataataataaagattgtttttattttagaacctgaaataagtggcaatatttgggtgactaccaaacgggatttctgcacgtgactgtgatgtttttttttcccgaaactgttgatcattgccagaatgtcaccgcgcgagataggtgtgagtgtgaccgtgtgcgggtctgacgagagtgaacgaatgatttcttccaccacctaacccccaccgtctctccccctcccccccaatctcacaaaccctagcccccatgtcatcgccgccgccgccgccgccgacggaaatggcggagggcgaggtcgagagccgcgactgggcggagatgccgtcggacgcgctcgcggcggtgttcgggaagctggacgtgaccgacctcctggtcggggccggggtggtgtgccgcgcgtggcgccggctcgcggcgatcgaccccacgctgtggcgccgcgtggatatgagccaccagggagacatcatggaggtcgacgaggcggtggccatggcgcgcgccgcggtggaccgagc

SEQ ID NO: 8169 - DNA, 8401 bp, Oryza sativa
aacaccttaggaaaccctctagtacaagaaagaaactctacataaccaatcgtaccaaatttggactccttccaaattcgactccatatcccatacgcacacaatacctccatcatatgccatatggaatctccatcaaccacatgcatcaactctagcataagtatcccgcatgatctctgaccaccacggacgtcgtcttatccccaagccgactcccggtccatcaccgcaaatactctcccgaggcatcaagtcacctacacatgaaaaaaacaaagaaaccatattccaagaccaagctatctccaacttgactcattagtagcaaacaacaatattacacacgtatagtatccatctagaagccataatcatgaaataaactcagatatccaaacaaacaacccgaaaccaaaaccgatatagtgtcggccggtcagaccacgggctggccggtccgacggcacgatcaccgccggtctgaccggcacacactgcccgatctgaccggtcacataaactaacaaacctgcgattcacctgtaaatccaatcatctccaaaaccacttcgtgaataaattccaaataacaaaaccaataatctccgatgccaattgttcatcccagaataataatcaaaaacacctttgattttacagatggcatgcctcttgtctcacggcacttgaggaagctagatttatctagtctagaattaaaggagtgtttccttaacttctcgagctgccctgcattgaaatggctatctttctctgatcattgctgctttgattctgtaaagaagatcgtgttccaatcaatagaatatctttgcttctacttctgccagttcagtgagtatcaccacactcacatttatgcaccaagcctcgttggactccatcttgaaggtttctagggcaggacaccttttctggaaagcatgccatcattagttgcagcaattgttacacctcaccagaattgtgatgatcgttgtagtaatacttactctggttattgtgaggatgaaaactgtcatggttgtcatggtatgctaggtgagactggcaatgatagtgccaatgtgtgctcctgggaggattatcaaaagctaagagtttgaagttggtagctggacctgaaatggtaagcctacgttaacatcttatctcctttatgttatttgctgcgccttatttctgttcccttaactatattcatcattttgacattttaacaatctctcttttttaatgcattgctactatcttgacattcaaattgttgtattcacataaaaaaatagttgatcttctcgcctgcactttagctagcgaattttcagaagtggtttaagatggtgccctttgttaagcaggttgaaaactttgatacccaatgaggggtgtgttgccctgattggtggcctctaccttgtattctcaaacaatgtccagttctaaataagctcactcttcgaaattccaaggtatacgtttttacaattgctgcactagtgcccaggcaaagttattgtacatgattggttgaaagggaaaatgtttcccccttttcagaaagcttaatgtatgatagaaacataatgcattggtgaaatcagctgcaatatctgaacacctcaaggtgggaaaatcgtctgtaaagaagctgatgatggggtttacaaaattgtgaagtgctttaggacatggaagttattatcaaaaggaggaatcagtcggcaaaacgttaactattgaacctcttcattctttcattttttttctaaaatttagatttttttaatctgggaatggaagaaagaaataactaaaacaaaaatacagatagggaaaggagattaaagatccaatgtattttgttttctactatgattcatgaaagtatacagaatttattttcctgttgaacttaataatataaacagatgacagtatgcggacttctaaaatggatgagagtagttctagacaataacacaacatgttgatttcggaatatctcttaattgtacatgttatatgacctcatacggctacttaatctttgaaaattaataattgctccttctctttaaaagatctttcggtacctgatatttggatgccatgtaaaatttattgtgctctacatattggcgcgcaaaatctatttcgagaggcatctcgatttagacttaacgagcgatgcagacaattacctgagaagtaccagtagcggtatagacatgcatgcaagtagtttttctattaggttgtgtgttttttttttcttcttatgaaattttctcttaaactactcatccgatctatgatccgattacaccgttgtgttcgtaataattaaatctttacaacaagatctcacatgattatattttgatgaaaaatcacaaattacttttatgatatgtctaaattacttttatatttcactaagttacttcttagacatataaaagtaaattcagtaaaacctaaaagtaatttacatatattatagaagtaacttagaacaaaaagaaggtaacttcggcatgccatttgaagtaaatccgttgtagagataaaaacatgactctatctaaaaattaaattaatcagcacaaattatagaattaactaaaaacaataataaaagtaatcacctcagagcattataaatgtataggaagtattttaatcaaatctaaaagtaacttatatatatatgataattatatatatgataatttgttcaatgaaaaaaagtattaattaaagttactttctttttctttttgttataagttacttctataatatatgtaaattacttttaagctttactgaatttacttttgtatgtctaagaagtaacttagtgaaatctaaaaataatttagacatatcataaaagtaatttgtgatttttcattaaaatataatcatgtgagatcttgttgtaaagatttaattattacgaacacaacagtgtaatcggatcgtagattggatgagtagtttaagagaaaattgtatttgaagtataggtggatggtatcttttatagatgaagtggtagctgatttagataaaccagctaccactagctgtgtagtcacgtagatattggcgcagtcttcaggttcggggaagggaatttgggttggagtcttgatgatataacttttagatgaagtaactgtttcgactgtctgtgcacttcggtaatgtgataggaacatactgtaactgcgttgtatatgtcacttttactaattggacacctttcataccatggtgtccttttatttgaaagcaactgcagctgagcattttcttctcttttgttatggaactagtatggtagttggtgtagattacgcagctagcattgctgtatatatatatttataatagcatatatactttcatgttttattattaaaataatactaaaaacaacaatatgattttaaactgctgcataacttgaccaatatgattttatatgtctgatatctatggtaagtcttatgtccatcaagcaacgtgatggatcctctagtactgtctagtactgccttagtaatacaatatacttataaaccatggtagctggatgattatcgttaaatgctatagaaaaggtcattcttcttccctccatcttataaagttttaaattattagtgccatcttttcactatctgtagtgatatccttgtacctactaaagatgatatattgtatcttatgttcataatattttataaaccgtttcagataagtaaatgaacactttttcatttcattgtcacgttagtttagggttggaggatccaatctcatctgttagttagttgtaattttatacaacttagacaatcaagccatttttgcttctcttattaacatgtgaattcaaagaattttcaattaaaatgaaaacttctatgtatttttaccttctagaattaatgtgtcactcctagtaaatcctccaattaatataaataaaaatatagactctactcccaatattatttattattttcctagatttaaaatatttctaagttgtcctcatacatgaactcttttccttaatattacttgtttcaaatatgaattagatgaacttatttctccactttatttattagagtgaatttattttataattccaattttagatatttccaaattgtatttctatgtggactcttttccttaatactatatatttttaaactaaacttcagatataaatttgtacttatacactgattcttgtctcagtatcaattattttttagtttttaatacaaattttgtattttccataaattgtatttctacatggactcttatgtcaatatttattattatttgatccgaagtttaaatttttctaaattgtgtttctgcttgatttggctttctcaatacacacaatctgaatgaattattccatctgcccctatcaccacaagcagcacttgagtggcaagatcctcattacattccttaaaacacaactataacaaatctccatgatcaatggattggaacagtgtatgctacgaaacaaaaaaggtttattccctctttttcgctcatttccctcttggaagagcaaatgcacaatgaaactcaaggtcttccattggatactcttgatggaccgttcaaacacgagaccttctgcaaagaaagaatctccactctaaataaggaactaattgggtaatatgcaactcttttcatacagaagatgtgctgcacttattctttaattgtcctttggcagttcaatgctgaaattacgtcggaatacagtgggctacaaactggaattcatgaacatggtggtaacagcaaagcaaaattttagacatccgttcttcattgaagtttttgctatcgcgttatggaacacatggaaaagaaggaatgacctgattttcaacaatatcacaccttctttcaatctttgtaaactactttttggggatgattttactcttcttttgtttagagtaaaggatcaagaccgtcaaacctggcaaacatagattggcaatttgtaattttgattccttcccctttcccctgtacagtctcttgtaattaacattctttaatctaatttacagtagaagcctctcctactgtttcctcataaaaaaaactgatatagttcaggtggttggttgggcctgttcaacgtggtgtagctttattcagtggaaatttactgttttaaactacaactgtttacaaccgcctttatgcaaatagtcacaaacctccttttgtctccccttgcatgaatgcattattggtgtggtttgtggtttgctgagtacgctggttatactcagccttgctataattcctctctttcaaaagtttagtgtttctgttctgaagatggtgttagaggatcaaggattatacccagttgagttctgcttgtggagtggagctaaagcctgctaggtgtcgtgccccgaaaatacttttcccgaacgctacacttcaacaaccatgatacaaaagacacatctttattatatggttgagttttgcagtaaaacaatattttaaatcacttagttgcccaaggtaaatttgtaaatctaaccataagagtaattaagattattaattaaggccgtgaacccacacgaacctgccttaacccaagggcctacgatgagttagaccgaactggcagccttatagccaggccccagctcgtcccaagtcaacctaggccaaccattccaggtttttagttgattaaccaagttttaagagggaaaccactaacttgggtacattgctagccttggccatagccgagggcgcaactatttgaatagattatactctgattagatgtgtacatcttttacacagaagaaacacctttactctgcattctattgcaattggaacccatcataaaaacgtggcataacccttcacccatcctagttgtgaacaaaagtaccgacgcaactccgcctacggccggtatcccgggacaggtaggttagggttgagccccacaacatcagaacatccctcaggagtggccaccgagatgcccgtcctatgccacgacaccttgattatcgaaatactcgcccgataaccttcatttgtctcagagatatccatcacccgactttagccatctctattcgtgtccttttgttcatgactagactgagcaccgagttaagccttacccattttagacatgtggttagtatgatagtgctttgcaacagaggctcgagcttaatccttatagcacccaaggtacggctatcaaaaccaagccacgcacctcgagcccagcctaaaccattttgggagttttgaaaggggaagagtgtgtccagagcttgtcattaaacctcagtccaatgtatccaatgatgtttgtgaaacaactcccaaagtctaatgctgtaaaacatctaagggtttctaattaagcagggctaaacaaaagtctagcaagtactagtgagtgccgatctatagagttctcactagtagggttttatttacctaggattgtcaaagtgataatcttaacaataacgagtaataaggtcataacaaggaataataggcatggataagtaaaacaattatttgtaagaatttaataaagaaaaatgcaataatttaaatcaaaataattttataaactgggaatcaatatgctcaaagatgatacgacttgccttgcttagagggaacggtcttccgaacacgaaccgcgcttcggaacctctagaatgacaggagctacgtgaagcacccaagcaaagctaaaccctataaagaagcaataataatacataaaaataaaagcacagggttctttagattatagcaaaaattaagagacttgaacggattgattcggagttcgtatgaccaagatatgatcatccgaagtttaatgctgttatatggagcttaattaagttttgtaactataaaacatgtgtaactccagcccggaaaagaaaggaaggttgcgctattgacctgtggaccccacatgtcaatctaaaggaacacggtggactgagtacacagagacggtccacgggccaacggaagcggaccctgtgtgtcaaccgaagcgagtggtcgataaacagaacccactagacaccacacgggctgcacacgtggacaacacgtggctaccgagcgggcacacaaacacggtcatcacacgtgcatgcgaaggctgtgcgaatgattgccgataatggtacccaggtatcgatttggagttcgtatgaccaagatatgatcatccaaagtttaatgctattatatggagatttacgggctattgtaattaagttttgtgactataaaacatgtgtaactctagtccagaaaagaaaggaaaggttgcactgttgacctatggaccccacatatcaacctaaaggaccatggtggactgattacacagagacggtccattggccgacgaaagcggaccacgtgtcaaccgaagcgagtagccgataaacggaccccactagacactatgcgggctgcacacgtgaacaccacgcagctatcgagcgggcacacggacacggtcaccacacatgcacgcgaagcttgtgcaaacgattgctgatactggtaccccagtaccgggaccgacaactgcatgacgggcacgggggtgacaccgaggggatgaggacgggtgagtgaaggagggatcctcaccacaattggaagaggcgtagaacgaggacgacgaacgggcacagcggatgcggctcagggtagactgacgacgatgaggagacgactctgggcggcgaccctaggacgaaggtgagacgagaccggcacaacgcggagccaaggacgaagacgacaacggggctgcagcacccttgacggaacgaggacgacgaacgggatttgcttgacggagggatgccacgacgataaggacgacaaccgggaatgacttggaggaggacaatgttagccgtaggcgaggccaaggtggaatgtgttgcggcgatgctgacgatgatggcggcacagcggggggacgagccggtgagaagaaacggccggccgatgggacgtgggcgaggacgaacgttgacgacgacaatggctagcaagattcgtcccatgtggaggcgaggttggggatggccttgccactgcgatgataggggtggtgatggtgtggtcgatcggcacacgggcaaggaggaagggccgatcgaagaagctcaagtgaggaggatggaccaggcacgtggcggtctctgggccaaaccgacggcagggtctggggagaggaaag

SEQ ID NO: 8170 - DNA, 249 bp, Oryza sativa
ccctgcgcatagtcttaccaaaatctacaaccaaagcgtgagtcgaacaaccaaagatgatatcatccacataaatctgaacgaaaagttgattatcaccatgcttaagaacaaaaaacgttgtgtcaacctttcccattgtaaaacctttcgcaagcaaaaagttcttaagcctatcataccatgccctaagagcttgtttcaaaccatataaagctttagacgatttaaaaacatggtcgggaaaat

SEQ ID NO: 8171 - DNA, 1005 bp, Oryza sativa
ggccgccccccgcgcagatccggcggcagcggccctccgccgcacagatccggcggcggcgacgggagcgggcggtggatccggccacggcaacggcgacgacgacgggaaggaggcgacgggtagggttagggtttcgttttttcaatttcgttttttttttcgattttttgtttttgcatgtgggcgacataagcacccgcacgcgaaaatcggattttcgcgtgcggttgcgccacccgcacgcaaaaatagcgattttcgcagacaaattgctctagacgggccgaagctctgcacgcgaaaatctaaatcgaccgcacgggaaaacgatatgtgtagtagtgtaattatgaaacttacatatataattttcgaacttacatatatatagtgatttatattgtaaatacactaaaattacatatataatttagggatttacaatataaatatacatgctgactatttttcaaatatacatgctgactatttttcatgaaaaatatgatgacacatttatagcaaatccgtataaggttgcgttcgagagagcatgttcggaacgcttgcctcttgcacaaaaaacggagcgatccattagcacgtgattaatcaagtattagttgaattttttttttcaaaaatggaacaatatgatttttttaaataactttcgtataaatttttttttgaaaaaacacactgaaatagcagtttgaaaaacgtgcgtgcggaaatcgagaaggagaggttgggaacctggacaaacgaactgagcctaagtatctatgttggaaaaaaaatccagttccttaattaacagaaaaaaatattatacccttgtcgagcacggcgcgcactggtggagaaatgctttctagtcccggttcataacccccctgtagtcccggttttccaaccgagactacgaatccgggactaaagatcgctatcattagtcccggttcaaataaccgggacaaaaaatcaatctttagtccc

SEQ ID NO: 8172 - DNA, 29156 bp, Oryza sativa
atcaaaaaatacccttaagtttttaaaccgggactaaagatgctttttagtcccggattttattggaaccgggactattgtggaattggaccgaccgaccaaagatggtttctccaccagtggcgggtgaccacccaggcagggttgcctacttgcgtgcggagctgctggtgcctgcttccttgtcatcgaaaaggaatactccaagtgttccgaatcttttcaccttgttgaggacgttccaagtgttccgacgttgtgcttagaattgtcatcactgacgtcagcaatatattcaagagtttcgatatatccaagcttatggagcatgttgtgtagttacacacgtgctacgtactacatgcatgcatgtatccgatattagtatatctgaacatttttttctatttatggccacagagaaaaaccacatcataaaacatatcgttcagaacaatcgcatcgagaatacatgtatgtacacttgtagacaaattgtcttaattttgaaaataatacattttctcgatcggtgcatagtttcgtgctttcgatatagaaatggagatggctcaaaaaataataactaattgtgaagacgacttgttcgttcaaaaaataaaattgtgagatgacccgcgttgaatttctatgatattcatccattttaaatttctctgactatttatatttcataggaaaatgtgtacacacagtagctaggtatagaccataataattaatattacacatgatttgaattctctgggtccatccggaaacggaaagctttcttttccaacaaggattcgtgctggtaattaactcatcgttcgtaaggaatgcaacactgtcattcctatgggcgcaatgttcccgaccggaataacacagtaattcttgacagttgaaatacgagaaattcgataatatctacatgcatctctcaatcaactaagtgtacgttgatgtacgctacctgtatatatgaagaccacttctatagttaatatagcatcagataaacattttttacttaacacataaaataaacatttatatatgcagtccataatccatttacacaggtattttttccaagctgccctataaaagtgcccgtatataaatcaaggatttgtgcgggcggattccacaaccgctgactcccttaaggaactggccataaaaataaattttcagtttaattttgtaggcgcaaaaagaatcctaaaaaatattttatattttagtagacatgtagtggaaatgttcatttgacgaggtaaataatctgaaaagaaactaatccttagctggtgagaaaatcttagtggaaatgttcatgagattatctggcatagcttcaactactgtgctgtgaggaaacaaaagtatagacactactgtgaattcgtgatcacaattcacaataaggttagggtccttccactttccaattcccagttgccaacttgttggcaaattacacagacagagcgaagcacggaaagatgcaacttgccctctaactacacaacgtctgtctccacctatatataaacccttccatctctcccccacacatgcatagcagtgctagagagagaaacaaattaaccaagaaatcctcttaagaaggatactgacagtgcacgccagctagctaatcactccaccagtttcggggaaaaaatatcaaggatttcgagatcctagctcgctagcaggtgatcgatcgatcgatcaatggccctggtgcagtcggcgcggcgtgccgcggggccggcggcgagccggctcttctcgacagcgtcggtggcggcggccgggcgctcccccgtggctggcctgccgaaggcgctgccgcggccggccatatcgtcgctgtggatggtcggcgccgccgctccgccccgccgctttgccggcacggcggcggtgggcggtgtcgacgtgaccgcgccgacggcgacgccaccgccggcgaaaaagaggaatcggagaaggaggcggcgagctactggggcgtggcgccgaggaggctcgtcaaggaagacggcacggtgtggaagtggtcctgcttccgggtacgcatgcactggcacagcacgttgattaattaattaatcagttaacaaagctccgttaatcaccgtcgttaaagctcgctggttaactcactctactgttgaacagccgtgggacacgtacgaagctgacgtggcgatcgatctgacgaaacaccacaacccggcgacgctcggtgacaaggttgccaggtggacggtcaaatcgttgcgctggccggttgacctcttcttccaggtaacccttcgctttcctcatttctgtatcgtttctgaaatgaaatgatgtagtacaatctaatacaaatcacatgcaattcctgaatctttaactatgctgctgcctactctacatgcttgcgagtcgtctacatatgcttggaattttttttcttagcatagagatcattgatttgtttaactgaaaaattaatcaaggatcattttcgaatcggcgaactttacagccgaagatctggaccgtccagtgaattcagttcagctggatgagttcggaccatacggctgagcagcttcgaaagaattgaatttgaatgaactctcatacactcgatcttcggaacagtgatctccgggcccattgatccactacaagcccaagctcaaatacggtcctgttggacttgggccgaaccgtgaataccggtgaactcttttgggtaatcctgttgttgggttctatgggccctggcacgaaacaatggccgggccgggccgggcttggtagtcttggactgggcttcgggttccatttgatatttttcaacctgcaagaaagaacatgcttgactgactgacagacaggtaaccatactctgttttcccctgttctttcgagctagtactaactgctatcgtcatgacccgggtgagattgtaaatggaacgaacgattactctaatgagattttatcgtgacgaagcgattaattcgtatcgagagttgataattgatcagattgctaatcaactagtagcagcaatgatgaatgaattctgatggtcaatttggttcgcagaggaagtacgggtgcccggcgatgatgctggagaccgtggccgcagctgccgggaatgtggccggcgcggtgctgcatctgcgttcgctgcggcggttccagcacagcggcgggtggatccgggcgctgctggaggaggccgagaacgagcggatgcacctgatgacgttcatggaggtgtcgcagccgcggtggtacgagcgggcgctggtggtcgccgtccagggcgccttcttcaacgcctacctcgcctcctacctcctctcccctcgcttcgcccaccgcatcgtcggctacctcgaggaggaggccgtccactcctacaccgagttcctccgcgacctcgacgccggcaagatcgacgacgtccccgcccccgccatcgccatcgactactggcgcctccccgccgacgccaccctcagggacgtcgtcatggtcgtccgcgccgacgaggcccaccaccgcgacgtcaaccactacgcctccgtacgcttccctcactccctcaccttgtgttggacgatgcatcatgtctcgcaatttcgaagcaaaacaaaaaggagaagaaatttgaacgaattttgctaactttgtccatggctgtggatgtgcaggacatacattaccagggtcacgcgctgagggaggtggccgcgccgctcggctaccactgatcggacggacggacacgatctatcgccattaagggatcaataaatatccggagacaataattgtagtattatttggacgcatgcaatgatcgttgcagttcctctcaacacttttgtgatatttcagaattcagaattttttactccttgtgctgtgttcgttgtggttgtatatacagctggtttgttagtttactgtggtgtcggtctcaattaagggatgtgaaaattgattggaactgtgaaccaatttattttacatatatgatactatatgtcttcttgttggtttcgttagcactgatgcaattgcagtctggtcgtttttcggaatttcttcccgcttatggtggtatccgtgtataatggatatttagggtgtgtttgaggagaagggattggggagattgggaagatacgcaaaacgaggtgagccattagcacatgattaattgagtattaactattttaaacttcaaaaatggattaatatgattttttaaagcaacttttctatagaaattttttttaaaaaaacgcactgttcagtagtttgggaagcgtgcgcgcggaaaacgagatgattttctctctcaattccccagattgcccaggaacgaacgaagccttagaaattttagaaattgggatttgagatacagatgatgccttctatgaacggcatattttttttcaaatcaaaacaaatggatgaggtattttcggcgcgtcccacttcagcatcagcgtccagtagttcatgcatgggcgccagaacgcgatgttgggcttgccagacactatggcggcggcgcaatacgggtttctgttttattcttttacaacattatacagctctacaatgtactgctgccccacatttctcaacacttgtacagttcactgatttgaaagattcagaacaggaatgttccatcttctttttttttttcgaataaggaatgttccatcttttttttttcgaacaagaaggaatgttccatacttccatctacatttccatggtatatcagtacaccctgtcactgcttctgatggtataaacaggaatttgagatgcaaataatggcttatgctgtcatgcaacagatgaacgaaaatttttgtctccagaaatggatgacatatactgaaactatctaagaatagtttaaagaccgatgggaacaatgagaagcataacatggacatattcagacggttttaggtagcctgacaagagaggcgtccggtccaacaaggttcaggtttacacaagttaataagagataccaactttaataagagaaatcaacttcttcctgggcacggtagcacgtcgtcgatgttagacaatctcaatgtttcatcactcaatggtcattcatgtctcaaattagacatttctaacctgacacttatgactcacactatgagttgaaagctccaaatttttcacacagaaaatgtcagtataaagcatccgaattcagaaggaccatgacatccacagtttatacctaacaaactgttcaaaacaaatccatcgttgtccagaacaacctgaactgctgatttatgtttcattttagcactgcaaatacgaaccagcttcacatttctagttcataaaaacattggaaacaatctttgagaaaagaagaaaaatcagaatgaacatggaagtcttaagttattaatcagctgtcagaagtgagctagaaaacttacagggtgcatcattcagtaactaagctacgcagagatcagacgttctcaaagaatgttaaaatgattaacgtcacaacaaaggaatcaagcattgaaacagaggcatcatgcatcaatagaagaaatagtaacagaggtcacaaactcagtaatcagcacgattgccatgggtcaggaaaacttttaccaaaacctcctaaccgcgagtctgaaatattgccagagataagcatcagtaccaaaattttcattcatgtcatgatgtagtaacaatgattcatgtctcatttcaccagagtactgaaaaatctgcacaatattgctgtgtcataagaacatgtgaaacagtcgtgcagaaatgatgaaagaatcaacatgaaaatagcagtattaagttactaatcaattttcagaagtgaactaggaaattgtagcaaggcatcattcagtaattagaaaaatgcagagatcaaagtttctcacagtagaatgataaaatgatttaacagcacagctgaggcatcaggcatcatatcaatggaagaaacagcaagacagatcacaaccttactgcatcatcactcatcagtatctaatcattcatgtctcaaacctcactcaaaacacattgcaaatttttgaaggattaccagatctgaattaccagaataccgaaccaacctgcacaaaattctacccatcctgatgttcctgcagtctcagctgttccccttgtttgattagttgctccataaaccacttacgactaagggcctcgtatgggggcagatagaaccaagtccacggcgaggagtctgatggcggctctcgcggcaggcagcggactatgccctgctcgcagcatctgccggtgtcgccgcaggggaacgggccctcaacctgctgcacctgcgaggtcgagctccctgcgccgttgaacctcgcggagtcatccaggaagtagatgttgggagggcactggctagatttcctcatctcgacggcgcaggagcagcctcgcacgaggaagatcgtccggtctgcgagggtgtccaaggtgagtttcttccaggacggtggcttcagctccagcttgaagacgtcgaacgccaccgtggccttctccgtggagacgaacctgacgaccatgagcagctgcccgcgggattccacgaggtagcggccgagcacctcccctggccctggcatggtgggtcggggatttcggcggagctggtacttgttcacggatgacatcgtgagctcgccgtgcctgtcgttggccttgggggtgtacaccaggaggtcctccttgttgttgagaacatagaatcccccaccgagcgggccgaagaagatgtagttggcgtcctcgattgggtccttggatagctgcttctgccacattttgaaccccgagtcccacttcagcatcggcggcacccaatcgctcatgccggggcgccagaacatgatattgggcttgccggaaactatggcggcggcgtagtacggatgagcctgacatggggtataggagaggatgacggcttggatgtggttgatgaaggtggtatcagggttgttgttgcggagggatctcgggaggaggacgcgctcgccggtgcagaggttgagcagagcgggggcacgattccccgggacagagcggtcatcatgcggaatctcggcggcggcgacccaaccttcaaggtgggcgccgcagaagcgcgcgccgcgggcgttgtccggcaggcagggcccctggtgggtgcgctcgcaggcgacgcagaagaaggaggtcgcgttggtggacggcatgaacaaccacggttgcataggcggcagatgccgcatggcgatggtgcgccaccttgtgcagacaccggagaacatggagtggtcagggaggcaaaggaggtggtggaggatgccggcgacgcactcttcggggagctccgcccacgccatgtttgcgtcggccatgggagggggaggaggaggaggaggatgagtttctggaaacttttggatgggattgggaatggtgggaagaagaagaagagggcaagtgggaagattcgttgggaagggaattgctgtgattttataggctcctcgtctgaagccacgcgaatgctaatcattttcttcttgcttgccaagttttcctattgttctgcatttccattgttctacactgatctccaagcattactctgttacggtatctgcttgttctgcattaatttcagtttattgtagaagattatctttgtttatactatagtgctttctatattcaaagtaaaaaaaattcttctgttctgatctttcacaaaatttacacagctctaagatgcgttgctgtgttacgaacccactccatgtgatttagtgaatttatgcacaagcaaacaattcttcctccaacacttgatacatgagtatttggggatacaaatagaggaaatggaatcaagactgggaatcagctgtaggttgaagaagaagacatagatagagattggagaagagaagagaggtacagaggttgaagaagagagagcattagaaggaagaagtcaagttttatctgttctattctgtactgttttggctctgctccttttgtagtggctggagtggtcggcttagcgcagcggattgggcctagccagccctgagctcaatatgcataccaatccgacccaattacataacattctccccgccttgaaaatcagcttgtccccaagctgatgcaattgaagctcaagatcagtgcctccaggatcccagggtagctgcaagtgatcatcaagagctaatccgtaagcaccagctgatccataaaatgcaaccacaagagacgactccatgccaatagaagtgacaaaacttgcactctggtggatgcattgcacctccatttgtccagaattatagttagggatcttgatactagtcccaagctttctatatggaaggacaacaaatatggtcaatgatagagaaatgctagatactgtgcccacttggatactatcatgagcattcttgtacttgcaaactgagctgagatcaagagtatcactccctcccttcttcacttctgtagaaatttggcaagctattatagtaactaaattgacaatacctggatcccaagatcttattcttgtcatctcagcaatcttgacatgcacaagcttcactgccaattgcacagtcccagcatctaggaaatttatcagggcaaaagcagataatagccatgtcctcccaactgctacaacatggatccatttgcttggcatgacaggagtccctgtcacatcatacactatattttcagaaacactgcaatatacaatgctgatttgatgacagtatagcaacatcttatcaacaccatcaatttgttgctttatcattccttgaaaaggaaacccttggtaagctggagcatccaccatatattttctccattgataaggcttgctcaagaaataattagctgagaatttgaaccgacaccaactcataacttgttgaaccagtaaattttcattctcaaatcgagttagattgtagcttgaaactagctgtcccaatgactgcataggcagagcagtatcaatcatatctccaactaaaagatttgaaaaactgtaccaactggacttgacaacctcacacttcagttgctcttccagtaacatccgttcacccaacaattgtagaccttctatggtagccttggggaccgaatagactgttacgataatctgaatctttagtttctgaccatgtagattcagtttttccactttagctttaacttctgcttgaataggtggtggccagggctgtaagagcttcaccaccacgcctccgctgccttgattaaatatatctggccatggcaagaatcgaaaatccagtgggactgccagtctccagggaggtactacttgcggtctagctgtgaaatctgcccctgagacaaaatcatcgcagcagacctcacattcagaagagacaacaggaaggttggtgacaacaatgtgattgctccggcacaaagtcaaacacacatctgtaaatggtctgaacacaaaaatgagcttggtatccaccttggtaaacttgacacaattatcagtgaccataccaccgacatcaccatcaaccttttcctttttgctttttgtcaaacccttggttggtttcactgtcaccatactaagcttgttagtgttgacaagatgagttgagttagcctcattactgacctctgataagatgggtactggatcaatgttaacgcttagtgccgtggcatctccattgcaatccacactcacggtataatcctccttggtgttacggcatgtctccaacattttattgatcatggccatcatcttagtgttcaagtcctgagtggttttctctgatttcaacacctccttgtccatgccagccccaacatccttggtctcggtggaaggtgccggagtcgtcatggttgttgatgaagttgaggatgccaatgaagctttagtggctgggaacacgcgttctgttgcagctggtatgctcttggcccctgacgtggtggtggcataacttggtcccaacgtcgaacacttggtgggcatcacgttagcaccatttccagggaaagacgcgtgtgctggacatcaagcaggcaacacccatcgtaaatgttgcgttcattggtgtcagatcgagccctttatgcgtcatagcttgaccggaaccagactagcgcctcaatgccccaacaactcgtggcgagcacttgcaccgccactgctccatagccgttgtagacttgatgtagtacctcgctagtcatcgggtaaaggacttggctcacttggacacgaagaacagcgccagcaccagctcccagccagctcggcatttctccgaacacctggcaggcgcctccagtgaaaccacctccaatgcttggatctagcctctggacgtcactgctgccactgtgtgtcatccaccttgccttctggtatggaatcccacggattgttggctctgataccttattgttacgaacccactccatgtgatttagtgaatttttgcacaagcaaacaattcttcctccaatacttgatacataagtatttttttttttgcagggtgatacataagtatttggggatacaaatggaggaaatggaatcaagactgagaatcagcagtaggttggagaagaagacatagctagagattggagaagagaagagaggtacagaggttgaagaagagagagcattagaaggaagaagtcaagttttatctgttctgttctattctgttttcttccccatttgttggctctgctccttttgtagtggctggagtggtcggcttatcgcagcagattgggcctagccagccctgagctcaatatgcataccaatccgacccagttacatgacatgctgccccacattcctacttgttctgttctttcacaaaatttacacagctgtaagatgggttgctgccccacattcctactgatttggaagattcagaacagggaatgccccttcaatctaatacgtagttaatttctataggcagacatcactgtcacaattttcatttccattctgctgattcaagtaactaaactggtttcatttcccacttcagtgcaaaaattgaagaatatgatattcgttcctgggcaatgcatactgtacttatttcaatttcagctgagattaatgaactcacatactcctattgtaagtaaaaacttgccacagtattatccagagaatgccagctaaaattaatgtaactccgtagccttgtgattgaagtactgaaccattaactttcttcagttgcttaagtttagggatggcaggcaagaggcaactttcataagtcctatgtcattctgaacaaaacactgaaaatatacagcagttcagacaagcaactaaaagccagtcatcaacaattgatcaatcagtcaacctgtagcagtcttcagttgcaactcaatcaagggtcacacaagttaacgtgccagtagaattctaatctgcaatattacaggatatcaacttcttcctgttgatggcagcacgtcgtcaaattcaggcaactcagtgcttcatcatgcagcaacagccactcatttgaaaccagacatcgagtcacttacaacacattgtgaatttgcaaggtcaaagttaaaagaagtgttcaaaaatgccattcatggttaatacacatgtacactgacatgccaaatgtcagtttcaaacatccgaattcaaaaacataatgacatgtaacagttgtactacttgacaaactagggaaaacaaatgtaagaaactgaagttgccatggcccatggagaaccaaatccatcgatgttctgcacaaaactaaacagttgaattatattttgctttaccactgaaaattccaaccaggttcatacttcaatttcgtgagaacattcgaaataatctttcagaaaagagaggggggggggggggggatatcaacaagagagcagctgccataactcataagctcaatcagttgtcagaaatggaactaggaaaacttgcatcattcagtcattaaacaaatgcagagatcagaattcatgtagaacattaaaatgattaacatcaaaacagatgcatcaaaaatcaatggaagcaatggtaaaagaggccgcaacctcagtaataaacagttaaacaccatattcaggtcaggataactccgaactgcaagtctgaaatattgtcagagataaagtatcagtaccaaatacttcatttatctcatgagatagtaacaacgattcattaattcttcatttctcactcaaaacaaattgggaaatctaaaagcgttaccatccctgaattaacagattactgaacgtgtccacaaaattatatcctgatacaggtgcagctctgtgagttttctcatcacttggaatctttggatcagagctctgtgagttttctcatcacttggaatctttggatcagagaccatctatgcatgttctagccgatggaaaaaacccaagtccatcgccaggtgccaggtccccgcaccaagcaccatggaagctcgcggcggcgtcgcagaagtagatgtggagcgggcaggggttgcacaaatcgacggagaagtagcagcctcgtctgaggaagatcctccggccgctcaggggcgccgattgcgagcttcttctagtgaggcggctgctgcccgtcgccgtgctccagcctgaagcgcatcaaacgccgtctccctcgttgagacgaacctgatgaccatgagcacgaggttgcgggcgagcaccaggaagtacatgcatagcgggcaggggggacctcttcctgatgtcgtcgacggtgacgaagcagaatcggcggaggaagattctccggcctcacagcctctcgggagggcgacacactcgccggtgcataggtcgagcagcacggggccgcggccgcgcgactcggggagctccgcggcgagccaggcacccgggaaggagccgcagaatctcgcgcagcgcgcgtcgccgaggagcccggggcggtgggtgtcctcggagacgacgcagaacaatgaggtcgcggcggtggacggcatgagcagccatgggaggttacacggcgggtgctgctgctgctgctgctgcgcgatggatcgccacggtttgcaaacaccggagaacatggcgtgatcgaggatgcaagggaggtggcggaggatgctgatgaggccatgggagaaggagaagttttgagtctgcaaactttttggtggggatttgggggaaaaaaaaaagagtaccggagagattcgttcgggatacgagaaagcaaaaaaaaatgatatggttacacgttttttttcatgaaggtacaataacataacagagccagctgtaaatatattttaagaagataaataagaaggagaagcggggtacagatttatagccagcagtagtatgaactcccagacgcagtgtgaatgacaggtgggaccagatattaatagtatagtactccctccatctacttttgatagtcatagttcatcttgacacacagacaaaggataagtaattctacttatcatccatttaaacatggtactagtcattcctcgtaaccaagcgattcattaatatttacatttctcaatacctatgtagccaatcatgtgtggaaaaatggagagtcacgcaataaattcgagaaaatcattaagagaataggttgttggattgaaatatgcctatcaaaaataaaattttcaaatttagaaatatgactatcaaaattagatggagaaagtatataattattgtatgaatgagctactccctctattctataatgatcatttcgttgtggtatcgagaccaagaagaggcccactacctattttctatttaatccttgtaattaatctccatattaattggctttgagaaacgaaacggcattactgccgctgcatgattacacatgcaagggatgttccgtgctgcatgcagctcgaaaatcgcatggcctactcgatctccgtggtagtaactagttaggccctgtttagatcctctagttttgccattttatagtactttttgttattttggatctaaacactagtagtaaaagttgacaatttgtcatttagcatttgctagtatatagtagcaacttgtactaaaaagtgctttgggaccactccctctctctttctctctctcactttagtgctagaatgtcaaaactttaatatgcatctaaacaccaactaatacttttgcaatgccaaagcttttgccatttgccatttgctattccaaataaatctaaacaggcccttaatccatccaacatgcacatgctaccagtgttaatacgctgatcaaatcggaatatctctacttttgttatgcgctgattattatgaaatggagagagtattaaattggctatagttaaattagaaccagtagttgattatactattaaacttgctcttatgtagctggttttttttttttgaggggaaagatgcaggagaacagatatcttcagttaattagtggtatgcaatggtcagtgggagaagcggagtttcagtttctggtaatgtcgcagaacacctaagcattgctgctttttcttaattgggttggcataataattttcaagaaaatcattctcctgctggggatttatttttttttctggaaaatcattttcattggctgttggtataacacaagcaccagcaaaaattattttcactggctgccctcataaggcagccgctagcgaagacaattttcgctgcggctgtctttattcagctgccaatgaaaatatatttttgctggcgactgtcttaagacggccgccagcgaaaatatttcttcgcttatagttgataaccgctagcaaagatgttgatcttcactggcctttgctttgtggcggctctaaattctgccagcgaagacccaaaatggccgccacgaaagatggttttcgtagcagtcctattgcgtagttttgattgcctgtgctttgtgaaaagttgttgtggattgggaatcattaccagaatcagcctatgtggtagatggatgacttgcgtggtcagaaacggatgtgatccgagatgtatgcgggcatcatagactaggcttcccgagtggaaacagattgttgtgctgcggggcagcgggactcctggagtccgagaaaataaaaaaggctcagggagccgcttaatcaagtgaaatggctccgtgagccgagaagtaatgatccgacctaagaagtcggtgcattgccatttgagttgctgaaagcatctctcttaagtcgaatcgagatgcaagtctcttttcgacctaaacttaaagaataaaatcacttagtggtttcaaatcaagtatttgcaaaacaatcttgcctctctttcaagcttgcattaaacacctaagttcccgtgacttgctgagtacataagtactcacccttgctctctctctgtgtgtgtgtatatatatatatatatatatatatatatatatatatatatatatatatagttccttcaccctgaaaatgaagtgaagagaagattagggtttcgtcctggttcccagccgttgcctgtggtattgggtgttagtccattggttccgctgatgttgctgctgctgttgttgttggtgttgtttcgtccgtgtcgtaggttgcattctcgggctgtcctgagtaaataagtcctctatataatttaaggattgcaatgattcataattgtctgcatggttaccagcgctatgtccttggactggtactcagatcacggtctcgtaagaagcggttcgcgccgtttttcctacgacactattggtatttcttacgatcacagataagatccgcaagcgcacggatataccgatgtagcacttcccctacggagtattccaagagtatcgaatccaagggaacgtgtgtgattatctctttctccggttcattcaaggacacaaagctaatgtgggcagaggacagaggatttcctaatgagaaacagtgtctatggaaagcttaactttaatcctaacacaatacttcaggcactggcaacccgctgttcccagatgttgctctactatgtacccggacagggaggacttaagtgctcttgagggctgtcaccacctctacacccacctcaaacgtactgtgggatacgcagcaaccactggagattaattacccagacaccgcgtctacgcaattaataactacactagtgctgatcaaacaataaagcattcactataaataaatagactatagtgaacaatgatcccgtatgctaattaggaactaactaagaagtaattctcactaagcaaatcttaattattcagaatgatatttctattaaagcagagtaattaacaagatacaaaagtaagaggagattaccgacaactccgggatttctccgattccttctaccttactatatccctattataatatataataaagtacactagagcctcttgtaattcagctcatactttggtgtgtgtttacaagtgaggatgagaggggtatttataggtggagaagtgccttgggagtgtggagatgctcgaagcatccaaagagcatcttctctcttgtgttgccaagtgtccaagcttatgacggtttctaccggtgaaaacggccataaccatcattgggaggtggattgctaccgaactggacttgggctggggcgaacggcctctgccagggttcggccgaacccgggacggctctgttcgctccaattttcgtcctggacactcattttgggcccctcaattcattggtatgaatgtttggcccatttggaggtgtttaattgggtttatgggtccaaaactccttaagttcggatacgagtttgattctcatcctccttcatgtatatttcctctcaaccttagtagtttgtcacctgcatatgaatatacaccaacactcgtggaaattgttagaaataagccctaccactatgttggatgtttacaattatggtcttatgcagttattgacggcgttaatttggtacttaacagccgtcaataaacccccacacttagctctttactcgtcccgagtaaaggttaaggattaatgtggaataaaatttcccaagatataatacaagtatacaaattattctaagccatacctgtacgtgtgaacttttgaagtgtctaacttaccatcttggacaattgatgaatggaacggtcgtgactcaagtcctcctttatcctcctgtcaatctcttgggttttttatatatttttgcaaagtagctatactcctcgaataactctctcaaatcactcacgtggtttgatttgtggatcctcaccaaggcatggttgccgatttgtccctattctaaaaggctgtataggtggagctcggtagggatcaatcggggcatacctgcatcacatatattgcaaagccaaaataccggacccaaggagatagcaagtcatactctctgattaagaatgtgcatgtgtgtgatatgtgtatgggtatgtgtatagaaaattttgtggatggaaaaaggaaaataaaagataacaactcctttgtatacctcctcctccaattttctctctttggaattttgagagtgcatggctatctcttttcttctctttttttttcatcatgccccgtactttgtatgagcaagattcaagggaaggctgttatgttgcaatcggttttgttttcaagttttcaacaatctaattgtgtgcttttccacaaccaacagggtaaaatgtaaacaaattgattttcaagtttgcacaacttctagagttggcctcaaagttggttttcccaaaaccaaaccaaatttccaatcttttggagtttagttgtccaaaataaccattcacttctagggactccctatcatgttgtctccctgatagccacttgcttttccaaacatcaggtttcccaaaacacaacaccttttcacaaagcaaggtaaaacgaaaactacgctaaggaatcacctcatatccacccatgatcgtgggcacggctatttgaccagtttgttaacctctgcagagggggtacactttacctacacgatgtcactaacctaggtcacctagcccatgcagaataaccacgtctggtgactttgaggctttcacgacaaggcatttccaaagccgactcagggtcaccttatgccaacgggaggggtccaacgaaccaacaacattttagtttccagaccatgttgtgccggaagccaaggggacctccacaacaccaccctggcgaatccacttgtcccttggcatcaaagcttccctggcctagttagttactcagcctggggtgtcccacttcacctatgcggtcgcacttgttatatgcttagatgtaatcccaaaggaatcggtccttaaaagcgtgatcacttacccctacttggactatggttttaataatcatattatgatcgtgaatataatggcccattgtttaaaccgctgccttcctagtggtatccgtgcatttgcatatttatctatgatcgtaacaaataccaacaatattagcttgtcgttttgtgtaccttggcttgattcatgggaagggatttaaattttaatacataaaatagtttgaaaattggctaatttttgggcgtaacaattttctctaaagatgtgttttacgttacactttcctaaccttacatcttcgttttccacgcacatgcttcccgaagggctagacagtgtttttttaaaaaaatatgtacaaaagttgcttaaaaaatcatattaatctagtttccaaaatattttagctaataattaattagttatgtgctaatctgccactctattatgcgtgataggggttccaaaccttcacaaaggaacacaacctaaattgtgatactaactgtattaaagtttgtaactagacatgcagaaactgtactctctacactgaatgacctattgcaatcaaacaaacctacaatttatccgataaacctatacaattcatccttagtattgtagttaatattaatttactgcattgaagttgagacaatcagatcaaattaggagagccattagatcaaatcgcaatggcttgatgtgcatccctctctattcttctatccaactctacatccaaattgtcacattcgttggcttccacgaccatcaaagctacgagagtaatgcttttaatctggtaaaattaattactatgtggtgactgttaccattcccattatctagtttatatgtatgagaaaggtgcagtgatgtagttatatcatgagattgggctataagctaacagtgtggctggtcatttgtgcagatgagatgaaagggcaacttcatctgaatgtagacattgtcttctctaacatgcctacggtgaatttgccatcaaaactggatcatatttcctcaaagcagatccttccatgaagcaggtggtcccagttcaccaaataattacaaaatgtgatgcatatttttgtgctgatcaataaaacaacaaaatttagatatcaaaatctgcaacaatgtaatgatggtatgcttactatattaaatgtttgtgaagcaacttgtacatcccattggtagcatatagtacatccgtagctctaggaggctttgatggaaaaaagaccatatctgtctgtgctatgccattgctttctaacgtttctgaaagttgagaaattttatggaatagccaaagatgagaacaaaggcggccataaagccaaaatgggcaagtataacatatcctaggaagtcatgtcggacgccaacattatcttccaaaatttggctcattgctacatggctcccaccaggaactgaaatcgatccaccgttccctccaaactgtgatgcaatgacaccatatattgtccaggatactgggtttgcccaatagtaccacctccaccaaattggtattgcctgtaacacatacaccaagttgatgaaggaacctagatacactaaatagtaaataagtaaaataacaacgaaaaagaaaactttgcttgctttaccttcctaaaaataaggaacccagcaaacaagttccaaagagggagtgcaaaggttatgagaatgttcgcaagcagtgcagatggggtgcatgccaccaacatcattccgaaaaatgtgaagtagttgaagcttgaaacaatgaagaatagaaaataaaagaatttgctagctttccaatcgtatccgatcattgcatagatgatgaccgtgtacaaaatcccttgtatgatattgtaaatgaactccacgcttgcctgcgtagatcaaccatataaaatcaaccaccacaccaaaaataatggttgattctgctgcaactctttcttgagtttgtgtgattcccagcattttgcattctattaagaggaaaaagtaaaacgttcacagtcttgagaatggatggatttagtgacaacttagaaatgatacaattgtttctctgcattctaaaagttaacaacttttccaagagaatgtgaaatagattgttgtcctcaaatttaagagaactattgtttactagattagaatggtatgtcatcaacctaagattaaaaaaagaaactagaataagtacacaagtgactactctttgctaatactattttaaacttacgtttgtgctcttatatttgcaagcatatctagttctctaatcaccttttattttaatagtttttcaatatcttggagtgccacagcattgatgtccctttttatttggaatgttttgaatataaacaaaattgtcagatttcattcaaaatggctgataaatataaacaagcatgcgatgttacctgagcaaatgcataggacaatggagagtacattcctgctgcgctttcacgatagtaaactgctctctcaattgatacaacaggctgaactgacatgcagttagtagccccaatgaagaagattgcagcataagtggctccgagtaaattgtacaaatcttgctgtgagtctctgtgcattacatatataaaacacactttagcccaccgaagactataatatggtatcaaactatatttccaagtagagaacttacaactttgttcctttttgccaaaatactgtgccaaagaaaaggccatagagaaacgttgttagataacgcaagctattgtaagatggattcttccaataagacttatattgcttccataagttcgcaacacattggatatagaaactttgagaatattttgtagcaaataagagatctcgatagcctggtgggggaatgctcaactcctcaataagttcttggtttttcctggcatatttaggaaaggtgaatttagtatgagtcgtacaaatgaccgcttcaattttttagaactcataatcatttttatgtaaacaaaaaccaataatacaaaatattgtcaaacaaagtttcaacaattgagaatgcttacctataaagcagggaattggcataaatttcagcaaaatctacgttcatgcgagcttcttctagagtggagctaacttctagcatccatgttgcaggattatatccttctgtaatacttggaacacctaaaattgtctgcacaacaaatgtatcttttgtgataaatataaaaatttgttgcaccttaatggagttgaaccatgtccatgtttattgactttcatagctaacatatcatactattaatcagagtgtgtattcaacttcagaaagaagcaaaacataactgaggtcaaaatattcaactagtttatgtgagtggtcaccaagttcaccagcataaataaccccgacctcctcttttcaaaaaccaaagcctggataaataaccaattgaaagttcaagccattgggggactcacaaactatgtatgaatagttcacatatccatgcataaattgcacaaacttaacatagtagccaaacatagagacaattgcatgtgtatgtgagagaaacctcatcaaaagactcaaaaatatcaatgcttggctgatggatcgtgcagaccacagtacgcccagtgttgacagtatttctcacagttcgcatgacaattgctgcagctctagcatcaagaccagaagtaggctcatccataaagatgattgaaggatttgctaccagctccacagcaattgttaatcgctttctttgttcagtcgataaaccgctaactccagggagaccaaccatagcattgcacaatacatcaagctctacaagggccatgacctcctccacaaacatctaaatttattaaaattgtttatttgatcagaaataaccatgttgggagttttaaatctgcatataaatgcatattaagtgaaaatgtggcttagaaaaaacctttcttgtattgctatcaacatctgagggaaggcgcaaccaagcagagtagagaatggattcatatacagtaacatttggtgaatggatatcagcttgttcacagtagccgctaatgcgagcaaacgtttcttgtttcttggagtaaccagaaagggttatgcttccttcaattgttccactagttttccttcctgctaagacatccatcaaagtggtctttccagctccactgacaccaactaatgcagttagaagacctggcctaaaagcaccactaatatcagagagcagttggagacgactttccatgagtccttgttgcttcatttcctaaatgacaaaagatagcacatgtaactatataactataactatatatatatatatatatatatatatatatatatatatatatatatatatatatatatatatatatatatatatatatatgtacttataaattgtcatacaagtcagaatttatttcaaacatgaaatatgaaatgggtaaggtatgcttactgagggcatgtccacataataatttagatggttgaaacaaagtgacaatggttggaaaggtaagacaaattgtgactgagttggcctatttccttctccgttagcacctgctgaaacaaacattgatatttactattgttggaagtttgttatcaacaacttggcatgttacatcattatgggaaaggtccaacaaacgtagtttggactgaaatttttttctgcataattgtattattttaatatagataaagatgatcttactcgtaggtatcgatgatgttgtggtggatgttcgggacctatgctcttcatttcttgtttccgtgtacaactcagtttcattgtgttcatcaataactagtgcgtttgcacttctaatagctaggagagccaatttttgaagtataagtgcccaactgaatagataaacaaagtaataaacatgatgaaaaaacagtggtgcttacgacttaagtatgtaagtgccaagatgtataaggtgttgaacaaaataatgaatcctactagggctccaatggatagccaaaatccccactctccagtgaacaagccttttgactttagaatagcctcacctaccgtttttgcatcaatggttgtgtcattgtttggctgtaataaaaaaaagctcatacattagttgaattgttgccatatttcagggtttgtggttacctcactatgtatttcatagatgtaaggaaaaattactgataaaaacttacaatggcccacctactggccagaaattcgttgatcgatattgcattttggctatacatcataggagatgcccaataacaccagatccaccatggtctaatgtcatctggccacattgcaatcaaataggaggttaatatcactcttgcaaattaaatgtaagtgcaattatgtgatttctcatgacaactgaaataaaaacagatgtaatatgctagatgtttacttacttttacgtatcacaaatcctccaaagacgaagacaataagcaacacaagcatcccaaaactaattgctataaccattgtttgcaagatagcaccaagaaatcgaaacagagccattgccattaggtgagtaacgaagaaagctagaaactgacgaaagaacctaaaattaatcaatagataacttttgtaagattctgcaatgattcatagcactaaaagtcaaaataaatatgtcaggtatgtcgacggatttttagtaccttcctgctgctggtgcaaatcccatcacatagtacgtgatgacaacccagaccgtagcctccacaagagatacaggaacctttattagtatatttgcaaccccaaaggtccatggagggaagaataaaaaatctctatgcttgtagaacacaggaagcttctttactgtcaagtttagctcagaaaggccattgaacatgactggtattaaaatgaatgtcaatgccccaagaaatttaatgccctcagaaaattgcccatggggcatctttgttctaaaaaacaccggcattgacaagaaagccagaatgatcaattgggtgaccctgaatatttaaaaaaaagaagtgcgtttcatcaacaacttctctctacaaagcacacccttcaatgactcccagggggataatgcatttttcattgttttggtgcagcactatggattttggatttttcaaatggaatatgttgctccttcatcatttggtggccaatataaaatgacttgaaacgttctgcaaactctgggactgacacataacaataaggctccttgtcaaggaaccaatattgttgctggtctttcttggaagtgacctcttgaaggaagtcagacactgctttcctttgagggcatcgaaagccagaagcttcaaaaaattcgatgtattctcgcgtggcccatgatagactatgtatccttctgatagtagaactatgtggtcaaagagattatatgtctctggcggtggttggaggagagagatcatcacagtttcattcattatatggaccaaatgcctaataaattttacaatatgaaatgtgctagagctatccaagccagtggatatctcatccatgagcaaagcccttgccggtcctgttaacatttcccctaccaccaagaaaagtaataattgtaaacgatatacattctatgactaatttttaatataactgtcaagtttctacctgttgtcacacgcttcatttgtccaccagaaattcctctaatcatctcatcaccaacaatagtatcagcgcaaatgtccagcccaagcacctaacaatgttcaatgatcatttcttgttatttcacccctaatagattacatgcaaaaacataacaataatatcaccttgagaataagatctgttatgatattagtctcttgtccttgcattgcagtagctttcatgaaagcatcgatctcagggtctggcttaatgcctgcattgcgttcccttctagagatttccgtgagcatgtcgtatcttgacccaatacctaagcaccacctagagaaatctaatgtctctcttacggtcatctctgcattatggagatcatattgactaacataggcacttgtccgctctggatagaactcggaaaatttatgtccacaataggtgatattaccaaatacctagattgtgatagaatgaataagcaggtagcagtaatgcatcataagcaatataaaatagtaatattccatgagatgactggatttgaatagaaccttgaggtttttatcaagtttcccagtgagcgctcgcataagtgtgctttttcctgatgatggaggtccaagaaggagagtcatcctgaaaataatactagtcagattaaccacttttttctacttatcatattatggcattaaaatttcttacaactaggtgattccccgcgctttgctgcggaaattactaagcaattctcaagaaaatatctactttcttgtatatacatatatttctattagtatatgtatgtaaaattgattgaatgatggttggaaatagtaaatatgatatgatatcttgattgtattattgtccaattgagtacctgattaaatatatagcatttagatggggtggtgattcatggcgttgtttaattggtgaggaagtggaggggacttttatctaatggctaatactagaaagacttgtcgatccaacggttgaaactattttgatgatgtggctaaatgtggtgcctgtttgtggtctcacttatatagaaagcatagataagaagattggtttctatctgaaatgtttcgcaatctcctctatacccctgaattttgcctcatcccctacatgcccttgagcttttatgttgatctcttctatccttattccgttagttgaccatgagttgactgttaaatttttctaaaatgaccatattgcccattttccattgctacagttacatgctatctactctacttcataattcacaatatgaaaaattgtaactcatgataaaatcaaatgggacataattatttatttaaaagaaaatttaaacttttgaacaaatttattttttttggacaaaatccatataagagttttagctagaaattgtgaaccaaaattatttatttgttgggttcaaattttgatgaacacaatgtacgaatatcatgaaatttaatttataatttatttaaaaaattttgatttatttttaaaattgttgtcaaataattatattccctttgtttatttacaaatagattttttttcatataagaattgtgtttttatcattaaactagcacataagtataaaaaaaggggaatataatcaatttcaaaaatatttaatgggtaaactaccggcaactaacggaatgggcatagaaaaaaatcaaataaaaactcaagggtatataagggaataggcaaaattcaaaagtacataaaggattggatgaattctcaaaggtacataagggattttctcatatgcttattatactatacagggcccatggtggtggcaaaatgtagccaccaccctaaatctataaacaaatatattgaggtggtaaatcgatcttgcaactgtaggtggacctcaacttttaatttgtaaatgggccaccctcaactatggatagaccctcacaacacattgtaattacacacaagtataataaaaccttaaatctgcactcctatttccctgccatgacaattcatcccttattctccggtgcactgctcccctctcccctcccctacacacacgcctctcacctcatccttctaccccaccacctaatccctagccacaaaagaaggtcccatccatggagcacactaatagttctcgaggatctagcttgtctattgtggtggtggctccagaagatcttgaacggctgcggtcatccatccctccagatcagctagcggaactgtcgatagcagccaacaactatcttttatcgagcagattgcacatttttctagattttattattgttatgcacaaaacacattggactaggtattagcacatatttttttacttttgactaggcattgttactaaagctttcactttgtactatttgtccacaagtaatccagtaaatcttcccctccccccatctcaagctcaatcaatggttgcatcagtgtcctattccgcctcaaccacggtcaattgaaaggcaatccttgaacctttctacgatggtgccttggcctcttcctcctccccatccccaaatcatggtttacttcaaaccactccttctttttttttagttttttgtgttaccaaatgtaaatgctgcaaaatttaggtgctaaatgcctgtagaccccgtatgtaaattctatatttctagttgcaaatactataagctgaatggtttgtgaatgcaagagtaagataagcatatgtcactacttttggaaatgattcacggtcatgatttcttcatgtatgggcattttatttattaacaactatgaggaaactaatgattttacaacttcaggggaggtatttatagtcacaatgggaattcatagctcgtgactataaacaggtagtggtttaggatttcagaagaaatggggtgctggtaccgccctcgggcttcaaatagcggtaccaataaacaggtagttgtattgccagaatgctaggcatattagaacaattattagtcattatcttagggaagaaaaattggttatgcttaggattccctggcatgaaaactaatcagttacatttttctggtattaacactaatcaccagcccagaagaggaaagaacaaaaaggaaaggaccatgttgctgcgagcaagtgtttatatgaagaaaagaatgggaaattcgtttaataccacaaaatatggacattttagttttactgcagcgaaatttggtagtacatgttgatattcaaattttcttcgatttccattctcaaattttcttgggtttccatttcaccactattgttcttttcttcctgtgcttaaggattttcatttattttcatttggtgaaataccaaattttcccctacagaaatttgttcatctctaatttctcaacatgtggcctttggaagaagaggcccagaaatcactcaccacattccatctcaacgtcggatcttggatctcgatcatcagctggtttgcgaggtgagcaccctttgttgtccagctcaactctatcaaccctctccactggccattaattggtccatatcttcctcagctccttaattgccttcactgaatgttgaccatgccacaacaggtatggcgtgaacaaggcagttgaaatcaactgtgcagaggtgtccggttaggcattgagtcgagcatgtggaacacggcggtgtgcagaggtattccagtgttggaaataggacac

SEQ ID NO: 8173 - DNA, 3813 bp, Oryza sativa
ttccatttacaaaggctaataatagttattgagccattggtaaccgtagtaatgatgtttatctatcctctcttctccctcctgtatatcagtaaatattcctaataaacaaggctaagaacccattactaatgtccacactgtacatgcacaacccatcccaatgaatttcatttagaaaattcaatccctatgcatcaatttatctattatattattaaatcagccttaaaagaagacatcatgtttgctatggaggctagaaattcctacattaatcgaagaaaagaagaaatatctaaaccattagattttaatgcattagattaaagggtgtagatttatcagaaaaaaagttctccaagtatgaaacaaactctacttaatacaaataggagagtcagtcttatctctcacgttacgtcacgcgcaggcatgcatgtttgagtactgattgtatttgggctaggatattgtccgaatgggggaaagggaaaaaaatggataccacatggattccaaataggaaaaataaaatcaaacggacagctttgatatacagatgtggaatcggattttgaagtgaaaaaatatcaagaacatcccgagatcaggccatcgctaagttaagtagcatggtcacggtggttagcgagacttctaaaagtaaaaaatgtaaacccaatgctaatcatgtttgatttttaaaatctcaaaaaaaaaaaagaggggaaccagctggtaggccgtagaggaaaaataaacaccaatgatagtcatgttcagtttttaaaatcttaatgaaaataaagaggagatgcagcgggcagctctagaggagtacagtggcgaagccgctaacggtttaatgaaacttttaaaaagtaaaaaaataaacccaaccgataattatgtttgatttttaaaatcccaatcacaataaagagaggagacagcgggtgggcagtagataagtataatagcgaaaccgctgacggtttggcgggatttctagaatgtaaaaaaataaacccaaacggtaattatgcttgatttttaaaatcccattgacaatgaatagaggaggcagtgaatggaccctagaggagtatagtggcagtatatttggtagcacttttaaaaattataaaaacgaaacccaacaagagaatgaactctaaaaactacgatgtccaatttttaaaggttccaaggactatggatagaaatggtggtagatcaaaaaagcaaataaaggtgtgacaaagaagtaaggggtaacgactggcatgacttttaaaaatataaaattaaaaacacggtgatgataaggtttgatgtttcaaagtcctaagactacaaggcaactattaaacaaaatttaagtaaaattatatgtaagaaatagataattttatttaggtgctagccgcgtaattgcgcgggccacctagctagttctttctcaaaggaccatgcaactctctcgtctaaaggcttagttcagtagctcgtttagcttttgcaactcatttatctatagcacccgttctaaaccaaaaaaactttttatatataagtttattttttaaaaaataaataaaccaatttttaaatttattataattaatactcaattaattatattttagagactagccctattttgcatagcacaaacattccaaacaaaaaacccacgtttgaacggaccaaatagtttgtaatcaagaaccatttaaaatctttatgaaccattggaaatgaactagttctataatatatctctaaccattacaggctaagaaacattagtggcttcggttaaatgttatggcctagttctataatttgacttcgtttgattctatatataatatactatcgtattttgcataacttctctgttttaccatcgtcctacttctacgccatcgatatcgctcactgtgtagatttgctatattgaggaatgatattaattataaaatacacttaaaatttttgcgttctatcattagatgttaatggatcaatttattcattaactgttggtgatattttctctctataaaatagatcagagcaaatatatataatacttcctgtctatgtatattgacgttattttaggactgagttgggactgatctaaggtagtacgtgcctggagaaagttgatggcagagttggaaagggtgggtagggcgcggctggcgacgaaggcgtctgcctggacggagagctcctcgtaccgaatttcgatcttcggaagttcaatgccaaccctgcgtgtatgcagcagcaggaccatgtaaataaacgcgagaaattgaacaaagaaaataaagacttaactgggcttagttggactcaaacttttggcgagacataaaacaaagagaaccattatagaatgattaagtaagtactattgttaactataaacttaaaaagtaaatttatttaaattttaaaagaaatatctatatagaactttcttttcaagaatatatcgtttagctgtttgagaaaaatgtgttaaccgaaaacgaggtagcagttgagctgaaaagctaagtagaagacagcgtgacatgtggtacaacaacgtacgcaggggcggaatcaggcatggggcagctagggcttgagccacatgactagctccataatcccattataatcttgaaaaatactaatttatgaaaatatttgagatctcattagctcagtcctagacgtggaaattttctggctccgccactatacgtacgtacatgtctatgcggtcccttagccggcgcaagaaccgctcgctgtcgtcctgcaagaggcgttccacgagggcgcgggcggcgtcgccggtggcaagcctcccgatgtcgacgagctccaccgccttgccggtgcccgcgtcgtcgtcgtccttgtggtcgtcatcaccatcacgcaggagcgcgctgcggacgacgccgcgtcgcatccggtcgtaggtgggcagcttctcgagcgccgcccaccgcaggtcctcctcctcctcgtcgtggcccctcatcgactgcgcacgccggaacgggtcctccgcctccacctgccggaacgactgcgagatggcggaaccccagctcgggctccgtccgctcgcggacgccaccagcgccgcatggtggcggtggctcatctcgctggctttcttggtcgatcggttgattactcagttggcatgcagcaacttaactcaagcatacgctaagctatatgtgtatatatacgcctagatgccagcatcccacgggcacccgctctatggctccgtttttttctccaataaaagttggatgaagattaagatttttgtggcacgtttttcaaactgctaaacggtgtgttttatggaaaactttctatatgaaagttgctctaaaatatcattttaatctaattttcaagtttataataattaaaactcaatcaatcattcattaataccatctcgttttgtttaaaaaacttactccttatctctatcttcatctacagaagaaatgaagtacgaactatacgtgagtgattagcagctgctaataatttcccccgcagccaatgcttggctgctagctgaccagctgtccatcgtcgtaccatttgttatatacagtacattatataggagtacgttgatatacgcaataatcccttatatgccactaaaaattggtcggatctcttatataccactaaaaattggttctttccttatatgccataagtctaaatttgcgcaccttctcatgccactgccgtcagttg

SEQ ID NO: 8174 - DNA, 11761 bp, Oryza sativa
tcaactgacggagagtggcatgagaggttgcgcaaatttagatcaatggcatataaggaaagagccaattttcagtagtatataagggatcaaaccaattttcagtggcatataaggaattctatatgcacagagacaccccaagtgccatgcggtacagccgtgcagggccaccgtttcgaatgcgtgaaggggaccagaattccaaaattccggatgaaaatttgaagaaattttgctaaatttaattaaaaaagattccgctaatttttttaaaaaataaaattttcgatcgagaagtacctcttgcacaggtacccactggtaaacacaaaattttggaaattctgatacggtgtgtagtactgtagtgtactctctcctcttgctagatcaaccggttatgcaaaacaaagcaacacgtgcgtgtactacataagtatatggaccagtatgcttggcacggttgtgggcggtggcacagtacgaggtacacaccgtttttttcttggtaacattaaatggattgcgtacatgtatatatcagatagattctaatatttaatttgggatcggcctacgatcatgtactactactacataaaataattatataatagaataataaatgaagtgtagatgttggaaaatagagaaccgacatctataaatatatatttatatatagtacgtgttatatttttccttcgccctaaaaaaaactgaacttctatagtttaaattttgtcccaccaaaaactaacttctaccatcctacctactctcagcagaagttttatctctttaataccctttacctatctaggggtgaaaacggtacgaaaactgacggaaatcatctttatcgtttttattttcatattttttttcgtaatcgaaatcgaaatcggaaacccggatacgaaaacggaatcgaatattatcgcaaccgaaaacggagcgaaaacgaaccggcgcgaatacggtaacgaaaatttatcggaataaaaataacccctctaactgataaatctaattctcaagtctcaacggtcaacaattcatcgtaaaacacaatcatataagtccaattattaagtatcaacagtacatcacaaaacacaatctatggaacaaattagtaatgctgttgataaatcccaatgtatgaaaaaaatattattatgtaattttagatttgcataacaaatattatttaaaaaataatagccaaacaccatggtataaactattcagtgcttaaaaaaacaatccagggtatttctagaaattccgagaaaaaattccagaaagttttcgacggattgcgagttctgacggaaactgcccttatcattttcgattccgtgtccgagaaagtatttccgaatccgtttccgtttccgaaaaattccgaaaaaattctgaccgacagattccgtttccgaaaataggtccggaatacggaaaattttcgtaccgttttcaccccctacctattactcttactatgttttttatttattaagggcattttagtcattatcactcgccactaatttcaccttgggatgctaggattggattttttttggacggagacagtacttggttgtaaaaaaaaaaactaaaattgggtgcgttatagtttgtctgtgtgtgtcaatatatatatatatatatatatatatatatatatatatatatatatatatatatatatatatatatatatatatatatataaaataaaactggtgtctattaaggtgtggctttttaaagtgctccacatacacacaaatatttgtgtcagttttcttaaccgtccgataccacatatttttcttagtgagtgtaggagttgagcctatcacttcgttatctttatcctatcctctccctctctcacgttctcacctattcccgtcccccccacccccccccccccgcgcgcgcactacccttctgatgtgaccatggctaacacggatgcaaccattgctcacatcatggatgaacaagaagatatcgagatcaagtactccaagtgctggaatccgattcggccacctactacactactgacttcaaacggccaccgaatctgcatacgacctccgttttcggcctgtgagtacttgatggaaagctcttggagccctctttctaacggatccagcctcttctctgaattccatctcgtgtggccggaatcataggaacaaggtgctgcatcacctataatgggcctatgggcttgtaacttcatttgggacccggcccaggtggggcccatgtggggtgcgccccaagctgatggagcacgaccctaggcacccctaggtcatcctcccaccctatatatagctagttaccccttcagggtttctcgggttttgttagattaaagtttagccattgctacttgcttgcagcgcgcgtgtcggctagaccgtccgtctgcttgttcttcagaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcagatcgtcaacgtttctcccaaatcgtagttatcacaactcaccgaaagatcgggccaacaacagccttgagtgtcgagaggaactcagggttcatcaccttcgctcctcaaagttgtgcctgtcgccacctcctcctcctcctccttccacttcatcccacactatgcgtgaatggtgtgaggacactagccatcacgctcgcctgggatagcctctaggccacagcccacatcctcgcactcctcggcttctccctctcctgcacctacacctgttgggatggcgatggctgcccctccttctctccaatcgggggcgaccggattaatcgccgcgcgcatgggggcggccaaatctgccacagcgcgcggggcatgccactcgacgactacagtagtagtggcagcagcgacctcctctctttgtgtgatcaggagctgctcgatgcctcggctcgaattattttttattcatggaacctcaaaggtgttggttccaaaactggaacctttgattcctccttgttagtggaacctactaggtgtccgttatgaaatcttgcatctatgtgtggttctcaaccggtacctactaaggtttttgtagtagtggtaggattagaatgtttcaattgacatcagcaaaatatacgttatgaaataaataatttagtcgtcaaaacattcaaaaaaaaactttgaaacacaataaaaatataattctaaaattttgccctaacacgtgaaatataaattttaatagttaaagcacatatatttctttcatcaaagtataaccatcttattataaaggtttaattgtaaagaatatagtggttattcataccacaaatcaggtaagaaatcttatttaatttcccttcataaatatatggatgaaaatgaaattcccaatgggacttttcagttcgaagacttttgatgtatgttatcattagctatcattgtcaaaactaaagtcataacgtacaatgcttcaagatacagatagtgtcaagttcttttgtttgctagacaaaacaataagtaactttgaaatatggcaaattttattttaggacaacgtgagtttgcaattttagctgtagacaccacaagagtaaaactttcagttgaagacactatgtaaatatggtaattagccattagacatcgcccccaatatttttatgtatttggcctgacaaaacaagagaaggcctacatttatacatggagagaccgaaatgcctacatggtatttggctatatggagttggattggttggaacatggcctgagccatcagtcttgaagacccacggtggccaagcacatctgtcatcataccgtgatggtggtgataacatcaaggtgaccactttctccatggtggccacaaggcgaaggtggtgttgaccgtgatggccacgatgaggcgtaggtggccacaaccgcatgatgatgatatattcttcttcgttttttgcctcacgtggtatagtgggagcccggagttcctaggtcagcgatcttcctcttgtgaaatgcctgttttgcaaggacgattccatggtagtgggatcggacaatatgtaagcaatttcccccaagtttctagggctttcactacatttcagctttaggaatttcaatttgattaaatgtgtgttgttgttgtgttttgcaaactggtgcacaatgtaattttttgatgtggcacgaggactatgttgtatagatggtgaagaaagggtggcttcatgctacagtagattgcaatgcttcatgctacgtcttgatgcttggagtagactggatcaatggcagcatggtcgcacactaagtgcttgatcagcattccgcgacagctcggacataatgtggtgaggtaaagctttagagtattgatgtagaagtgaagggtggatgatggtgaacagaggctagggtgctatttataggatggctggcaaagggcaaattggccttggccatggccatggctgtcggcatctaggaatggaatttctgaatacccgaagcataaaccgtctaagtcccatgattagtagatagtacatgagtccacaacctgatcatcacatccatacataatatgcatacaaatagataacatggttcacataacatagcgagtgcataagtcatacaatataaatagggtcgaccagccaaaagaaagagtttaaacgtagcataataagaatagcaaaatatcattttggtatacccatctaccaaaccaacccagaaaccgatagggaatcaacctagaaagaaccatcctcgaaacctcctacacggtgcaaagtactcgtccctaagcatttcacttccaacatcaatgtctaaaaaaaaacaataagaggtgggtcaatacatatgtattggcaagtactacccaaaccatgtgaagtatatgtctattgcaagctgagatcaaaggaggttatctttgtagactaaattttagcataagcaattttttattcgcaatagtaataattatatattgcaactaaatttgtaaagcaacaagtaaacaataatagtaacataagcatcataataatatcatacttgtgcactccatggtagcaagtaaccatttcattctcagctaacaccgggcaaaatcagcactgaatttacaccataccaatttcacatatcatttcaaaaatcaccaacactatacttgtatcatttcaccaaatcgctcatgaccatgagaacagttaatcaattagtttagaatctgcagagtttgtataatgtatccatatgacacaaaatagtaatcatgcaagcatgccacgcgataccgaaaggtacctgatttaacacttgagatgtagttgttacattcctcaaagtctagccttgcatcaacaatggtgagtgaaaattcacactaaggcatatgacctagcgttgttaggtagcggctcacaccttaaacctaacgccatagtggcaacccaatggttctgcgtgccgtattggacaaacttagacgcccatgccgtatcctgacacatggggtaactcctttgagttaaactcaacacaatagaatcatcatcaacacacatcataactcatattacttcagcctaccaaaatacaagcctagtcaataagcaacttagtaagctaaggttaccccaataaataacacatgtggttgcatgatacatcttagttggtgacacatagtttagtccttaatcgacccagacgaacactccccctatgtcacgccctaaaaatcccaaatttataaattgttgtttaaatagaattataagaaatgattttaaaagcctagaagaaaagatctaattttaagtaataaattccaatataaaagtggactagataaaattttattaaatacttctcttgattctatagttcctagatttttctgggatttatttgagccaagaaagtatttttaataaatggaattgcatttcatgaataatttaaaaggaaaaaggtttaaaaatccttcttttggatttgggccgaaagctagcccaagtctctctctccccggcctgtgcgcgcccggcccaagccggcccaccaagccagtccgcccctctctccctcctctctcccgctgacaggtggggcccacctatcagggtcgtcttccacctcccgccgccagccgcgccctagccgcgcgcaagctgccgccgccccttccaaattcggtcgcatctttcccgatccgatcaaattgatagagggaaaatgatcccttcgatctcctctatcttttcccctatagaaactttagctaatttcgtttggaaatcgtcggattcgagttcgattcagattcgatttcttccctccaaccttaaaccttccatcgcctccgccagacgccgtgggcctagccgcagcccctagcccctataaaaggacccccgagacctccgctgttcgtgccaccttcgccttagccctccaccgccggtagagctctagccgcgttagcccgtgcgccgccgtcgccgcagcaagtccagccgtgtgccctcgccgctctggttgtcgtcatcgcttggggaggttgctgtcgggttcgccaagtcgtctctgtcctcgtcttgtcctccgtttccgccgaagatcgccggagcatcgcagtcgccgtcgacccgaacgtcttcgccgcctcgacctcgccgtcgtcgccgtctgttgccgtctgtcgtcgtcagagccctcggtgagttcgccgcgtcgccctctacccgtaggtgctgtccgtttgcgccgctgcgccgtcgttcgccagcgagcacgtggtgccgagccgccgtcggcaatgacgtcatcgtcgacgtcagcgccacgtcagccgtagacccgcaatagattagatcgatctcggccgttcgttttgtttagattaaatctcagccgttcgttccgtaaaccgttttcgtgcacccggtccaccgtaaatccgagcccgttgacacaataaatcattttttccttttcaaaaataattctttatagcgtcataatccaattaaaatctatataaatgatttaatccggtttaatcttaaaaattcataactaattcatcttagctcggatttagttggttcaagtctctaaatttttctaaaattgagatctacatgttaaaaatatccacatgtgctgtttatgattgtttatgtactgttttggtgattttggtcttttatgtttagattccgatgttcccggagagtccgattttgcaggagaagactttgaagaattccaaggccagcaaggcaagtcacacatatcccaaacaaccctttgagcatgttgatccagtttaaagctattgtttctattcaactattgcatttatttttgaatgtcaccgggtgggaacgacatattgcctttgttatagccctttgttattgatttcctatactttgtcacctggttaataattggattagctagaacattatatggttttagctaaagtaattaggatgcttagccatgcttagagacgctagctcatatgaatgggataattaatgattcactattacttaatgatggtttaatggtagctcatgatggttaatcatgataagatgccaactaaaacatggtaatagtgggttgtgagcacatggttttgatggtcgtgctcatgacaattaaggaccggttcacgattttcggttgtgaaacattaaccgtgccaaccacaagccagcgtgggcaacggctttaccttttgtatagtgtggttcatcgcgaggcaccagactgagaagtggcgaagataagcccacgggggtcgctagggagtccatgccttgttttataagtgggtgattatgatacaggaatggtgcactgatttgaattgtgctatgcggagggtattgtcacaatctctattcgggtacttgttaagtatcgcgacgcatggttgacatgatgttaaggttgtgtcttgtgggtacagtggtacacctctggccatagtaaaactattcgaatagtcgtgcctgcggttatgggcgggtctaacaatgtcttttgtgattagtctcacacctcttaccataataaatgatgctataattggtaataacttgtttagctcctggtttggaatggtatattcctggtttggaaatagaactgggcagccgggaatggttgttcagaatggttgggcctatgcaacgggtatgttgtatagcgttggattagtattatttaattaaatactttactatttttctaaattctgaagtatttattgaatgccatttatgcaaatgagactatattatgccatcctttgttatcccctgcacttgcatatttgctgcgtggcttgttgagtttgtcatatactcaccttgcaatcattcatcagaggaggagttctacagtgatgctgaaggtgtggaggattaggcgtagccctggtcaagctgcttgtgggatggagttgtctgcgctctttattttattttccgctgcttagatctttattgtttgagaggaactatctacctctgtaatgactttatattcacctattaattggaataataattgtactctattatcaatttgttattgtgtgcctcggctgattcctggacgagggtttacacgcatgtaagcgtttggagttttgcatagaaattccgggcgtgacaccctatcaatgtgcaactatcaccttatgcacatcacttgccacccaattctaaaaccatcatttttagtttttattttcacaaataatagaggcaatacccctgtccaatattatcaaatgactaatttgaaagagtgaatattgtgtcattgatatccatcaaaatttctaggcatggctaagcaatagctatattagtatctcgaatatactaaaattggtacttggacactactacaaggcatcctaggtatatcaacaggaatatgaacaataattcaaggtggataatgtaacaagtaggagttgttctatcggtacccaattttttcaacatcgcatacaagttatagacaatattgcattacgaaaatatagacatacaacatgatcggaggaggaattgaataggacttgccttactcagtgaactcatcacaagtatcaggttcgtgctcacactcctccacggctgtaactttgtcgtttattcaaatttaaatgaaactcgaatgaacaccaaatattaaaaatgctcaaacatgcatggtactagtacagtagatataggatgattttagataaatttaggtgaaaaaatcattagaatctgatttcatacgccttagttataaagctttcaaagtttaaaaatgctgaaattgcaaaggttactattcactatttgaaaattcagatttagctgtagatctgccctatatttgtcaaaaaatttttacttaaccacacgaaggagaatattatgaggatcaatggtaatttggttcactcaaatcagggtgaaaatgaattctctatgatttttcaaagcttcagcaaattacatatataattcacagaaattgttttctcaaattttttagttatttattaaacatctacttcaatgcattacaacttcttcaatttggtcttttttttttataaatgctttgaagtggtaagtagtggcatatgtctattttttgtcaaattgtaatggcattataaatgctttgaattataaatgctttgaatggtgtgcaggcctggactggcaagtgccaacctacctgctgcgacgccagggcttctctgttctgtactctcgccgtccctaaaaaaatctcaatttaagttagaactagaaaatgagcgtgcccgttggcatggatcttgtttctgttggctcatgttgacttcatgatgatgtagttaaccaaaatctcttgttattgtcacacaccttcactcaaggaacaacaatgatcgattaattgcacttcctcacgttacttcaactttctccatcgaccatgagagggcactagaccattcggtcgataagttttcacatgaccataccagcctatgagggcactcgcagtgcgccatcagaaatggtgcgcctgagcttggggctgggctagagaacaccaaaagccacttatctacaatgtaagtgaccttacaagtagcttatagtgggacccaccataccactttttccttttcactttccctccccctctctctcccctctcttcctctcccctctctctcccgagcggcggggcaacggcggggcgacggcgccgagggcccaagcggcggcgagccaagcgacgatggcgccaggcaccgggcggcgtggcagcgaggcggtggcagggcggagcggtggtgggacggccagatctggccggacttggcctcgggcagtgacggtgacgggcggcacgaggacgacaagctcgacggtggcggggacgatggtgccatctctccaccaaccagtggggcacggcgcggcaggagattctcggcgcgcgaaagggggcagccgtggccggcgtcgttctcaagctcctcgccgtcggcctcaagcttcggatgtgccgagctttcttccctccctctctcccttccctggtgacctgacaaagctgccaaattttgctgaagaacgtgtgtctcactttggtcacttggtcctgggttggtcacaggaaatgctgatgtggctgagaatctcctacatgtaagctcgaggctgaatgacacgtaagcccactgtgaatggcctgagatgcgttcaccacttcaccagacaaagcgccgcatgtgaataatccaaaatgtgggcatacatatgcacgctgattcacaaaacaaacgttgatgaatctggtgccacacaaacaaaacttcagaggatattgcatctactaatagactagcttcgaggcttggatatgcagaagatacttgccacgtccagaaatttagccaatttccaaattattttttatgtaataaatccatgtccaagaatgaagccagtgtacacaaaatgacaaattaatatacagatccaaacgcaaataaagcataagtacttatagaagaggtgcttagtcggttagtcctcacacagtaaagaaaacagcagtagaaagggacgataatagcgatttttaattaaaaatcattccctaaaaggaataataaaatttattaaaattcaaaaagaaattagaaaacattaaaatacatacaagaaaaattcgaatgttacccggattatttttcttaaattccccatgttataaaatgtctccctaatttttacatgaattttaagaacaccagaaataattttaatgcaacaaaaaataatttaagatttaattaaaatagaaaacctaaaataaatcccctctcacccgttaggcaaatccagcccaaagcctctctcccctccctctctttttggaaaaagtacatcaaaggtccctcaacttttcatcgagtcacaaaatcgtccccaaaccgcaaaaccg

SEQ ID NO: 8175 - DNA, 1402 bp, Oryza sativa
gggcgaggcaggaaaggaggaggcgtgggctgcgatgctagagaaggcgagggcagcggcagtggcgaaagcaagagcacagtgccacagtactgcgagaatgctaagccacacctgacatgcagagactaacacaacaactgccgaatcaagcgctcccaactattgggcggcaccttgccacttttcgctgccggcgatgccggacttcaagaacggcgtgccgccttgcgcgccaagcccggacatatgcccgctgccggccagcgacgtcgagtacctgaactcgtagccgccgttgccgccaagcctcacgatgggctccccttcatagctccttgacagcatgtggacggtggagaactgctcttgccagaagcacgccaccttgccaccgacggaggcaagcgccgccgagtgcccgacgttgatgaagctctgcgtgccattcggcaccgcgttgccaatgaactccgccatcaagtgtggcccgttcgtccccgtcgatgcggaagccgccaccgccacagccgctacatgaaccaagaacgacacagcaacgacaaatgtaaccgatgtagctgagtcaagtgcattcatacaaggcggcggcatgatcgatggaagctaagctaaggtaagataagccgtcgctgccctcgccttctccagcatcgcagccgccaccatggcctccacctctcccgcctcgccctggcggcctcctcctcagccgtcggccggcttgccagaagagaagagaagagtgagagagaggagggagaggagggggaagagaacctgcagatgtggcacctgacatgtggggcccacgtgggtctcaagctgacccagccgccacgtcagataaaacaggcatcaaaaccaccgaggaacctagtttgcactggttttgtaagttgggggatgctttgtgtctagttttatggttaggggacaattttgtaactcgataacaagttgagggacctttgatgtacttgttcctctcttttccctccttctccctgggccgtcccacctccttctctccctcccccgggctgcctcggcccgagccatcctgcccctcccgcctgagccgcttccctcgcgcggcccagcgccagccgcaccacccacacacgcgcgacgcacgtgcgctgaccgcgcgcctcacgtgggtcccgcctgtcagactcgtctccttcctcctgccggcctcctctcctcacttccgtgaaaacctgcctgagtcctccccaaaatccgctcgattcaaacagataattccaaaattaattggaacggctgtgcctccatcacccggaacggctgtgcctttcccgaccaccttccatggccgccggccaccattctcggtgctggccccacctctccc

SEQ ID NO: 8176 - DNA, 626 bp, Oryza sativa
tttcccctacagaaatttgttcatctctaatttctcaacatgtggcctttggaagaagaggcccagaaatcactcaccacattccatctcaacgtcggatcttggatctcgatcatcagctggtttgcgaggtgagcaccctttgttgtccagctcaactctatcaaccctctccactggccattaattggtccatatcttcctcagctccttaattgccttcactgaatgttgaccatgccacaacaggtatggcgtgaacaaggcagttgaaatcaactgtgcagaggtgtccggttaggcattgagtcgagcatgtggaacacggcggtgtgcagaggtattccagtgttggaaataggacacgagggatggatttggcagaagagtagcctatcagacgatgtggatgagtagggatgaagcagaggagccgagcagtactacggaggggcagcatggacattggaggatccatacagtgttgtggaggtgcggcacataaggttgttggcaagcttggttcctcggtctcctccccctcttcgtggtacttggtggtgcgctcctcaacaagggatgagaggatcaaaatgaccaatggaaaggagccaaaaaaaggagaa

SEQ ID NO: 8177 - DNA, 729 bp, Oryza sativa
ccatgcattcagaaccccttagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttg

SEQ ID NO: 8178 - DNA, 1000 bp, Oryza sativa
gtaatcacgtggaactcgtcgccagacaccgcagatcttgcccgtggcattctgatagacactgagagtgcccgccaaggtggctccagttgatgctcctccaggattacacccgcatcatcaacgaattgaatggcacgcggacgaccgattccgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggcgaatgacgaatgccaggggatcatcatgaatggcaatgcaactatcaggtagagatccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggaatgtgcggac

SEQ ID NO: 8179 - DNA, 773 bp, Oryza sativa
gagctgtgaaggtcacgaagctgtacgatccatgagggtatcctggaaaacaagcaacgttccaaatggagcttccaaagatggcgcggtggaggggacagtgtgctcaagccatcaacctgcaaccatgaaggaaaatgtttcagcagaacgatgttcctgaggctgccggaagatcgcgagagtcgttcaagggaacagcgcagggcttcaatacggctagtcacatcctccaagggctcactactgctgcagtcaagtttaagatctcttaagttggtcagctcaccaaggcattcaatattgctcattgagttttttattaaatcaaaccactctaggttacgcaaggatttcaggtcgccaatcccattgggcagaactgtatttgctggaataaacagctgtgacaaatggggcaaactaacaatatctgatggaatgctcaattcttctgatgtatgcagctcaattgtctccaaatgccacatcccaccaagttggctaggtagcaccaacttgacatcatgtgaaatctttaaatatctcagcagagaaaatccacagatacctgtaaggtccactctttttcccctccatctccgaggaaattcaagaagtagaactcgcacatatttgaactccaaggatgaaggcctaaaactgtttttgaaaaatgcagctgaacgaacttgtgacagtgatctattgtttgatgctggtatcacaccgtcctcttcatcagcatagtggaaagaaactcgacggatctt

SEQ ID NO: 8180 - DNA, 58329 bp, Oryza sativa
agtcctctggatacatactgacatatagaaggcatgtcttaagatggtgaggaaggttattgtagctcagttccagtatctgcctcattccacccaaggtaggatttccttcaaacatggacctcatagaattatttacatattcccaggtgatatatggttgaccagatagaaggctagctatactgatgattgcaagtggcaagccatcacacttttttagaatattagttgtaacctcttcaaatttattagggaaagcttcatgggatccaaatattctactataaaagagatttcgtgaattttggtcagtaagtgatttcatcttatatatatacgcttgactgttggagcaacaggtggtagcaacagacaaaattcgtgtagttgttaataccctgctgccatacttgttctctggaaaagcacatctaataatgttccactcaaaggaatcccataaatcatctaccacaatgaagtacctgccaaaaaatttcatggatttctctacacagtatcaacgtaatgtagtacatagatgaaattgtgcaaagtgtcttacatatatctatttagaggaatagcttttcggcaagtgaaataaaatgaattactaattatctcacggggtcaatagaaaaaaggaacattgaaattcatctaacttcatgctttctttataaatagaacataagaattcccggccaatgaatcatcccaatgtactccctccgtttcaggttacaagacattttgactttagttaaagtcaaactgcttcaagtttaactaagtgtatagaaaaaataataacattttcaacccaagacaaatttattatgaaaatatattcgattattgatttaatgaaactaatttggtattataaatattactatatttgtctataaactttgtcaaatttgaagtagtttgactttgaccaaagtcaaaacgtcttttaacctgaaacagagggagtataaggctcccatcggatggcccattaagccaaagaaaaagccaaattttaaattttcaaacttaattttgagattgattttgagatattttcaacgtagtttctttttcagcattggcttttaagttaccaagaacacatatataaaagttttacctacaaatttatttttatttcctaataagtcattttggcttattagaaaaaaagcaaaatgatggggccctaatttaatgaacttaagggaactttggaatgtagcactttaaagtagtgatagtagaatttttatccatttatactcaccttattttgcatatgacattcaaagtttgaagcgcattcattacttaacctttgtacattagtattgaaaaatcagtttcatattctgagtgtcagaaatctttgtattgccgcctgaacttgcaaattgaatttcaacacttaaagcttttaaattcgaagtacttataattcaagttattatgagcacaatctacaagaattggaacgaacgtaaaagtaggaatcagaattttcatgcatttaccctttcaagttatagctttgtaggcctgataattttataggacttcacctagaatttagatggtttttttagataatgaacaatttaaatctacttatgtaatttcattttttgacaaaaacaaaagcttatgactgcaaacatagtatgatacatgagaatcattacctcttatcccgcagactatttatgatatcattgagaatcccatccaaattggtgttgtgcacagagcactgccccctaacttccaataatattctattgagaagttttggtatgtcaggtttttgagataccgacacaaacgcgccgcagtcaaatttcctttcaagcttgcggtacacttcctttgcaagcgtggttttgcctacacctccaaaacctacaatagaagccaccttcagcccttgctcttcacccatcagcaatttgaggagctcatctcttggcgcatcaattccaacaaggccagccgcctccgaatagattgcgaccactcgcgggtcaaccggaacatgtctggaattgggggtatactcatcaatcttgtacctcatgcggcgctcgctcacctctttcacaaggttcttgatctcctgaatactgttaccaatctgatggcgtgcccttatctccttcagaaatttaaccgtcttgtgaacaaatccattgcttccattgttcttgtcaagctgatgcaagaaatcatcgatgcaatcctcaatgtcataggacatctccctcacttggtctctccactccttggcctgaccatcaagctcatccatggcggcgagcttctcaagaagggccctcatgcttctcaactcgtcctccaaggaagccacctccttccggacgcctctcagcttgccgtactcttcccccatcagcgcggcgagcttggataggagggagttgatcgcaccactggaggcgctcgccatggttacggccaaagatatctttgttgcttagtcagtacgcactcacttggagttggaagaagccgtggatgcagcgccgcgcaggagccgagccgcgcgtcgcctgacggagcaaccggaggtggcctccacggcgactcgccggtgctcaccgggctggtcgattgcaggatgtgaaatccggcgagtggcagtccggcacggaagagacgtgaaatggggaatttcaggtagagcaggtcaaaaaatcagaggggaatttaactgatacgccgttgacttcttaatatgttgaccattcttcttatctattattccctcagtttcgttttatttgacaccgttaattttttagcatatgtttgaccgttcgtcttattcaaaaacttttgtgaaatatgtaaaactatacatatgcataaaaatatatttaacaatgaatcaaatgataggaaaaaaattaataattatttaaattttttgaatgagacgagcggtcaaacatgtgctaaaaaatcaacggtatcaaataaaacgaaacggagggagtatatactaaaagtacattaaacttcctacaaactctctcaagctgccacgtgacgctctaataaattagagaaaatcttagaaattctaagaaaaagcaaaacatctacctttaatcacttaaattggtgggtccaacattacacaccgttagatgaaattgatcttaaaacaaaccaaatactatgggtcctacctctccttctcccgtgcatgtgtacgtggggatatataggtacttaccatgtacgtacgcccttcttttcttttttttttctttttttcttctttttccatttatataatatggctatatacttttttaaataatcataaatttacaacacaaagaatctactaaattagctctacaatttttagaaataaaatttaaaccattatatgtgaccattaaattaataatacaatatagtttccacttaaacatgggtactcattattttgtactattatttttaaataatgcactattttaaaataaattttacacaattatattgtgtacctatcaaataaacaatttaagatctatattaattgatttatacgtgcacttaaaccgatggatctattatttaaatcatcggaactattttttattacattggactattattctcaaataatgcatggtttcaaaataaagtctacaccattatattatgtacccattaaatcaacaatttaaaatctatattaactaatgtagacttacactataaccggtggacccattatttaaatcatcttatatattatttgctaataaataaagcgtccgaagttctcttttttgcccgctgcacaaggcacatatgcacctttgccttttgcacgtgtgccaaagcgtcttgtctaaggtatctaaggtgatcacgactaccgcagcactaccgttttgcaacatatcaaatcatatatggagatgattaattttgttaataacatgaaaagaaatttaaaggtgtgatgcagcgagagaggaattaagcaccgtgggttgtgttttttctaatacttagctctgtttaagctgaaaccgagagttaattacagaataattataatgtattgtgttatatatgtcgtatttgcatttggtactatttgttcgtataggtgaaataaatcattatgttataaatgtgagcacaattttaacgaatattaatagcactcttacaaagactagggtgttataagggagtttaagatccgctttttttcccgatttcatagttggattttcgtttgcacgctttccaagtttttaaatggtgtctttttaaacaacattttaactttttagaagtcaattcattcatttataccctaaaatagctatcacataaatcagataattcatcaatttcagttgtcctaaaccctaagtagtacatatttttttatgtgagtcatggtgatcagtaaattgtggatcaacggataatcaaagtcgtaagatgaatatataagagctactatgaacaactataaatacgtgtcaaaattaattgctactaattagacatctaatggcttgctagccacataattaatttctctcgacatgtatataaacatgcacgaagctggaacaaatattattatatgccctatacatatatattaagcggctaatattctaattacatgtgttaagtcctttaaaatttcttaaaacgctctcaagctgccacgtggtgctccaataaattagagcaaatattagaaattctaagggaagaaaaagagcaaagtatccattacttgatttttcatttaatcagtacgtccaatattataaaccgttaaattaaattgatctttgaaaaaactaaatactataaggtctcacctcttgtcccgtggcataggtatgcacctacgtacatgggtacgtacgcttcccctcccttttttcatttttccctttcttctttttttccatgcatacacttccctccctttcttactatatcatacgccttcttgagatgatttaatcacaagaattttgagtatcatgctctcacatttttcatttgttgccatactacatggtatgcatatagatggacggtatgataattaactagcaatagtttcttatttactcgagaaaaaaatgattcaaaagtcatcccttaagaaaaagtttgtgaatggttttttaagatactttgaaaaaaatagaacccttaaattattataaaataacattatccaactttagtttgcccttaatctatgagacaatttttgaacaaacaataattttacctttcaataatataagtgcccgcgcatgcgcgcgggccaccttcctagttaataaaattatacaattaatatttaagtatgatttaaatatttttatatatacacaaaatattcaaaataagacggatgatcaaacattaacaaaaaaaaagtcaacggcgtcgtacatttaagatagtcctagaaaaaggtcccgcacattgccgtaggatcgcgcaagattatcaaatgctcaacttagattaaagcagtgatatatgtatattattatatttattgtatgtgctattatatgtatattttttattggaaaatagatatgttcaattataaagggcacaaccatttgagggttttactgtaatggacaaatgatttttctcatttgtatcataggaatttttagtaagaacttacaatgaagattaagtgtttcacgcaaaacgaggtggtaataacgtgtagttttgattattacaaacttgaaaaatggattaatctgatatttttagagcaacttttatatagaaaggtttcgtatgaaaagtaccgtttagtagtttaaaaagcgtgctacgagtatccaaaatttcatcccacctttgttggagaaatgaacgcagcctaagtattcatttctgtatgatttttcagcagcttgaaaaacccaacattaacctaatatgtcattttattaatttaaaaatagcataattcatcaaactcatcagaataatcaccctcacattattttttgggttaataggatccatgccattaaaaatatgttggttttgaaatatgccactagtatttgcgtatctggaaccatgccattataattttacacatattcgagatatgccactactgtctacttatcctttggatgcattttaaaagaaatatctggaccaaacgaccctttttccccttattccttctcccttcttcccctttcatcttccgcctctcttctatggcttcacctgaccggtgatggtggccaccacagttacatctcctccctctctgacactccttcgtctgcatctccctccaccttggcccgctgccagcctccttccacgtgtcatctccctccacctcggcccgccgccggcctccttttgtgcttcagcgcatcccagatccagtcacctctctttgccgcgaggagctctgggcagtggcgacgaccaaggaaagagcggccacttctctccggtgagctcctgcaccttcctccctccctcactgcacccgtagctcctctggtccagcagctgcctccaccacctcgtcgccgatgtccgcctcgacgcctgatgcagcgaggacggccttcgtgaagagccttggcggatggcagacctgcggtgttctgtccggtgctccgagctcctgtggcaaacgtcgctgccgacaaagagaggtagaagatgagggtagagggaggtagaagatgagggtattttcgtccaatacatacaaaataagtatcttagtggcaccactgagattacaacagaagtggcatcgttacaaatacttttttttttgtcttttcatttatacgttttcacatgagacgtacttggtttgacaccatccccaatacctcaccagcctgcttcaaaacttcctgtactagttgatacctcacgcgttactgtgggagttcaatataataacaataggtaaaaataatacgtaaaatagttagacaacatagacttacataagttgatgtggattataataatttaaatttaaataatacatagaatgatgattcgaagataaaagtaaggtgatgtatatgagagaagaaaatgaggaagatagtttgtactatagattaatcatctaagactaaaaataattggtgtgatatgacttaatgagagaagagagaaataatgctaagtgagaatgaactatatataagtatataagataatataaaaatgttgaatagatatattgaaatattatatgaattatatgggacgatgatttaacatgcttgtattttaaaccctaaaatttaataaatgataaaattgtagataatatagaatgcttgtatgatgtttaaatgtaataattgttagtggatgataatgtgatatttttgcatgttaagctttaggatttagtgggctataagtttatagtgtgataggatttaggtgccactttataaaatctgtttttcaagttctcccatagtatctcacctttttccttagatttcatatacggtttctttaatttacttcattcctttgcataagtttatttattatataaaatataacctatttggaacattttccttattactgaatggaaatggatagttttataattaacaacagtactaatttgagctgctaagtccaaacctggaatgcaagaatttaaagtcaaacatcacattgaccagaaatatccctcaaatttttgtgtttgtaaccttcttattttaagtatgttgttattatattccaaataaggtgtaagttttccttataaaatataattaatagattaattatagtagattttataggtgatttacgagatacgataatttgaaatatgtcaggatgtgtaaacaggatatatatctaggtgctcatttctcctctagcgctgaactgatggcctagctttagttacgaactacacttcattgcattttgccttaggccccgtttagatctcaccctaaaattttacaccctgtcatatcgaacgtttaacacctgtataaagtattaaatataagctaaaaaataactaattgcacaaattacgactactttgcgagacgaatcttttaaacctaattgctccatgatttgataatgtggtgctacagtaaacatgtgctaatgatggattaattaggcttaataaatttatctcgtggtttactagaggatactgtaattagttttttattagtacccgaacaccccatgcgacacccaatataatacccgatgtgacacgcgcaaactttacacccctggatctaaacacctcgtatagtgatggtcttgccttgcctgcatttcagtgatggttggatcctactacgtttggtgcatagaacccctggggcagagtgtaggcctgatgttttaccgtgtgcgttgcagcagttaaatagagtacaataaaaccatcggaggttaccaattgtaaacagtgaaatagtaaaacatgcgacgtggatgaatgttgtatttcatgccatacctctctaggaatatagttatgtgtagtgatggttggatcctacgtttggtagatctcatagtgcagactgcagagtgtaggttgaatgttttactgggtgcgttgtaatagtcgaatagaatacaacaaagccatcggaggctaccaattgtgaacagtgcaatagtacaacatgccatgtggacgaatgttggttaaatcctatactatagatcccatggtgcagagtgtaggatggatgttttaccaggtgcgctgcaacagtcaaaatgagtacaacagagctatcggaggttaccaattgtgaacagtgcaacggtaaaacatgcgatgtggacaaagggagaggaaggttgctaagtgtgagaaagaagacgagccggaggcagttaggaaggggaagtacccacattgcacccagtagaacaaattcaatttccccaagttgcatgtctacgatcgtttaaacccttctgtagtcgaatcaattgaggagatgccgaacctatcgagcaaatttgtttccaatgcaccggaaccaatttatgttttatccatgtcaatgtttgtacaagtgttgatttcaaaagcgctggaaccaatttatgttatatccatgtattcaatattcgtacaattgttgattccaaatcatcggaaccaatttatgttttatccatgtattcaatgttcatacaattgttgatttcattgtgaaaatctataaagttgcttccctccgcggaatttgggaaaaaaaacaagacaaaaatcttagctgatgtgtaagaggatctcagtgccagaaagaatcgcgctaacagtacaaagctcagcactagcatatttggcactgaattttgggacttaccagcgcgcgacccgcccaaccaaacaaaactcctatgttgggtggccatgaggcgctgagctggcaagcctcagcgccaaaaattggcactgacattgaatacctcaacgtcaatctttggcgctgacctttgggacttaggcgcgcacggccgtcccacccaaacatagctcctgcgtttggtgatcatgaggtgctgagtcggcaagcctcggcaccatatagaatggcgctgaccatatagaagggctcggctacagcggcggccaagcttttaatctgctacctcaatgccaacgcggttggcgctgaggccttgccacatcagtgaggggatcagctctggctccacgtggacccggggggggaggggggtcaatgccaacgtctctggcgctgaaccgttcaacaacctcagcgctaacgtcccttgcattgagtctatggcttaaatactgtctaaagtcatttaaatggtaccatcaaatatatttagtacatggaagattgtttggtgctcttggattatttgagcacatttcagaaatttcacaaagtaattggattgtttcctctaactgacgtcaattcatttttcgatcaatttgcaaataaagatgtaaaagttataattgttgtggtagctagagttgaaagctgacctaaaccaaatatgtcattcttggtatgtattggcagcgaaagcataaagtaaatatcgattctgcctataaagagtccgaggggtattgtatgtatgtatgtatgtatgtatgtatgtatgtatgtatgtatgtatgtacgtacgtacgtatgcacgcacccgaccagccacaccattcgccttcattcacatcctctcccctcctattgcctctcatgttatcatcctatattagttaggaagcataatttattataatattttaaaataaatagctattttttatcagcttatgacattggacccatattaactatatttcaacttctaaaataaatatgttattttgggttatattctgacttttttcatatcatttaaacaattattaaaaaaaatatgaaaaatccaatgatatatattttaccggctaaaaatatttttcatgaattttcttcacctctatgtatatcatgtagtcctatcactattgaaatacaaaccaaataatttagaaaaattccaaaatgatttgagaatgctaatctcacacaaattaaagtttaaattagatctactttgaaaaaacacaactaaattctgttgtttgtattttacatatgtagattcaaattgccgttgtatatctgttaagtaatatttgatatgatagaatattatgatgtgattttttttgaaaaattgttatggaattaattaatacatgtcaagatcatctgtccgaatgtattttgcactaaaatatagccaacataagtcattagtataaaatcataataattacatcaatagcataaaaaaaataaacgggatgaataggaagggaaaaggagaatggaggtatgtacgtttatacattacctgtacatacgtacatgcggggagggatgcatatgtacgcgcagggtaggggggaggactaaaatcagtttttaatctaatatgacggtgcaaaataatggacctaccagaaaatcgagggctagatgtttctaatatattaaaacgccatgtggcgacttaggagcgtttataggagtgccacatgacgatatgagagcgtttataggatgtttaatggatttttagtatataataatagatacttgtaacgctccgcttttcgtgagacgttaaaaactaattcggcaaaatcctaattgcgaaaatttcgttctttgagtgttgagtctaagttgtgccaaagatctcaatttaaatccctccctcgtctcgataccctgttatcaaagatcgtctcctcaaaattaccatcccaatgtagtcccgaagctcgattccttctattcgaaatcccctcctggaaccccatccgtgaactttgtcgaatgcccgaaccctaactccgtccaaggattcaccttcgcgtcatatgctctctcattggttccttcaaaccgattctcaaattcgaattcaacctctcaggttttgattcatctatctttctccctgtattggttcatcaatatacccttgttttctttctcgaacttctgacccaagtctgaatatgcaaatcgagatcacttccacccttgaactcaaaatcccaagattcaatcccttttgccctgagttctccccaaaatgatttccgttccgaaataatctcgaagtccgaacccttctattcagacttctctccaaaatccttaccccatatcttgttgagtagtcaaactcaaactgccaagttacactctctttctctaaattatccatccccttttgactcgtctccgaatattgttcccttccttgactccttcctattctcccgagaccgagtatcaacctcgaaattcgaatccagactccaactctaaaacctcccaattaaatctctctgtgaaagtctatttaacctccctcataggttggattccttcatcctttttccggtccacctcttccttttcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttccggtaaaagtctattttacctccctcgtgatgatttgggccgaaacctgccgctggcccatctctccccaactccctccatctccacgtgcgccgcacatgaccaccgagagagagagcgctgtctctctcccttccctctctcgaacgttctctctctctctccctcgccgcgcccaaaccgctcgccgccgtttgaatccgctcgccgtttcccgtgcgctcgcgcgcgtggccgaccgtctgggagacgccatcgccaccctcggtcgtcgcctgctccgacgaccaccgcgtgtccgtgctcacctccaaacagtccccgtccttttgcagtcgtcgccggcgtcatcctgtcgagccctgcgccccacgccgcgtgcgtccaaagccgcgaggcacagctcgtgctcccgcccccctctcctcccaaaaacggaagggacatgcctcccttttcaccgtccccctcccctttttcccttctgggctgggtctctctctctcccgcccatgtctccttgcgcccggaggcagagcaccatgacgcagacgccagcggccagctcgccacccccaccttgaccgctccacgctgccagcccgcgctcgcgtttcaaatttcgccgtccgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtcttcgcctcgctcgaaacacccgcgccattgttgccggccgccagctgctcgcccccgtctcgccgtcgcacggtccgtcctctgccgcctcctccctcaacctcggtcgccgtcgcgtggccaaccccggagcatcgccgccttcttggtcgccgcggccaagaacgccaccgccgcgaccaagggcgccaatgcacgcctccgttcccttccccggcacgcccgctgtgacacgatgccgcctcggcatcgcgttcgtcgccgtgcgccgctgctcgtccatgcgccgccatcggccttcccatcctcaactcgccgtcgacgccgttacctcccgtcggtgagctccccacctctcttttcctctgtcctagcactcgcgtagctcgcgtcacgcgtgctctgtttccgccgccgtgcgcaatcaagagccgccgttggcctccctttcggcgactcctctagccaccgccgttcttgagttcgctctctacctccccaagcagctgtttcagccgccggcctcccctctcgccctcgcgtcgcgtcgcccgattcgccgctgccgcgctcggccacttccgctgtgcctcccctgccgtcggcctccctcctctccttgattcccggcgccgccaccttcctcgggccccccctcgacctccccaacccctccccctggccgccgaccttcctccttgctcccgcgccgtgccgtccctcccgccgccgcaaagcgccgccgcgagccacagcccggcgaccatcgggtcccgcgtcaccgcgtgtgcgccgcaaccccataccgcgtccactaagcccgagcgcgcgagccgcatcccttcccatcgcgcatccacgtcggcatcccggcgagcttcgccgccgccgccggccgtcgtcacgcgtcgtctccccaatccgagccatggaatcggttcgccttgacctcctctagccaccggtgttcgtcgctcgcttcggctcgccgccgttcgccggattccgccgcgcgccgtgagccgtccgatgccattcccgcccccccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaggtccgcaattgctccctccaattgctcctctctctctctcaccttcttattggccccactcgtcaatgagtcaaagataatcttgagaatgtctttccaatattccacaaatatttctctcttctataaattcagtaaatcattttatcttatttcatgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcatcgatcgtggatatcttgaagattcgtgaagcttcgtgaagaccctgagcaaggcaagccacctttgaacatattgagcctatatttgaacttaattatattgcttgcaaaatattatgcattgataggattacacttaatttgtttgccccgtctgaaaggcagaccggtgggcctacccaactcgttgcatctaatccttccattgttaattgttatatcatgttcccttgtaaccatctagttgcgcctcgatattcgtgcactctgtgcgagtatcgacggtcgccttcaaacttaaaatctgagtaacttcttgggtaaaacttggtttacaaaagctttggaaaacccgatgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgaccacacgggtggaatgggacgcccctggctgagtaaattgctaatcgggggagccttgatgccgagagacatgtggattcgccggggtggtgtcggggaggatccctgggcttcctggcacagtatggtctgggacctaacctgttgttggtctgggacccctctcgtcggcatatggcaatcctgtgtctgctctcgaaatgccttgtcatgaaagcccttaggtcaccagacgtggccgttctacacgggctaggtgatttgggttagtaatgtcgtatgggtaaagtgtaccccctctgcagaggttaacaaactgttcgaacagccgtgcccacggtcatgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggacctctattatcgggaagtttggaaaattggtttggtttgggaaaaaccagatttgaagccaactctgggagttgtgcaaatcgtgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttcagtcagctccgaagatgaagttgaagtgaagtaaagattagggtttcgtcctagttccctgctgctgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttatcaccgtgggtaccagcgctatgtcctgggactggtactgagatcgcggtttcgtaggaagcggttcgcgccatttttcccacgacacgctcctgtcaggtaccgttgtacggcggtgccagattaaaggaaaatcgagggctagatgtttctaatatattaaaacaccgtgtggcgacttaggagcgtttataggagtgccacatgacgatatgagagcgtttataggatgtttaatggatttttagtatataataatagatactgaagcgtccttatccccttaatgtgtgtgttaagtttacacaattttctggagtggtatacacatgctatatgaatgttctcaaatatttcaaatgctatatgaatggtatacacaattttctcaaatactgtttgcaaggtatatggtgaaacgatgggacatcatttgcatattctcccactagaatgcaagcaagcatgtactgttcatcaaacccatacattggataaacatttataccacattattgcatagctttgttagcagcttcttggctcgtagtcatcgcttcaagaaattgtccacctgtgccaagcaaagacctcaaaagtgaaagatcaagtcggcgctaggttgatgcacttcaaacgttctccgcaacacagacttagcagatattacatcctggctccccgaatctgtaaaaacatttactagatggatcttgagaccagatgatggcaagttctcgatcccaacaggtaggcaagtgccaccttgttgctcccaaccattcacataaaaccgtaggtcgagcctctggagcctcggcatggcccccactagaaaggccaggcgaggcttagggcagctgaatgtaaggtccctaagagctcgaaatgccgtgccggcgccagagacgacgatcctctcttttggacattctcgaataccaaggtcaagttggacaagggagggcaactttgcaagaatacaaattccatcatcgccttcaaattcaataggcaccacgcctccctaaccaaaagtaccaagctgtagaggttatgtagctgagaaatccatctggggatcctgggtagccggcaaccatacagattgagtctgcgaagatggcggggtgaagggcacaagtcgctcaagcgatcgaatgacactagaataaaatggctgtccaggtcaaggctcctgaggcagctggaagaacgagatagactttcaagagaagagcacaatgcatccaggcgcctggccacatccgcatccgccaatagaccaatatcgcccaaatggactccgagatgtctcatgttggttagctcaccgaggcactcgatattgttcaccgagtttagtgccaaatccaacgaggtcaaggtgcgtagagatttcaagcttccaatcccatcaggcaacgttgtaccgcaaggaataaccaggtgcaacaaacagggcaagtgaacaatatctgatggaatggctatccttggtacaaatgattcacctagatcaaatgtctccaaatgtagaagctgcctaattttcatacctagcttgaaacatgcgtagtagccacggatctttaagtatcgtagtagagacaatccacatatgccggtcaggtccatcacttctctcatcggaagttcaagatgaagaactcgtaaatgcttcaactccaatagagaaggcctgaaagagcttctgaacactgcgattgatcgaacttgcgatagtgacccaaggattgttgtcgatataatgccatgctcttcatcagcatcgtattggacagaaactctgtggatctttttgtgtgccctaccacgacttgtggatgatctagtacaacaataaaattctcctctgcagactttgatctgataaaatcaagcattatatcatgaactctgcaggacaacacctcatcattgtagtccacctgcacaggttggatcatgctcctgttgatgagctcgttgaagtagctttgtgcaacatcttctgaatctaacccatgggttctactgacaaaaccttcagccatccattgcctcaccaaatcattcctctctatcgtgtggtcctctggataaatactaagatatagcaggcatgtcttcagatgttgaggaagatttctgtagctaaagtccagtatatgtttcatgtcttctaaagtaggatttctttcgaacatggatcccaatgaattccttacatactcccatttcgtctttgattgaccagctagaagactggatatgctcataatggcaagaggcaaacctccacatctttttagaatatcacctgaaatctcttcaaatacttcagagcaagcttctccagtgccaaatattctactgaataataatcttcttgagtctacctcaccaagtggactcatgttataaacatattctttcttattagagcaacaactaatagcaacagagtaaatcctcgtagttgtaagtactctactgccgtgattattttcaggaaaagcacatctaataacattccatgcggatgaatcccataaatcatcaattacgatgaagtatctacaaacatgtgatagtgtaggggtaggttagcaggtattttcagtagaattaatattttcatgagtatctatctaaagaataactaccatccttcattctagaccaaacttcatagtaggtattaacgataagtacaataacatcatttcgtatcaattaaaaatattcattttgtatcagctaaaaatatccattttgtatcagttaaattaaattgtggggtaaagatttctatatcatgcatacaattgttaagtgtaaatgggtggcccagcccgagccagtcccttctccagatttgtagacctattagcctcatttcggtacatccgaaaacctggtaaattctactaaataattaagaaaaataattttgtatttgttgttgtcaaaaatcatcttgacacatcgacgaggcagggccacccaatgaaactccaattggatgagcctcatccaccttttttatatggcttttcaacaactccaatgaatgttatcttcacccataaaaatattttactagtagttgtttctgatgatattggctttacaaacccatcgctacacacatatcctctcaagttaaaagccaatgcactcatcatctcaatggatcctgtttctctgcctgtccaactaaaatgacactaataactcttattatgtagtcggaaaaaaaatattagatggacttatgtgtagaatcaatttctgaacaacctataagaacagtgattttcatagtaaaatacgaaatctgcacagattattaaaaatatacaaaattaggagactagcagcaggaggaaagtacatggtagatcttttttttttcataaatgcacataaaccataatcacaatattattagtactccatccatttcaaattgtagtcatttctatccacgaatagcaatactccctacattctgtccagattcatatatagaaataatacattttgatagggagggactagggagtatgggtaaaatataaaatcggaactttgtagcataccgacacatgaaaaggtacctcttgtcttgtagatattctcggataaccttcagaaggttatctaactcgccaatgtgaagattgtactgccctgtaagttctgataatactttactcataagccttgttatatcagacctctgagagactgacacaaatgctcggcaatgaaaatgcccatccaatttgcggtacacttcattggcgagtgtggttttacctagacccccaaatccctgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggcttcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacagcgggtcggtttatatagagaagggtcacttgatcagggcgcccgcacgatctctactgcgcgtaaccgaaccggataagtcgcgcgtaacttatccggactccacgccgtgtgaatttgcagcaaaacaaaactgcaaaaggaggctgcatctgcgcaagggtgaggagctacgtcgtgcacgcgcgccgcctgccctgccaggcgaggcgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggctttttgtgattttccaaagaattaatcttcgagtgggctaaggcccattcattaattccaacaatcccacaatagaagccaccttcagctgttgctcatcatcacccatcaacaatttgacaacgtcatctcttgggatgtcaattcccacaagatcagctgtgtttgcataaatagtgaccactcgtggatcaattggctcacaactagacttggaagtgtactcatcaagtttgtacctcattcgccgctcgttcacctccttgacatgattcttgatctcttcaatcttcttagcaatttgatgacgtgcccttagcttcctcggaagttcagtagttttcttgataagcccagatctcacatcatacttgccaaggcggtgaacgaaatcatcgatgcaatcttcaatgtcataggacatctccctcacctggtccctccactctttaacctgaacatcaagctcatccatgcatgcgagcttctcaagcagagcctccatgcttctcaactcaccctcaagagacaccacctcgtttcggacccctttgagcttgctgtagcactcctcccttatcagtgtagcgagcttggtgaggagtgagttcatcacgccactggaggaactagccattatggccaactctctctttgctcaggttctctcttggcaaactatatgctcaggaaatgtgagagtagcacagataatgcttgcaggctcgtcttgattgtccagaaggttaattaacttaataatatatttcctcaagatccacgccgtctaaaataatcttacttggagcagcaaagagagcagagtacatgggactaagtaaaaatcaacccactctacttattttagaagcactgggtgttgacttattgccctgaatcaatgtactccctccgttttttaatagatgacgccgttgacgttttctcatatgtttgaccattcgtcttattcaaaaattttatacaaatgcataagatataaatcacacttaaagtactatgagtgataaaacaactcataacaaaataaattataattacgtaaattttttgaataagacgaatggtcaaacatgtgaaaaaaagtcaacgtcgtcatctattaaaaaacagaggtagtatttaggtcattaggttgtaattgttattttatagataactagcatggtggcccgcgcatattacgcggctagcattgttagatttttttctcatataatagcttaaatattttcacattttattattaaaatatattaaaatgataacataattttaaattctgggttgaactaacaaatgcgtgatattttattgtattgtatatacgtgatagttgttaattttgaattaacaaattatattataaattatatttctatatggactcaagagtcagcttttaatattccttatttttaaaatttcgaatttcctttattcatacattctattccaatatagattctagactactcttccaatattcatttttcttaactctaaattttagttatttataaattgtatttttatatggactctagactcttctttcaatatttcttatttttaatatttaatttcaattattggtaaattgtattccaatattgactctagacttctttttcaatatttcttatttttttttaatttcagttatttctaaattgtattcctatatggacgctagacgactcttctcccaatcttttttatttttaattttgattttttgtaattctaaattgtatttctatatggactctaatttctacttttagtttttctattttttaattccgaattttaattaattctaaaatggatactagtctactctttcaatatttcttatttttaattccgaatttcatctatttttaaattgtattcctttatgaactctactttttctttttcttcaattagtgtgaaaatttctaaacggtgagagcaaacgtggtggcttctttttttattactttaataagataatagatagatagatgaatataaatccgacatctatattcgcatgtgggtatacgcaaacaaaggttataagaatgcttagagtccaaatctcataactgagataaacaaatggaaaacaacaaaatagaaaacacgaagcctaaactttgatctttccctgtcgtgcttcaatcttgccccttcgctctgtagcaacagagatgtgtcacactacttagaaactttggtgtcagaattatcttgccaggtacagtgattttccgctgcctgacgaatcctgcaatagaaaattgcacttaggcaatctcgtggagcagccgccctcatgaagctccccaacttataggcggccaaatatgagaatggggagatgcggaactagcccgccgccgatctgtcgtgcctattccatcccattgtcactttggccctgtttagttccaaagtttttttccaaacttccaactttctgtcacattaaatctttcatacacacgcaacttttcagtcacaccgttctaatttcaaccaaacttccaaacttcagtatgaactaaacacagcctttattcttttctaatgccgccagcggcaaagacatttctacaatgatgcacacaaacatcaaattttgagtttaaaaataagaaacttgaaatagaaattagaataaacctctcacgatgaaattgtaggatcgaacaataagagctaagcttaaaaaaaaaaagggtgaatggtggtaacacgaataactgaaaacttttagcgagattaaaagttaactcgaagttaattgatatccttgacacaactgccctgctgcgcctgatagaagcccccttgcttaatttgcacagctgagatagcaacgctgctagcgcatgatgagtctaaatagactcgcatcagaagacgtcgccgatccgcccccaagcgcgaacaccttccgtcgtctgccgtccatcccaacgcgagaagatgcgtcgccgttcctcacaagagtagcaagccagtaagactgtaagagcaagtgagcacgttcgattgttgcttgcttgctttgtgtgattccttgttgctggataatggaaccaattacagtaaatctaattggagagtactctccaattagtcttaaccagagacacccacgtgctaatactttaggagttttggttgctattaatccattgagcaagtagggaaaatattcctatcatctatgcttcaaatataattttctcttaaattactcatccgatttacaatccgattacaccgttgtgttcgtaataattaaatctttacaacaagatctcacataattatattttaatgaaaaatcacaaattacttttatgatatgtctaaattacttttagattttactaagttacttcttagacatataaaagtaaattcagtaaagcctaaaagtaatttacatatattgtagaagtaacttataacaaaaagtaagttacttttagatttgattaaaatacttcctatacattcataatgctatgaggtgattacttttattatttttgtagttaattccataatttatgctgattaatttaatttctagatagagtcatgtttttatctctacaacggattcacttcaaatgacatgctaaagttacctttgttctaagttacttctataatatatgtaaattacttttaggttttactgaatttacttttatatatctaagaagtaacttagtgaaatctaaaagtaatttagacatatcataaaagtaatttgtgatttttcatcaaaatataatcatgtgagatcttgttgtaaagatttaattattacgaacacaacggtgtaatcggatcgtaaatcgaatgagtagtttaagagaaaattgtatttgaagtataggtggatggtacctcttatagatggagtggtagctggtttagacaaactagctaacactagttgtctagttacgtccaaccaattaacctatgatcgatgtgtgtcttcattattcaccggaggtccctcaatttaatagtgagattttttaatcccttaaccacaaaattagaaatatatgcccctagtcagcaaaaaaaatttaaaaagtacgtggagcccacatgtcagttacacaacttttttttcttttcttttcttctccttctcttctctttctcttcttcagtgagtgaggccggcggcggagagggcggagcggcgatgggcgggcggcgggtccgcgcggcggcgggcggcggcaggcgagcacggcctgtggacagaacggaggcgggcggagcggcgccgggatgcaggcagagcagcgatgggcggcggcaggcaaccggatgagcacggcgggcggaggagggggtcgcaacggcggaggtggccgaaaccacgtcagtgaaaccacttttttaaattttttttgctgactaagatgctacgtcagtgaaaccacccacatatactgccatgggacctcctttgaacggtttgtgtgagtttaggggtaacatttctggttttatggttaaggggcctcaaaaaatctcgctgttaagctgagggaccttcggtgaacttattccaattgtgagcaactcgcttgttcttttgaggggctgtgcgcatcaggggcaggcccaggaaccaagccggatgggctgatgcaatctgggcccaaaattcccccagaagaaacgggtattttgaagcccagcccaaaaaatatgaatggatcagcccaaggcttggcctgatagcaattatctgttctgaattatgacggtcttcacgtatgccaaaagaacccagattggaaatgtgtgcatacaaaatatctaatgatcattgaaaagtgaggagtttaattatttattactttagaaaatagccactcttcaaatgttttttatggacacaactacaccaagagagtgctagctggatagtgttaaagagagacatcatttttttcaaaaaaaagctactattacactcaatatctatgtattttttttcttcttagagaagtttctcttaaattactcatccgatttataatccgattacaccgttgtgtttgtaacaattaaatctttacaacaagatctcacatgattatattttgatgaaaaatcacaagttacttttatgatatgtctaaattacttctagatttcactaagttacttcttagacatataaaagtaaattcagtaaaacttaaaagtaatttacatatattataaaagtaacttataacaaaaaagaaagtaactttaatttagaactatacctagattcattaacatctatataaatatggacaatgctaaaatgacttacattatgaaacggggggagtaactctctgtagtagaaataattatattgtgagtgagctaaaataagaaactatgtagagtaaatttgcaagtaaagtgtagagaagatttataaagtccaaaaaaatatagaattaactaaaaataataataaaaataatcaacttagagcattatgaatgtatagaagtaatttagtcaaatctaaaagtaacttttatatatatatgataaaagtaacttgtatataataaaagtaatttacaaatataaatgttttttcatcgtaatataatcgtgtaagatcttgttgtgaagatttaattgtaacgaacacaatggtgtaattggattgtaaatcggataagtaatttgagagaaaactttataagaaggaagaaaaagatacatatgtctaagagaaaaaacagcacgcacatcagcacgtgtagcagtaattcttctcacaattggttcgtcgctggttaacactaaatcgagaggcttcttggtttagattttaccgttttttatacagttgttcataccattttatcatcggagaaagaagattgcttaaacattttcgtctacgtggcacaacacattgacgtgctagagtggacgctgggcagctgcctccataattttcttgccgtgccaaaaaaaaaaaggaaagcgccatatatttctctccggtaagaaaaacatagggaccatacaaaagctggtactaacttccaaaaacaaaggtatctatccacccacctgtgcgccaacaacttagattcagaaaaatacataaaaggaaacgaaatagcaacagatgaaaacaaaaataaatgcagcgcacgagcgctgacccagcatttgcaggttgcagctggatctgtagctgtccttttgttgccatcggtgaagatcgagtgatcgacatatatatacttcattcacacttccagacagttaacttttaagcacatatttaacttttaagcatatattgatgattcgtcttatttaaaaaaatttatacaaatataaaatttataaattatttttaaaatactttaagtggtgaaacaactcacaacaagataaattataattacataattttttaaataagataaatgatcaaacatatgaaaaaaattaaaggggttacctatttaaaaatggaggttgtatattatttttgcagttgcgattggagctggcatgaagagagagacagtgcgacacaagcgcgtcgacccgtgttgtgttggtcacatgtaccaccaacgggcaacagcctttgcacatgcacaaacacacacaccaccccgctggcgcacatgcactgcaccctgttgccgttcctaacatgcacccccattttcatacaatatccgtcacataatttggtactaatacgttttctctatcacttgaaggaacatgtggatctaatttgctataattattatgcattttggggttggggttgtggtcgtgattctttgttgtctcactttcgacagtcaacttatgcttatatacatatgtacgtagtcaccctagttaattgacatgctgaaattcagcacgccgaaatattttatgaatgcctttattttctttttgaatgattgtagttcttgtgaagctacaacttaattagccttttgttttctcaaactaaaggttaaagtatcgatcgcataatgctatcacatttttctcaagtagattataatattagtataattgaatttaatgatacaagcttgctagtggaattaattggtgttggagatatttgcccccaattcttcttttttaaaatttttatgcttcaattttaactcatacgaagagaggctcaaatgtatacgattgaactcgcgagactacattggatagtcttaaatcatgtatacattggttttatctggatgggcgcaagtggaagtatccaaagcatttcttgacagccactgtttctgattaaagatacactagattttatctaagaatttttattaagctttgtaagatgaaatcttatatatgtaagtcactgtggaatagtttggtttggtgccctactaattcattggcaattttcaattgtgttttagttatttggattggtgccaaattttaacaacacatctcttcgataataaaaattttgcctatccaaatttggtggtgctaaaagttgcccaaactttggcactaccaagattttacggcaccaaaccaaactggctctataaacccttttttaaatttgaaataattaaattttaattaattatgtgctaatgattttctcctttttgcgtgtcctgccaccctccctcgaacgatctaacggccagcattcgatcgatctacctcattggggtaacccaaaatgaagcttaaatccaatcctagccgttgaaaatccgaattgttgttgccgttataaatagtagtagctccccctaatttgacttttctctcccccgttttccttctccatttatccgcttccgcctcccctctctccctgatgcacagatgaaccgcgtgccctaatcctctccgagattagtacctatccgaggaaatcgagggttggagcttgggattaagattccgcctgtacgaatcgaagtgcgcggctggatcggtgggggtttcctttttgatttgttcgcttctctttgcgtgtttgatgtggcgattcttgtacggattggcgtcttgatctggtttggttttgggaagattggaatctgatgattccgctgtttgttcatcagatttcccattatcttgtctgtttgatggattttttttttacgttcctggagcaaaatctgatttgaattagatttttgttttcatgcccgtttttagttggtctatcttgagcatttcttctgagtattcaatgtttcgtccccacgaaaattgtcgtgtttattgggaattttttgccctaataattcgatttttgcacatttgcggtgcttcccagatgagatctgtgcctggcgcctcaaaattttcgcaattctgtttgacgttttgtttcattttgtttccgcgcagaggttgagcacgccatgatggcgaacgcgaggtttcagaagcaggcattgctgccgccgcggagcccgttcccggcggcggtgggggcggcgccgtcgccgtcgccgcacgccgagctgggcccgatcgcgcggccgcgggacgcgccccaccggcacggccaccagcgcacgtcgtcggagagcgtcctcatcgacgagcagccgtcgtggctggacgacctgctcgccgagcccgaggcgccggcgcggccgcacggccgccccggccaccgcaggtcgtccagcgactccttcacgctgttcgacggcggtgcctccgccgccgcggctggcatgtacgacaatgtgttcgatggaatgaggggaagaggtggaggaggacagcaggttggttcttggggtgccgcaccggagttcttcccggaacaaagctcgtttgggcggccgcaagggcaggggggccggccatgggattcgagactgatgctccgacaaggtggtggtggtggcggcggcatgccggtgccgatgaatggtggccatcatggtccaccaagcgcatttggtgatcatgggcatggttctttgccgaatggggtggacaggaaaggccctggagattcagctcatgatcagaggatgggagcagagaggaaagagggtgcacacctaaggcactcccaatcggaggcagacaccaagcgagctaaacagtgagttcgattttattccatgctcattgctaatttgctatcactttgataatcaaagtttgattgaccagttgtcgaattccatgctcatgaaacaccaattctgataatgaagcttgcatcatgaatccgtgattggaatagcagaatgagcctttgatacactgctatcaaatcacctctagcccctggttgaagcctacactgttaacaacactgttgtggttcaatgttttgtgactctgcagggcgtatctagtggcgatcacaacatggttggagattgaattaatgccgaagatattagcttgcactctatttaagtaaaagtgacctgtaaactttatatttctagtcatgatgcatatgtaacacacattaactcttgataaaagcccattttctacacccaccagtagagtgcactatctttctaatttatgaaagttttttcaaaattttaatagataaaaaaaatcgaagatctttaaggaatatcatcgaattactttcagtaaattctttattttcattttaaagtatgcataacttaatacagggaatctatttgctatttaattccaaaaggtatccccgccaatcttacagtatgataaaatcttctttggagaaaattttacaagtattttcacttggagtttttattgactaactacaaaaggttcttcagagaaatctgatacatgttttatctacaatagagtatgaagaacacaattccgcatcatgatttctgttgatatgcttggaaatagctactttgggccgtctttgattgtgttactcacctgtgatagtaggtttaatgttaaaggtagaattccctgtaaacatatggaagccacagaaacaacattttttaacctacaatagaaatgagtaatttatcatcaaattagaaattttcttgtgtagttgcgtagataaacgacatcaagaaacaataataaaaagcatactgctgttttatatgtcctggtgatcacatgctgtctcaatctacgtgaaaacgcaatggtaatacttaccttagtaattagcctctgttttcaaggcaaatcatatatatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcaccctcctagtctaaaattcgaaatttgaatgggatgttgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcatgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcactcggatgtgcttgctccgttcgtgaaaaacggggttcattgccagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctgctgcttgaccgactgccaactaacgaggcacttgccgaggaagaagagaatcccgctcgtgctcttgctggtgtcgatgtcgccggcgtggtcgctgtcgctgtacccgacaaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgttgaagcatgatcccggagttgtcctggtgcacttcgatccccaggtagaaggagagaggccccagatcactcatctggaaggtggccttcatctcctccttgaacgccgcgacctccgcatccttggtgccagtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtctatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggcttcggcttcatccctcttcagcttgaacacccacttaagggtgatcgcgcggtgaccatgagggaggtcagcaagctcccaggtgcggttctcctgaaccgcgtccatctccgactgcatcgcggcacgccatgccgcgtgtttctcggcctctacaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcatcggagtagacgtgcttggaggagtggctgttggtgctggagcatgtggagtcactggctggggtggtgtcgacgaagagctcgtcgtagtcgaagtcgtggcccgagggtgtgttggtgttggagtcggtggagattcgggggctggggtagacacgctaggtgaagaagagctgcctactcccccagctccctcgaagtggacgtactcgacggtgaagtcgtcgtacgtcggagtcgaaccatcgtccaccgccttgtcccatacccaccccctcgcccttcatcgaacacaacgtcgcgcgcagtgcgcacacgctgtgtctccgggtcgaggatgcggtaggccttcgagccctccgcgtagccgatgaacacccctggggtgctcctgtcatcgagcttgccaatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcaacgacgccgttctgctgcgggctgtacggcgtggtgtagtggcgctgaatgccctcatcagcgcagtacgacgcaaattcagccgctgtgaattcgccgctgttgtcggtgcgcagcacgtgcagcttgcggccgcactctgcctctgcagcagcctgcgcatgcctgatggcgtccgcagcctctcccttgctgccgaggaccatcacccacatgtagcgggagaggtcgtcgacgagcagtaagaagtaacgtcgccctcctggtgtggccggtgtcactgggccacacaagtccccgtgcacgagctcgagccgctccttggctcggaagctcgtctgctggggaaaggggagccgccactgcttcgtcaccacgcaaacgtcgcagagctgctccatgtggtcaaggcacggcatgcctcgcaccatctccttggcaccgagctgcttcagggcctcgaagtggaggtgcccgaagcgctcatgccactgccacgcctcgtcgtcccgacgagcggtgaggcaaactggttgtgcgacctgtgcgctgaggatgtagagtcgattagtgtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcgatgaagaactcccgtcggccggtcatgtgatgggtggcgccggtgtcgaggtaccacccatcagccttgtcgttgctggagccgttgcagagggagacgagtaccttcggctcatcaaggtggaggaaagccgttgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcacccaccgtagctggacacctccccgcgccttgcgcggcttacagccgcctgtcggggaagatgactcccccttccttccgtcaccttgagaggcctcccactgctcccgagtgagatggagcttcccgccgatggtgatgggccccgagagaggctgtggctcatcactatcgacgaccttgaggcgacctaacgcctcctcgatcgtcatcgtggagaggtccagcagagattcgatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttttgggaaagcgagaactgcatctcgggcgggattgcagcgatgagggcatccagtgcccgccgatcctcatcgtagtcgacgtcaccgtaccggactgcctcccacatgtgccgcacctggagcctcaccctcatcaccgcggcctactcgatgtatttggttttggtgagggtaggccacccaccgccgggaccaaagtccctgaccaccgtctggacgccgtggtgaccatggcgccggtcaggggagagagagccgtgctgcctgcgagggccacgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagttccctgtcggcggtgatgtcgccggcgatggagccgttgatgctgctgcgcaaggtctcaacctctacctccgccgcacgtgccgcatcttccgccgcctccgcctccgccctggctgccgccaactccgctgccgccagtctagccgccctcgctgctgctgcagcggtctgagccgttgctcgcctgcgctcttctgctgcggctagctcggcgtcttgctgacgccgagtgctcgaggcgaccaaacgccgagactgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcacccttctagtctaaaattcgaaatttgaatgggatgctgtcctagagggcatccaaactgaataaagcataaatgaggcataaaggagatgctaactgctgttgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacaatatagataacgagaacccagtactgtaacagtagtagtatagtagatccttgctgtgaaattatcctgtgacaaaacaatacatgctagaaaaattgatcaatgttttaaaaaggagtaagtggttttatgcggtcactaagggtgcaagcgggcaggcccgcgaacccaattatagtacaaataagcggttaccgcgtatttgttctattagtggcagaaatgtagtagcagcgactgcagcaaagatctgctgcattctgcacttgagggattaggatgctcccgaaggcaacttgaccctgcgtactgtgttcaatgcccggaattgtctgaagacatattaagaaattcgtatggcaattagagcaaactaataaggaaagtaagagccgaattaaatcataggagtaacgaagctcaacaccgtcgtgtgaacaaatttaagttttttcaatggaaattaaatgaacaccatgatggtaacgattatgttatatcataattcatacagcagaaactttccattcataataaaaacattaagcagtgctttatatatgggtagaaataaatattaagagcaaactaattgctcaggagggatttaggggtaactcttaatgtgagccatgtgatcaaataaaagtgatggtcaggatagtagtatcaacctaatagttaatgcaccaattcaaaactcgtgctttttatatgttgaatgctcaattgcatatggccaatctaaagtttgtttgaaatctttatcagattgaatttaccctgctacacagttgcctttacttgcaatttgtaagtctagtacatccatcaatccctgaatgcacacaagctgcatatctgcatgttcaccaaactctctggtgtcaaaacatcttatgttgacagctccattgaaaggatgaactatttgaatcaattcttgacattatgcagagtttactggtatatcttgaacatcatgtcatatgcatttaacaaattgctcccaactacccatttcaggcagtatgctcagaggtctcgtgttagaaagctccagtacattgcagagctcgagagaagagttcaagctttacaggtgaccttattgcaaggaactgttttaatgctttcttgtacaagttcgctttgccttaatgtttaaaaatggttgtttcaaatgtttgcagacagagggtgtagaagtttctgctgagatggattttcttggtcaacaaaatatcatgttagatttggagaataaagccttgaaacaacggcttgagagtctatctcaggaacacctaattaaacgctgtaagtatgatatctcccttctatattctttcacacgagtaattttattgcaatgctttcttttgccaatcgatgtttttagttctctttctattatattagagtgaattatgatgttttcttctgatttttttaaggcctatttggtttggaaaaaaaaataaatttgtgcatgtgtagttaatgttgtttcctctctctctcacgtattgattttattatctttctgagcattcccgtgtgactaatcacagaaaaagaatctatctcatcttaccaaagaacttaatagaagggtactccacgctttagtcattctctttggtaataatactttatatcttataactttctaaatctatgtgctggtcctgccggatcagaatgcacactatgtaaatcgatggagggagtatgtgacaaccaaaaatcctctatgccatcttacaatcggtgcatgtatcatatcaaaggctcataacctgagcatgatgtttcaacagaaaattacaatatttccaccgtagcaagaaacattgagattatctggatattttcttttgaatgatagtaaaccagttgcattgtatttcttcatcaagttttaattttgaaattgttctgattaaatgactgatcatctgaactcctttctacagttcaacaggagatgtttgaacgggaaattggccgtctcagatcattgtttcagcaacagcaacagcagcagcacataccacagcagcagggtcctacccacagtcgtagtaacagcagagacctcgattcgcaatttgcaaacatgtctctaaaacacggcgatcccaactcagggcgtgatgctgttccaggccttcgcatttaggattcttttcccccagcttatgattctgtgagtttcacatagcttcgctatccctgtcataccactatttgtggtcattagttgcatcaggaggggagcagcgacgatgaacctggaatcacatccaatgatgaatagagctggaaaggcttagtaactatggatccaatccttatttcattctgaatgtgcacctgacggtcatcctcatctcatatccattgttttgatgctagaccagtcggaggtgtttagggtctatttgcagcttgaagcttttcttgcttcctagtcagtttgaaacaaggttctaattcattcattcagtctttgtttcatttgttatttcaaatccgcattattacacaccatgtgttgcttctaatagttcggcagccggcacacaaggacatgagcagaatgtgagaagtgttgagattaattgtcacgtcttggagaactgtatgcagcacatccaataaaagcttagtgctgttgaagcatgttgtagttctctcatgtctttgaactgtgtattgactcctgtaataccaagttaatcggaacgcagtgtcatatctgataaggcacgccgtgttcatatgaaaaataagctgttatatatctttttgggcctggaagtatgctatcacttaatttactttagattgtccccttctatctgcttgtattctgtgtcacgttgggtgataatgttaatcgccgatctactatattaatagtattgtgcgacatttcgtctagattggtcccatttcactgctgacttttttaaactgctcatgattcaagttaaacatcagttagattatttgaaacatctgtggtttgatgaagtttttcgcatatcggagtagaatgcttagttcaaattaactgaatttagaaccacagaacaaaagagagagaaatgatctaagctgcaactattggttgttccagctattggtataaaaccttgaacttcaaatactagcaaatggttgttgctatgaacgcaaactagtattaagataataaataaaaattatactggagacagtgaaacaataggttcttggcagtcctgtcgcttttatccgtagttgattttaattcaatgttcatttgtaaaaaaaatgttatccaggcaacatacatcgctaaacaggataaatgaccgagatgtccattgaccatgaaaactgaagtatgaatgcaagtcccgttgtgttataatagcatttcttacaatggatacagggagcattcatatcaaatagaccaactaattggtcgattacatagaaaatgtctgggcaaattgttgccatgcagcgaagaccacccagaagctacttctttttgttctgatcgatgttcatgcctgtaggattgttctgccgaaattgagtcactgcagtgtcaaatgtcccccttacatgctggcacatcaccatcaaatcctgcaaagagtctttcagaacatcctttgctgggtctcctgccaacatatacatcatacatcaggaaggcatcaaagatcaaacatttgtcgaaggcaatggtgcagaagagttttaaattgtaaaatgacagggaagaacaatagccatcccttcgatatttggaatatctgctaataatttggagggaaactactaatacaacaacattattcattaataagattagatgtgctacacattcaaccataagaacagaagctgtactatttagttataattgctctccacaataatataataaatatgtacacaccagctgatacacatgactgagtagtcaaaaaaagaaaaaaaaaactgtttggaattcttgcagcttcatgcgatgaatatatattccattatacaaagaaagtgaatattgatataatcatataaggcccattcaatatgcattgacaatcaaaagaaatgggacaattttgatcacccactatatgatagtacctgtagtctgaactcttatgttgactttgttgtcagcaggatgagggatactgtatccacagaatgctacccttgggctgtaacaacataaagaagagataattacaatgagaagatcttatacatcaggtttatacccaattcattgaaaaacacaagttaattttgaagattgcaatgattactatcgttgtctgaagcctgaaccattacctaaaaccttatttactattttacttattgagagctgatccaactacacataatgcaatacctaattaacattccaagttgttatttgttaaatatgcatgaccagcagatattatatcatttcctatggtacctcaggagttgttgtttgctgctattattatcaaatcaacaaggaacatgaactgttgcatgccaaagattaagctatcaatcaccatcatacaccagaaaatatgcctagttatgataaaccatgagaaatatgtttaatttactgatgatagcctctaagaaacatcatttcatacaaaaacatatcagggatgccccaaagaactaagtttcctaatcagtcaaaactcacaagctgccacaaaacatatccacggaatgctacccttgggctgtagcaacataaagaagggacagtcacaaagagaagttcttatacatcaaggcttactcaattcatagaaaaactcaagttgattttgaaaacagcaatgattactatagttgtcttaaaaaaaaaacttatttacttattgagagctgatccaactatacataaatcagtacctccttaacattccaagttgttatttgttaaatacacaggagcaacagatatcatatcatttcctaggaagcccaggagttgcttgcctgctgccattattatcaaatcagtaaggaacatgaattattgcatgcgaaagcttagctatcagtcaccatcatacaagggaaaatatgcccaagttataataaaccacgaataacttattttacttcctgagctatctctaagacacagtgaaataccatttcatacgattttgctaatgagtcgcatgcacccagatttttgccatggattatttgatcaatgctaaaatatgatttctcaaaaaaaaaaaatcttctactgcattgtttagaccacttgttctaagctatttatgaagtttatttttcaaaatattaacttattgcattaatcaagcaaacaatccacgtcaataatccgctcaaaaaactgtctccaacaggacctaaaacggatcagcaattccccaaagaagaatcgattttcctaaccagtcacaagcagccacaaatattggcgagaacaaatagttctttacgtctattttgtgttatattaattaagttgtagttgcgagggaatacaagcaactcaacatataattctgcactcataggaggtaattcttattctagttctgagtgttccaatctggatttaaactaaacaatggtgtggatttttggttattacattacacaaaccccagttgctccaatctaacaactcagcaaccgcatcaaaatatctaaatttctacagtacgaacaacttcgactgcacttcaagtggcaaccacaatctcttgatgtcaacaccacaaaatctaaaagagtcttgcttggttaacacaaacacatctattaaaggaggaacttgtacgcactcctgattaagaacaaatctaacggagttggcgagcgtgtgatcctcctccacgatggagaacgtcgaggccgtcgagtccgtcaccgacccatgctccatgatggcttctccttgcctacaagaagcaaccaaaaaaaaaaagaaggttcatgagagctaatccaatccaaggaagcccttcaccaagaaaccaggacaagaggctagcgctagatttcgataaaaaagaggatggatcccccaccggtgggtgccgcactgcgccggcgggtcggtggcggcgccggtggtttggggagggaaagaagcggaggggaaggagggaggggaaggagcgatctggggaagggatggagtgggctcggatctgggccgttcgattgtagggtgataaatatgagccgtttgatttgtaagatgtaatagtgtaagaacgagagatgaggtggtgagcgtgcagagccctcgcagaaccctcactctctcatgccgcaatcaccatgagcgccgccacccccgactccgccgccgccgccaagcgccccatcgacccctcccacgccgacccgtcgccggcggcgaagctccagaggtcgtccccgccggatccctcgccgccggctgaggcgcagggcgacgccactgacggcggcggcgaagtggctggggtgagaagcggggagatggccggcgcgcggaaccctcaggcgcagcggtacctggtcgccgtggagtacgtcggcacccggttctccggctcccagcagcagctcaaccagcgcaccgtcgtcggcgtcctcgaggtgaaatgcttctaatctgagctgtggattcgaaatggcgaccgtaatctgcactgctacggatgtccctggtactaggtagctacacaaattttctgaaatcggtaggggcttggggcagatttacgaaggatgaaagtccatgagaatatgaagcatgtatactcgtcttttgctggtctaactgaatcgttacacttacgcggatggcctgctaaagttttagaaattttttttttgcatcaggagatttgacttatttgttgatgactagtacccaatccgtactgcaatttgaggttaatcattcccaaatagcaagtacattcagtagtaactgatatatatgcctgtccttgggtaagcccttggatctaacatatgtttggaatgcataggactaatttgtgaaagtaaaattggagccacgttatttttgacctctcgggttttgagctagctagtagcttcgcttctgttttgctctataatggatgaagttagactcagtgcaacagtaggaaattctatgacatttgtaaatctacacttgtcatgttatatgatcctatacataagaacaactgggtgatgcttggttttagtcttgtaatgggcccaagtgtagtagtcaggatgcaaatggacctcatgtgctctggtgatttgtcagctttgggttatcaagtgggtggtaaatggcaggggaaacgttgtgcagagtacgtcatgactgtggcgacacttttaactttggtgttctggagccgttcgttatgaaaccaaaatttcctaacaagcctcaaccataatattgatacaatcaaaacattggcaacattttgctttaaataaaagaaggcattgttattttcttccgtttctgaagtgtgatcaaagttaagccggtgaaagactatgtcttttatagcttagcaacttttagtggtttgtatgctgagggacactaaagcgagcaacaacagaaatatacccttgaagaatttccagggtgcaggagttacaggtagataacacttgctgctttttaagagcacttgcactgattgaccactttgtcacaactcacaaatgaatcaaatattttccttggaagtcaaatagataccttgaataaaagtatgagtttgtgctatccagggtctctagtgaactagaagatatactccctccgtttcacaatgtaagatcttttgactttttccaaagttaaacttctttaagtatgactaagtttatagagaaaaataacaacactttcaacataaaacaaatacaatatcaaaatattgtatttaatgaaactagttttgtgttgtaaatattgttacatttttctataaacttggtcaaaattaaagaagtttgactttgaagaaaaagtcaaaacatcttaacattgtgaaatggagggagtattaggattagtgttgttatcctgcatcttaaattgtttgcgtttagtctcctttgtgtgttatctatttgagatattggccttttggcttacagtggcaatgcatcagttacttttcctacatctttcacatggtattagagctgaattctaaaccgttgaatgatcgtccaacagcaacccacggctactaggagctgtagctcccacggtagtaccaaatctgttgctttttctgatctgtttcttgtcatgaaaatcactttgagatctgtagtggaggctacatggcattgttttccccaagtctgtggctatcaacagatttgtgacctggcgttgctgccataatcagcagtgtgtttgtgttggctctgcttggggtttagcatcttaggtgttagctctgataccttgtgagagatttagagacttggctgttgcgttacattgtagcccagtaggccaacatgtctatgtaaagggggaattgatatcttgacattccacaaaataaattggcttcgattgtttgcaatcctggcccacatgccattgactcagttccgcatgtcattgtcacagtctcacagcgtaacaagtaacaacataatcaaagtggcaaatcaccaatttttacacacaagggattaaagtagaccagcatgtcagtgttagcaaaaggaacataggtttggagctagttctttatttccatttgccacactcttaacatggctggttgggatacatatatcaactagtggcttacaccataaggcaaagcaaatagcttacatcctaaggtagctactagtgggcttacatcctaaggaaactactagtggcttacatcctaaggcagctaactattattccaaaatagatgttaaaacatatggtaaaaacaagacttaatctgtcattatccccctaagtcttgtgtggcaccttctggggaatttgaaccattccaatcctggcgcgaagctcttggaacttgacccgcccaagagacttggtgagaaggtcagcgagctgatcctgggtgttgatgtagctggccttgatgctcccctcgtccaagcagctccgaatgaaatggtacttgatgcggatgtgcttgctgcgctcatggaagacgggattcttcgccaaggccaaccttccagatgagcgacttgggccttctctccttctacctggggatctcccttcgtcagaccgcctacgccaagcgcatcgtcgagttgggtgggctcaccggctgcaacccagcctacactctcatggaggaaaggctgaagctgagccgtgacagcacggccaaggaggttgatgccacgcagtaccggcgcattgtgggcagccttcgctacctcgttcacacgcggccggacttggcgtttgctgttggctatgttagccggttcatgcagcgaccgatgacagagcaccagcgggctgccaagaggatccgccgttacgtcgagggcaccagtgactacggcgatgtaagccactagtagtttccttaggatgtaagccactagtagctaccttaggatgtaagctatttgctttgtcttatggtgtaagccactagtctatatatgtatcccaaccagccatgttagagtgtggcaaatggaaataaagaactagctccaaacctgtgttccttttgctaactgtcagggccaccagccataattttactttaataacatgccagtttcgcctacatcttgtgtttcagtcgtagactcgtagtagcagagcaatttacagaacaacatttagggagttgcctattggctgttgcagtgagacaaatggattatttctatgattccaggctttcttttaattcagatgatcggactgcaagatgaaataatctgcctttgtctaggtggttgtacacagatttaattaaggtctagtatttaagacaaaggaatggcccagtatttttctcctagaaatggaaatatacatttttagttttgtttgttaggatcatattgaaggcaagtggctactaaagaacggatgctgaattggctgcagttaaataatatgaactctagtgatttttcacaaagaaaatatgtgacatcaagattagttccatactcttgttttcgcttggtctcctttgtgtccaatgtattctagatatgccttttggcctacaatagcaatgcatcagttacgtttcctacatagttacatggtatcagagctgaaatcctaaaccaatgaatgtttatccagcaccaatcccctgctgctaggagctgtagctctcggggcagtacctaatccgctgctgatctgtttctagtcatgaaaagcactgtgatctgtaagtgcttgctgcatgccatggttttgcccaattctatggccatcgttggattcgtgacctgacagtgatgcaataatcagtgatggatttgtgttggctctacttggggttgaggatcttagctgttagctctgataccatgttaactgtttagagacttggctgatgcattacttttggaaaccatgtaaagagtacatgtgtacacataagagactaaagcaaaccaatgtgttactaaccctaatttattttgtagtagcatgcacgtctcatttgcatggggaattgcctataggctgttccagcagtacagatggattacttttgtgattcctgggtttcttttaaagttgagttgatagggcactggcaatattttgcacatgaccaaacagccccttgttattttctcccgttcctgaagggtgatcaaagttaagccggtgaaagactaatgtcttttttagaggttagcagcttttagtggtttatgaataccatgctgagagacactggagtgaacaataatagaaatatgtcctttaaatattgtgagggtgcagcatgaaattgctgcttcttaagagcacttgcactggtttgccacttttaccacaactcataaggaatcaaatgtttcccttggaaatcaaatagacaccttcaagtatgagtttgtgccatccaggagctctggcaagtggcaaacccgaagagccttatgttgtatcatgtgttaattatatatgaggatcagtcctgtacttccaagttattttcttttagtttcctttgtatctatgtgttcttgttggccttgtggcctacaatagcaatgcattggctatgtttcctatgtccaccatttggtattagagctgaaatcctaaacctttgattgtttgtccacaccaatccactgctgctaggagttttagctccaatggcagtacctaatctggtactgatctgtttcttttcatgaaaagaactttgtgatctgcatgccatggtattccccaagtctgtcgccttcaacggatttgtgacttgacattaatgccataatcagcagtatgtttgtgttggctctgattggggtttaggatgttagttgttagctctgataccaattgttggacctagagacttggctgacgcattactattggagcccaacatgtctatgtaaagggtacatgctacaacatcagaaactaaagaaaaccaatgtgtcagtgtcgctaatcctaatttaccttttatcacatgcacattccacctacatggatgcgtttgagttctagctagcagagcaatttacagaacaacatctgcggtagttgcctatatgctgttcactagatggacagatggattagttttgtcattccaggctttcttttagttgagaagatagaattgcaagatgaaataaactaccttttgtttttttcttgagataaacataaactacctttgttgctgtacacactacacaaaggtttaatgttgttctagtatttaagatggcttagtattttgtcctaacaatgaaaatatacatgttcagtttctttttgttaggatcatattgaagtcaagtgactactgaagaatggatgctgacttggctgctgttgaataatatgaaatctagttttcttataaaaatatgcgatatcaggattagttccatattcccatgttgtttacccttagtctcctatgtgtcctatgtattctagatattggccttttgtcctacaatagcaatgcatcagttatgtttcctggatcattaaatcattgaatgtttatctagcaccaatctgctgctgatctgtttgtagtcatgaaaagcactttatgatctgaaagtgctggctgtatgccatggttttccccattctatggttattattgcaatcgtgacttaatagtgatgcaataatcagtagtggattcgtgttggctctacttcgggtttaggatcatagttattagctctgataccatgttattgatttagaaacttggctgatgcattacttttggagaccaacatgtcgatgtaaagggtacatgtgtacacataagaggctaaagcagaccaatgtgtcactaaccctaatctattttgaataacatgcatgttttatctgcatggatgtgtttcagtcctgggtagcagagcattttacagaacagcacatggggattggctaatacaaaattacaaatggattactttgtcatttcagtctttctttgtataggactctaggatatttacggaaggatttaattacagttattaagatcaagtgacccagtattttttgtcctagctgcaacaacatacatgttttgttttgtttgttagtatcagattgaaggcaagtggctgctgaaaaatggatgttgacttgttgactgcagttgaataatacgaagtccagtgctttgttaaaagataatattatcataaacattgtcatttgcaaaatgctcctcttattgttggaatgactagtcaaataccacttgatagattacttctacagcctcaacttattactagttgtgaaatgttaattgatgctaaatgtagttcacacgtcacacccatgcttttgaattatttcaggaggcatttcacaaattcattggtcagccagtctcaatcttctgttctagtcgaacggtatgtgaacttgttttattgcaatttcttctttttccttctaggtcagtatttgccttcagtacagcatgttttcttttactatttgaatatccattatcttgtgatagaaattacttgtggtctcttgctgactgtcactagtgagttttttactacgtaaacatggatacctggtatagttgtaccaacaatcgattatgtaatatgtatgtcagactggaggaattttggatcaatattgcatagcataatagatgtaaatagtggttaagatagaatagaattaccaggatcaatccaggttatggtcatagaagtatgatcaaattagtggagaggttatgccttctattaaatcaatgaatttatttctcacatctttgcaacatgctatgatactcttagtttcctgcaatgttatggcatactcatatgtattgattagtgaatgacttatattctggttcaggacacaggtgttcatgctttatcaaatgtttgtcatgttgacgtggagcggataagtaaaagaaagcctggtgaaatggtatgtgtccacaaactttctttccttactgggtttactcccaatactttttttctgcattttttggtactcaaaaacttattttgagtcttcaaatgcaactttgacccccccccccccagtcttctattggaatatatttttaaaacccattagaattataatattatgaaagtatttttttgagacaactctacattatgatttgtgtatattctaaatctatattgattctcaaatgttaggtggcccttggatgcttatctaaaacaagcacatatgtgactggactacatgataatttaggttgactgctgtaacatccatgttagaatctcactatatgcccccaaaccgatttcataaatgaactgtttttccctcttgacttgtacctctttatttgtgtaaacaaaaatatgttatgtagaacatctgtagccctgatgaccttcttgtccccatttgcagttgccacctcatgagcctggagttgtaaaacgtgcagtgaaccattttctacaggcaagtttttgacccaatcttgttatagtttcattcacctacaaattgtcagtccactttctctatagaagttatcatactgtaccttcgttctttgttttggtgatggcacacattcatatggttgatttgcttctcagtaatttgtctatgtactttacatctttacccgtttattgatggtgttatttccttatctgccattgtatatttatttttgcttcaccattttcctcgcagaagaatgaaggtgacataatggtgactgatgtccgttgtgttgcaccagacttccatgctagatacaaagccctagagcgcacgtaggtagcaaaatatacaatacaataaagggattttctcatttgctcttgttgttatacttgttccattcttatgtccaaattattttatcacaagcagcaataacccaaaatattaacatgctgtagtttttttgaagtaaatgagagaaaaatgaagcctgcttaaagaccagcctttctgaaatattggaaatgcttatatttttacttatgttcttgaaggtaccactatcgtttgctttctggatctgagccactatcagtttttgagaaaacctctgcttggcacatacccgaggatttaaatgtacaggcaatgaaggtgaagttttcttccatcattatttcctgatacaaaaattatattactgggtttactgatgattcatgttcagaaagcgtgcagcatacttgttgggcatcatgatttcagttcatttcgagcaactggatgtcaggtggtgtacttacttcttaactgctactcatttaaacagagctttttgaagaaatgcaagtatagtaagtcaggagataatcatagagttggagcattacatttggacagttgaacacagatttccctaccataagtgcatttaatttttcccctgcaatttgatcgagaacaaagtggactctgcagaatgcaaactatgaatcaagttaatttaattatttgctgaactatataacccatatttagaattttataattgatactttaacggaaacaataaacatttttcctgttttctagcgttttttggattttagcgtccaccttgtttacatgaaatttgattttctcttggcaattattgtttacaggcaaactctcccatgagaactttggatgagcttagtgttacagaagtatttccttccatgttttttccttcaagcatggagcgatcagagatggagtcattagatgggcatcttgtttattcaagaacgtcagttgtggaatcttctggaaaaggatctgatgcttctagtacaagtgagcaatcaagatttgagaatggagaagaatttggaaagaggctaaggcatcgttgcttcgttgttactgcacgggcacgttcatttctttaccaccaggttaattcatcttccatgaaggctaacttcagagcctagggatttacctggttgattgctgacttgctaaatcattttttgactgcctgtgtgggtgcccttgattgattgcaagttactctaatgatgttcggttcttaattcccatagtgttaattaagaacatatttcgtggtaatttgggaagtacttgtgttttggagcggagttcaacgcaatgttcctgggaaataaaaaaaaagtgtctatttctctcttttatcttcaaagttcaaactgttcatgttgtggagccttaaacctctgaaaaatgttttgatattagctgtaacgttaggcatcatccactttaactctattttcttgttggttgtagataaatgtgtttgagcaatgagcatgtaagcatttgctattactaggcaactttatgtcaccattgttggcttgttgccattaattgattattggatgatgctacccttcctcttctttttggtcatttggtatgttttttatgtcttctctgatggtgcaggtaaggttaatggttggtcttctaaaatctgttggtactggagatctaacaactgaagatggtctgttttgattcctttaataaaattttcactgagtatcttttgtgttttgccttttgctccatagattgtgaaatgatgtgaacgtttatggtctttgatgcagttgagagaattctgaatttaaaggcagtgactgcggcacctcctatggcacctgcttgtggtctctaccttgccaacgtgaaatatgacctgagcgtttgaaggcagatttctgaaatgaccacaagttatgtcatgttttgtctttcagaggtatgtctaatgtactagtagctttttatgactcgtactgttgtatgtctgtataatctctactcactgcattttgattcagaattatttgccatgacacagcaagctatgatctctattgagtctattcaaacactgcccagttttatcagtaattatgcgctgttgcacaccacatcaagattttggcattgcatgatccttgtgttgatctttctatgtattgcagtattggtaatttgagcttctctgaggtacatctgttcagttagttcaggtcttcagtctaacagtggatatcctggcagtacttttctctttggtgaaccactaattagaaatggttaaataaaatacacggtctgacaagctaactgttgacccagtgcttccacctgggtcaatggtcgatccagggtgtgataagtgataacactacctacaagctacagtagtgttcctatgtgctgcaatgggaattagtttctttgtattggagtgtattgaataattttttaactaacatgacttttgaatttggccaaatcagtgatccatagtgaggataaagggtgcacgtgttggtctggaattttatgtgatgggctgtggtaggagaggtttggtgtgggaccaaattagaactaaccgtcgactgccagccaaataaatatgaatcttttggtgatctatagttgatagtggtacttgggaaattggatttatccctccttggttctttcttgtcacctactggctctgtaatctaattaactgtcatcaactacttgtaaaaggtgttgtattgattgtgtttcctttaaatttgtcaatttttctaagtagttctcttctttagctaattacattgagtttgagacctttacttaagttagaaatcaggatgtttttccagttatgaacttatgttaaacagcatgtgagaagtaataccttttcttcctttccaggcccatgtgtttgaattattgaaatactgagtagagaggtccagacgcaccttggaaaggaaaatgctttctcatggtccgaattttgtgcaaatctggaaaattttccccgatatttataagatacttttgtgcacatgatggaaggacatgtatttccatgttctcattagtttcgactcctatgtattcagattatcagatgtcaagtcgcataacattctctattgaatgtatgcacaaagttctagatcctaggacaaattaaactgtatatgtaaactagagtggcagctgacccttccttgattatgccttatattgtttcatcttcatttcacacagcacatacattatgcaaactgcattgcatggaatacatttcaccttcaattcatacatttgatctgaatggctttagtacaatctgcatcattgatttgctttcttgatcagtttgctttatcccatcatcccatgccccacgaaaccattacacattgcactcgtcattcatgtgcatcctcctttgcggcttgatctgatgtaatgcccgaaagaatgctttcatctttggacctttatttgtgacgtgctgatgaaagtttgctctgtaaagagagaacaagggcactctcccttggatgtaaattttatgcttgacatgaagagctatgatgatctgtgaatctatctggctatgcctttgggaggcaacggtacaatgtaaatccacaagtttctattctgtctcagctagagattgtcatttgtgcagatggtaggattgctgcattggacagcatgaccatgtctagagcctacgcttgtgctggctgcccacttctttgcagtcccaattcaaaggttgcaatgatagattgattccgtcatcatcttttcctttcatttcctttgtggtcgtatgcatcaaaacattatcagcttagagaaacggacatttggttgttggttgagagctaggttgttgctcttctctgcatgccttttcttttgcctacttatgtacactttgttctttacaaagccagattaacttgtcagcagtttcaatctacacgtcaaatgtggtttctctaacagttctatcccaacattttccatgctattcaacatgaaaatatgttgcctccgtttcaataagttcatattttatccattccgtatgtatcaatacaaaaccaaaaaactactatacccctattttttctattttattgaatacaactgtaattatttctctttttatttactctcaaaacagttatcctatattttcataaactccgatgtaatgattgcttgaaaatgaacttattttgagacaaatagaaggagtaaaaaataattttattttgggataggattttgagacgaatggagcaccatctttagaccagaaaatggatagccaaatgagttgctgatgagcacaggcatccatagtccatagatgattgtcatccatggatgatcgtcatatacaattttcaagggatacttttctaaagtaactttttaacgttgtacttaaatagctatcataaaaatcagataatccatcaattccagctatctcaaatacagtatatcaaatctaggatatttacttttaaaaaatggataatcaaaatgtgttaagttgcagaagaacacaggcatccatggatgattgtcatcttgtcagaatggcaccaaccaaaggaggcaaaggcgagtcggcagagccttgacgtctgtgcaaacctgtcaagcaagtggccggtaaaacaactacgaccaggcatttgcctgagcaaaagggggctagattgatacggattaaaggagcacgaatctttaaacaaaatcaaagtggaccgaagcggtctcccattggcgcatctaccggggtcccaccccctcatccctgaaagcgcctaccgccaagtacgctttccttgcaaagtccagcatagtagtgtaagctttcattcaaaaggaaaatgaaattcaggaatgtgttggctggctgtaccttgtaatcagtttaagctttggtagtgcaaaagatttggtgccacaaaacatagtacatatttagttattcattacaagaaaaatgaacacgcacaagacgtatacgcacatattcacgagtgtgctcactttaacgcacacttattaagagagagaaatggaaacatgtttttaaagtactaaattaaattgttgatcgaaacctaaacaattatcttaatactcattagttgtatgtatgtatatagttaattggttttgtccatagaggatgagttaattcatcctttatcttggtgacaaaataagtgtcttggatttttatatagagggagtaataacaaatctcttcattgatttcctattaaaagcacttccgtgtcggatatcgattacactagtagagtctgaatgtgtgggagtggtaaaatattatcatgtcatagcaattgtagggacgaatccactttgaattttctaaatgtaaacttcaggaatgaaaagaaaaggtcagtgtttaagtccaccatgacttagttttttaatccctaatcaagtgtcaatgtatgtgtttgttttaagcaaagtagtgatgggggtgtatacagtagtttgcagatcactaacagggattgctcaataacaaatggcagtggaggacttgtcaagaaagggagtttgttcacaaggcttccagcgcagactgcaccgaatcatttatttcattttcccattattggtatccatccggccttgtagccttcatggttacgtgtaacctacccaggatcatgcctgaaaaaaggggtggtaatttgatttatttcggttctagcttttctattctccaaaatatggccgaattgaacttgtcaaatggtgagcttgcatgattttgtggattgtaggaagtttgaagaaattaaccaatttggcaaggtgtgcgacaggcttggttttagtgaggtagagtcaacagtggtcaatttttgcttttgactgtgcttgacttggtacatatatattgaccatcaggaggtcaagctaccagttgtactatacgattttgttttcctgagctaagcctaccaattatatatactagtaataagattacaaaatgaactatggcatatatttctctgaagttttagatatagtcaaccactttaataaaatattaatttggcataatttagtggattatttcgaaataaagtttgtaaacagtaaaattaccaatacgaacttgatctgacataaaaccacttggttaatttgctaattaagggcaaattccagttgttttaaacctaaaagattttatgtgcttatccaacggctgggtagctacttggcttaatatatattgatatgtgcggtttaaataaaataagttgctactccctctgtcccacagtataagggattttgagtttttgcttacaacgt

SEQ ID NO: 8181 - DNA, 8695 bp, Oryza sativa
aatcccttatattatgggacggagggagtagcttataaggttctgataaggctctctaagctagactaagcaagtctacgctgattaaattattgaatggtttccatgtcagttatgcactaatcctagaattgattcttcttattggggtgcgtttgcttaattgtcatgtcagtttttctttttaatttagatatattcgtttgcttatatttgcctaatgagcattcacaatatcatacgtgatatgatgtctagtagctattcctataacgccagcattcacatttagcccttaaaatgatttcactatctctacttatctagattaacacataactgccgccacaaactaataaaagataattaaggatgtctaaaaccaattacatgatgtagtaatttctgattattctatttgtgttctcttggcagagatagtgccatactgagtggatcgcacataggtcgtgtcatagacttagacttccttttttccttcccttgtaggatgatttgtgtaaaattaatgagtcttctgtgtaatataaacaatcgtgtcttgtcggccagatttaaaatttccagttccctttaatttgtatataaaggaaaaccagattccccagtcaggtctccagagagttagtgatggaagaatatccctgtgtatgttgatgatataagctgttgatactccatgatatatatgatgcagatcatatctatgatgatctgtgcttgttgcttaattatgtatcaaaagttaagtttgttgggatcttaattagaaataagctaactttgagattatttttcccctgaaaatagattaaattttactgtatattatataaaaagtatacaataatttgtttaatgaatatattaacataagaaaatatccgtaaaaaataatatgctagcaatatccacatacattttttttactgctatatccactttttcaaaggatttcggttggttaacgagtcagcaaggagcatgcagtcatgcatgattctcaggtccacaaatgagcccacatagcgtgtaaatagtgggactcaaactaattagagataaatcatattaatgaacttcatatatggtgctatcccatttatttggaggaacatggttgaaactaatgaattgatgtacaagttataagacaaactaaagtaccaaaatcaataaaaaatgtgttcaaaacaaagataaaatttaatttgttggagatatttgaaaattagaatcctcaacttattaattaagtgtgtgttcatattcataaccatacatggccgtacacacttctcaagtaatgtgcactggagtgtgaatcggatcaatttttacatacagaacacacctagtgaaaagtatcatcagtactccctccgtcccaaaataagtacagttttaacattgttcatgctcaacgtttgaccgttcgtcttatttgaaaaacaattatgattagtatttttattgttattagatgataatacatgaatagtactttatgtgtgattaatatttttaatttttttcataaaatttttaaataagacggacggtcaaaacgctggatacgaatatctatggctgcacttattttgggatggaggtagtaaaaaaaagccttgttaaagatataagcatatcccacaaaaagacacttccaaattaaatcaattgttagtgctcttggaacccataggcttgctataaaattaaacttcaacttgttttctttcttgaggtagatatctgacaactgatcgagtaccattcacatgcttaatttgattaaaaaaattgcttttttttttcatattggttccgaaacgaatatttagtatgcctacaagttgtttcaatttataatggaagccatatatacatgcatgttcttctgttgctggaagaagaatcctttccgaaagtggtgctaatcgagaatatgttgatcttcttggttttattctttgccatcagaagtttgttctagctaggcaaggtggacatatgtttttcctttggtattttcttttgaaccaactgcaaagcctgacaagtacatatctgtgagatgccttttttaaaaaactttaacagtgataagtttcaccttatctcctgaaaaagaaaacagagagaaaggtaaaatatggatgggatgtatgaaaacaatgtttattatttgcaatgcgcgtaagggcatcaattcacttgtttttttacatcattaaaacgacattatggaagttactttctgaatcatagcctatcttaggatatagtaggcaacacgcaacgaaatcagagtctctacactctctacaaaagagggaaactgtaaagatcttaatcattttcagttacaaattaaatggtgtttcaatagcttgaaactcaataaagtttccttttggagagaggatagaaactaccccagctagcacatgcttgcatcgaacaataaaacaactttaagaccatatattcaagagcaaacggtccatcgatcatatataacttctactcctatctatatatatcgcaaatacgacaaatataccaattgagctagctagctataggatgatcaaccaatcaaataagcaacctgcattctcttcattcactcactcactcatactcatacatatatatgtgccccctcaataattaaaagctagatctacgtacacatacgctgataaaggtcgattgagacatcaccccaaatcttcccctaactttgctaattattcactggccttttcctttctatttctgctacagttttaatgaggagaaaaatagatgagctaccagttctttgcttttcctgagctatatatatttgggtggcttgtgcatcggctggcactcacccttgcacactcattctctagagaagggagagagaagagtgtagtagtagctagctaggagaaagagagagatagagagagaaacaatggacaggagagcagtagtgtatgatgctgaagcagttgatgatcatgagagacaaggtatgtgtacatgatgatcaatagctagtttactttgcacctaattgattgatgtaatattcagaagtgcccaattaattgtcaaaagtttattcaaataactactgtctgaacccatgctcatctctctatgttttttcctcgaaggcttttagaaggtctttgcatttgattgtgagacatgcatgtgtgggggttgtcatgcatgcatgccttttgctttgcacaacataacagaatgttaagaggggagctaggggacaaccttttctgttagcagagtgacatgcataaatgatgcaggatgtttgaaagctgcagttcaaaacatggtccatgcatatgcgaagcacacaggaccaatacatactcacatcattcatctacctttttagcttctaactaaaaaccacccagtcttaattactgtcaaattaaatcgatctgcccctacttgtcgtcatctcaatcacaaggaaattttgacagtaattgcaagtgtgtttacttgagctctctgcattgggttgatatgagatgatgatgatgatgatgatggtgatgatcagggacggtgtggacggcgacgtcgcacatcgtggcggcggtggtcggctccggcgtgctggcgctggcgtggacggtggcgcagctggggtgggtggtggggcccctcgtcctcgttggcttctcatgtgtcacttactacacatctaccctcctcgccaattgctaccgctaccccgaccccgtcaccggcaccgccaaccgcgagtacatcgacgccgttcgctgctacctcggtataatatatatatatcattataataatattattgtatttttacgatctataagaaggtaccacgagttaaaaagtgtcttaacggtgatatatacgtcaattttctcatgtgttttagggccgaagaacgtgatgttgtgtgggtgtgcgcagtatgtcaacctgtggggtacacttgtcgggtacaccatcacagcgagtgcaagcatgatgtaagttgctaattgccaatgttaagtatatatgctcgtgcccttcaattagattcaccaatcatcatatataaacgaatggaaattgaacttattttacgtacgtccgtggagtacgtgcatgcgtatatacatcaaacttggggcaaattaactaatcagtgcacattagaacttgaataattacagtgacctggcatgattaagatcttgatttaatatcgctttaacttttttttccatggtgcgttcgtgctcacatcctcctaaactttgtcgggatcgaaaacgtagtcgacaaatcagacagtagtaaaagtgcaccgaaaaaggtggcagagtatgtggctttaattagcagcctacatatagctgattagattatattaattaggctactttaattatccagtctacgagcataacttcgccctgaaacgaggagaatcccttgcaagcatcaacgatcgattttggatgcaaattaacacgcttaatgcgtgacacatcttggttggttaattagcacattctgcacgtacgtacggttgcatgcacgtatctggcgtgacactcacacatgcatgcacacttgtcactgttgcaatttcctaactactcatatagctcttaattgtaaaactaatcttgtgattagagaattattactctatccaatatttagaataacattcaattgctactattaatgatttctaaaatatttagattaaagaaatgatatccataaacttagctccaaaaatattcttataatattataaacatatcaaaattttataaacttacctttattataaaattgacggccagaatttcaaaagttttaacaacccccctcccccctaaatgccatgtttggcagtaacatcgagaaatagtattgtggttagtgaattaatttttacaaataatattttgagttcctatactagtgaattaatgttgagatactagatcgaagcattaatacacgtctaattaaagattactccctccgttttagactataagtcgttttaactttagtcagaacaacatttttcatccaagacaaatatattataacaatattgtcaattatagatttaataaaattaatttgatgttacaaatatatatcactatatttgtccataaatttggttaaatttaagtagtttgactttgatcaaagtaaaaataacttataatatagagagtaattgattaattaatggatggatgcagagcggtgaagcgggtgaactgcttccaccgggaagggtacggcgccggcgactgcggcgcgtcggggagcacgtacatggtggtgttcggcgtcttccagctcctcctctcccagctcccctccctccacaacatcgcctggctctccgtcgtcgccgtcgccacctccttcggctactccttcatcagcctcggcctctgcgccgccaagtgggcctcccacggcggcgccgtccgcggcaccctcgccggcgccgacctcgacttcccccgcgacaaggccttcaacgtcctcctcgccctcggcaacatcgccttctcctacaccttcgccgacgtcctcatcgagatccaggacacgctccgctcgccgccggcggagaacaagaccatgaagagggcctccttctacggcctctccatgaccaccgtcttctacctcctcctcggctgcaccggctacgccgccttcggcaacgacgcccccggcaacatcctcaccggcttcgccttctacgagcccttctggctcgtcgacatcgccaacatctgcgtcatcgtccacctcatcggcgcctaccaagtaattacccatcatcgtctcacttcctcgttaatggcgggcggcgatcgacgatgatcttatgtttgataatttgctgcaggtgttcgcgcagccgatcttcgcgaggctggagagctacgtggcgtgccagtggccggacgccaagttcatcaacgcgacctactacgtgagggtgccggggaggtggtggccggcggcgacggtggcggtggcgccgctgaagctggtgctgcggacgatcatcatcatgttcaccacgctggtggcgatgctcctccccttcttcaacgccgtgctgggcctcatcggggcgctcggcttctggccgctctccgtctacttcccggtgagcatgcacgtcgcccgcctcggcatccgccgcggcgagccgcggtggtggtcgctgcaggccatgagcttcgtctgcctcctcatctccatcgccgccagcatcggctccgtccaggacatcgtccacaacctcaaggctgctgcacccttcaagactgtcaactgatcgatgatcattaatttgatcgcttattaagtggttaaattattcagttaattaatgatcgatgatctagttgttagctcagcaacaagcaccatcagccatcagggagctgcctagctagagctgtggcctcattttgtttctaatttctttctctctgttttttttttggtgaatgattgatcgatctcaatgtactgaggttggttaatttttcttgctgctggttaatttgggcttaattttgatcttggagtaactagaaaacatgtaattcatcgtgttgaggatgagcaatgcaagaaagaaaataattattcgccaaaattaattaatcatgcatgtcattttctttcttttacatcctgatcaaggagtaatataattaatcagattaatgtgtcccaaaaggcatgcaagaacttaattagtgcatccatcgatctctgtaaactatctcgacttgtggtttgtggccttcaagtagctcctcactatcatctccaaagatagtgtaatttctgccatttgcacaaaactatgcacatattgcattattgccatgaccactaattgttctacttagttgattcaggaatcatctcttctctagaatgtggtcatgattgcttggtacaaccaagtttctttccattccattatatgtgtgtgcttccattacacatgtcatctactactctttaagcaaaaggtgattgcttcacaccacatagtacatacttaggcactgaacaaactgatgatgcagaagaatattgtcctcaatttgcctcatttgctgagccctggagggaacaagcagacatattcagatgcatatatatcatggtcatcatcaaccacccatacaatgcatgctaattctcagtattggatcccaactaagttggcacatgataaagtagcttagagggttcattcatgattcatcctgcaggtgcgatacatgatgaattgctgatgtgtgtgtggtgaattagtgcatggctctcactgtcagtagtgtcgcttctgtctgtcagtgtgcacatcgaaattcagatggaacaacgagtgcccactaattgcattctgtatctgtgtgtgttcatccaaaatggttgcatgcatcaccacttttctgaagacttgttctgctctagtactgctttgatatgtgggaccccccttcatcttttacgtatcttcgatcttacttgaaggagaatgacatgcatgtgcgtatctagttgggttaggcccacctgtcattgacacatacgtggctagctaattgaattcataagatgccagatggagctttaactaattaagagaggttaacatgggaattatatttaacatgcacacgttatggtttacagaatttgtagctaatgagaatttgtgggtatgcattatttgaaaattagaaatgtggaaataggtattatttttttgaaacgaactacagatgcaggcgttcatataaacatgcacacactcaccatatatctctataactacctccgaagacatggcaagatatcttgagattcacgaagttaccgagtacgttgcttacaactgaaagaataattgaccacaaatacaagcatccgcgccaaatctaagacttgaatatgagtgaacagatcccaccagcaagaacctagcaagttgagctatgctcacttcgtaaaattgatatttagtttagttcaatgttatactcttatgcttatatagaagcttagttgcactttgcaacaaatttcatatagaatgtattttcagtgtcacaaacataagttgtaaatttgcgtggaatatacctaagatacgcttataaaatctttgaaccttttcattttcagaaacgaacatttaactgaattatgtatcatcttccatctgtctaatatactccctccagtttttaatagataagggtattgacatttttacacacttttgatcatttgtcttattaaatacaagtatgctgaaatataagttggcttaaattatattacctttaatgataaagcaaaaaagtattattatgtaattttttttgaataacatgaatagacaaacgtacccatgtcaaaaagtcaatgtcatcctctattaaaaacgggtggtagtactttcacaaccacaacaagggagtggattttaatccctcgaggggatgtccctcgttgtttgcatgtcacttaaatagttatgaaaaaattaaaaatatttgtgaagatgtattaacatgtg

SEQ ID NO: 8182 - DNA, 1422 bp, Oryza sativa
atcacatgttaatacatcttcttaatttttttcaatttttttcataatcatttgaatgacatgcaaataatgagggttacattctgtcgagggatcaaaatagtttcccaccacaacaagcctatatataattaatgttggtatattagcacttctgaaatcaatcagttgcaaataaagagagattaatgcatgactcccaagtttaaatgcccatgaaaattacgcagcaaaactctgaaaaactatgcaggttattagcctgataactagcttcagcctgttgtagcataataggcagttttttgagcttcatttccttttcatatcttgaaatcacaggtcaagagggtgacaaattatgcaaaaaggcagcagagacaaaagaaaacaaggacatgtacatgcctcttactgagaggaaaggacgccattcctgaagaagttgcatgaactacatgctatgcataatagtcaattttaccttttgcttgaagatgagatgagcacattctgtatttttcccctctttttgtaagaaagttacatttgcaaattgttagtatattttccctggacggtagctccagaaatacatccttatccactggtgaaaaaagtttgccaaaacttgcttgtcacccaaaggccaaatgaaagaggccatggctttttgttgcgtgaggcttctcatctgaacaaaaggcctaataatgtagagcaccttgcacagaaagcacatatatatctcctttcaccatgagtattatttttttcttgttcttgccttttgattgttgatggcatcgcgagattcatccgatcttgaccctcttcttgtccttttgttatttcaggggagctttctctcagttttccatcaaaaaatgccaaggttgaacaatacagcatctgatgattttcagtaaaaaaaaatgccaaggttaaagctgaaaatttgcactttaacaaactaaaagacatatttttcttctcaatcaaattaaaagacatatagtttctcagaggcattcccaaaacaagtaaatataataatttaaaattatctatactattgcagcagttttttttcggggaaatattattgcaggagaaaacggacaatatgccactctatacgtggggtttcgatgaaatgccactcaatagaatgcaccaaataaaatgctactcagtacgttgcctaacggatgaaataccactttgaggagttttaaccatttttatgcccgaaatatactttgttgtggctgcgaagagatagggagaggggagcactgggggaggaccggatgggcggcgctgaaggcctcgctgcgggagacggcggtggcggcgaccaaagtggcagctgggacgacggggcggatggaggaagaggtgatgacaaggacaagttca

SEQ ID NO: 8183 - DNA, 14305 bp, Oryza sativa
atttcatcgaaccctcacatataaagtggcatattgtagtggcatattgtccgtttttttcactattgtagtagttgatctagtattctgtctgaactacatattttttagttaaaaagaataaatgaagttcatataggcattcccagagcaaccacgatttagtttttttaaagaaaaatgtgggttttttagtagttgatctagtttcgtatagtattatccaacaattagccggtgtgggggctatggaacatccacaaagaagtaaccattggcccaaacaagaggtttacaatagaagctgagttgttgggcctttttatgcagatgccgacccgagctgagaattcaaatatgaatgttcaaacaccctaattttgttcattctgatttaagctctgaactttatcttttgacgttcaagagtgcacatagttgtctagcacatttggaggaatgaaacaatgcagctgagaaacataacagtatattgcaattgtggcctctctatgaattacttcatgaacagaagaaactaaacagaaaaaaggtgaatcaatcaaacctgcattttgcagaaccgattagtagtgaagattcttcacaaatcacaaaaccagatcaacatatgattaacttacagattgcttttcttgatttcacagatacattgtgttggatagtatataagaagaggtataccgcgtaatataggacacgttgtattgagcctcaggagggcggtatatataggagtacatggggaggagataaggaaggattacagatatgaaaggagttcacacaaatcaatcctatctaatatgactctaactaccatatactctaacatcccccgcagtccaagcgtgagcagcgcggacacttggactggagaagaaaccgacaagagtgctcaacacggatgatagccctttatgccattgtcgacgtagcctgaaggagccgagagagccgtggtcgatgaagccgtgcgtagagtagccgtggtcgatgtagccgaagtcgggaagctgatgtcgagtttgccgagccgcgggccacgcatggggcgccgtagagtggtcgtggacgcacgggagggcgtcgtggaccaaggtgcgcaaggatgcgctggagacgaagacggtgacataatcgcgacagtcgttgaggaagatgatgccgaagagccgatgtagtcgaaccgcgaaggacgagacgtcacacagggcttgccagaccccgggacaactcgggacgaacgcgcgcgccggtgttgccaataccgcgcgggcgagacaggggaccaccatgaatcatacgccaatgtcggaggagactagcagagaagacctccaagacggtcgcggcgcgagaacggcgtagagggagaattgccagagtagcacgcggttgtcggagaaaggcgaagtgtagtcgagaaagatacgacgacgctggcgatgaatcatgttggacgaagacgaaggagaagtagtgggaccaacggcctggatggcgacgtcggtagccatgtagaggtagctgcaccaccggtctagagtggcgacagtggcagcttggagatgcggcggcgatgctcaaagtagaggaagaagaccctgagtggctgacgatgaccagtacggacgacgaggttgtcaatgcgcgaacggcgatgaagacgacaaaagcggcgaagctgcggtccgagaggacaacatagctgcagctccatgtcgatgcaatggcgagaagtccaccgatgatgtagccatgctgaggacggtgtctctcagcactgcaataaccagtggaggtgtggaccacgggcagcggcactgcggcccaaggggacgacgcagcggcaacccgaagcttgatggcgtagatgcgtagtcgaagacgattggcagcaaggtgtcatcgaagctgggcgcttgaacgggtgatcaagccaatgatgcgcgggcaagatgacgaagtggaagcagagtcgatgccgatgtcgaagacgcacagatgtcgacgaggcggtgggcgacgcaaacccgatcactgatcgggaaaaaaaatggatacatagcagcagtagcaagcaccatgtgtcgggaggctagagctctccatgcaggccttgaccaggtcaaccagcctgtgcacccatcttgtcgctcccatgttgtctctctcctcacttgctaaccacggcaagatcacagcaaaggagacagtcaaaagaacaataggcaaggtagcaagagatcgacttgacgtagacgagcggatgggaacggtgttggcatcgtggaggaagacggccggccgcgggcgtcctggaggaagtcggccggcggcggaagcggagatccaaggcgccgacccacgcggtcgcggcggtcgtgccggcctggtgggcacaggcggcggtccaggcggaagaggagacgatggggacggccggacgggtccccccgtaccctgctgcgtccaacgacggcgacgccagccatgcatgcggggatccgtcggccacgccggcggcgcgccgtggcggagcgcggaggacgaggtgctggccgcgacccaagaccggcggctactgtagtgctgtgctgcttgacgacgacaatgacgaacggccttggccgaagagattgatctctcttacgacaagcacgatgtcgatagagaaaaaaaaatcggtgcccgccccgggagcgagatcgtctcccgggggagacggcagcggaagcggtgagcggcggctctaggtcgtccgctctgataccatgttagatagtatataagaagaggtataccgcgtaatataggacacgttgtattgagccttaagggggcggtatatataggagtacatggggaggagataaggaaggattacatacacacaaatcaatactatcctaatatgactctaactaccatatactctaacacattgatggtgattcagtctataattcaattgaagcctgaactagatcaacatattactgcagcttgggcaaacaatggaactacaggacttggacttcttatttttcaaccctgaagcgtcagacccaactgaaaaactgcaagtctgaaatcagacagatggcaactgaagttagtactttagttctacagactgttaacatactcattattgagattgcagcctgaaactcttgcttgctgactgactgctcattttgcagggacacacaacttgcaggcttgcaggatagtaaggatcttgtgcaggaactgaacaaaggataccttcagattttcagaacaggtccatgcatttcactgaagtactatataaaagccctcatgtgattacctagtctagatatgcacaacatcaaactttataactgtagaatatatgtttattctgcaaacccttgtgtttaagcctttacagtcataagtttctgacaagaaaatcagtgggtactaatgttcaaagagatgtggtgaagtaatgttctaggtgcctgatggaaatcatagattcacaatgtaagattgtaagatcaatgtgcattgcattaaaaccaaaccgatttaggaactagggtagatggaagcagcagcttaattataccatctgtgtatgattactcagggagactgggacactgaattgtgtcatcgagtttcagagtttcagaagtgaagcttcacgcttgttgcactgtacacgaagaaagtgatgctctgttctgttccctggatgacttattagtgatctttacttatttattttttttgacgcagattttacttatttattttgatagaactagaagaaaataatttatatagtggcttggttgcagacttgcagtactcttccgtcgtcaagtttacttgtgtttatatgttgtttgaattttgaagccattagtcttcaattctcaagttcacttgcctgtttaactttaagctgaaaatcattatacaaaggcacaaaattggattacaaaagcatgtggacagtgggaacaacactactcataatcagacacattagcagaatgaaccgctgttgcagaatgaaaaacagaatttctattaagaatgaattttattaccatacgaataaatgaaacataatgcagatttacagagaactagataactaaaatctttcctctccataaaattcataatgccattataaaattcagtggcatatatgatatatcatatatctactactaatagtacttagctactgctattatgatctatccactgaagggacggaatttcatgaagtcgccgacgaagttggcgacggcgcccgtggtggcggcggccgacacgacgaagccggcgacggcgagcgccctgagcccgatccacagtgcgctgccgcgccgcacgccgcgctgcgcgatgtacatctccgtggggaggtagacggtgagcggccagaaggagatggcaccgaggaggccgacgatgacgccgaagaagggcagcgccatggcgaccacggtggtgaagcagacgaacaccgagcgccacgccagccggaacgcgctgatggcgaagggccacacccggagctcgctgttgacgaagccgctgtcgggccaccggcgcgacgccttgcgctcgacgaaggcgaagaccggctggcagtacacctggtaggcgccgatgaggtgcacggcgatggcgacgttggcggcgtcgacgagccagaacggctcgaagaagccgaatccggtgaggaggttgtccggcgccgcgttgccgaacgccgcgtagcccatccacccgcacagcgcgtagaacaccgacgtcgccacgatgctcagcagcgacgcctgcttcatcaccttcgcctccgacggcggcggcgccttgatcgtgtcctggatctcggtgtacacgttggagaaggcgaacgcgaaggcgatgttgcccagcgcctgcagcgaccgccacgccttctgcgtggcggtgacgttggtgacgccggcgatcgtgccgcggaacccgccgtcggcgacggtctgggcgatgccgaggccgaggccgacgccggagtaggtgaaggacatgacggcggcgacgatggacagccaccagatctcgtggaagtcggggatctgcgagaagacgatctcgaaggcgccgaagatgagcatgtacggggtgctcgagatgtggcacgggacgttgtggccattggcgtggaagcagcccgccctcttgatggcctgcatgctgatggaggcggcgatggtgtagccgacggcggtgccgacgaggttggcgtactggatgatgccgcagagcttggcgttggcgccgccgaggatggcgcggacggcgccgatgtaggtgtagttgcgggcgccggtctcctcgtcgccggtgcggtagcactcggcctggagcgtggcggtgaagtaggtgacgccgccgaacaccaccatcacggcgggcccgccgacccacccgagctgcgccgtcgcccacggcagcgacagcaccccggacccgatcacggcggtgatgatgtgcgcgctcgccgtccagaacgtgccggtgcggcgcggccgcccgtcgtcgtcgagcaacgccgagtccgcctggttgccggcctccagtgacacctcgagcggctcgatctgaaccatggcggcgaacaggagcgcgttcccggtgttcttggcacggaagatgcgatctctctgctctcgatgtggcaatggcgtgatcaagattgagatgcgtgtggagaagggaggccgccgggagcgcggtataaatggcgggagcggggagtcgacttgccgcgttcatatccgaggcgggaacggagtttgaatcggagacgggagcctaaacttcatccaatctgggggagataaaatttggcatattttagctcggacaggacgacctatccgattgggagtgggactcgttaaaatgcactctgttctccgactcgacaaacacgacaatactcaaatttcaatcaacggttcagtttttcaggtcgaccgaatgatttgcggatcaaatttcattaggttgagagtttaaaatcgaattaaaactctcgaaacactgcttatctattatccttatccttatctttatccttactttattatcctcaaaaacaaaatctctgctttcaaattttttcgttcggactccacccacgcgtcactccgagcatcccagcggacacgtcacgcgcggccacacgtgttggcaggaatatactccctccgtggcgtggctgttgtagttgtaaagaccaataaaaccgtttaaatatcagttacgctgattaattctctccgttcgaagagcgacgtttaggtagttgcgtggtagatacgctagcattaaccaccatgcagcgtgcgctcgacctgtactttccgcgcgaatagccagcatgcatgcagatgcatttttgctagcgcgctttgctcgcctggcataacgccatgtatggattgttttgattcaaaaatttggaaagccccatgcatgcatgcttgatcaaaaatttggatggcgccatcagcaataaaaaatgaatcgaaaattttcacttgacgccactatttgccagcaaaattttcttctataaatatggacaatgcaccacacatttcttccatctctcttcttccctcccatggttcaacgtacgtaatggccagttttgatctaaatctacccatcatcaattgggacgaagttgaggatttcgatggagatatatctgatttgaactatgacttcgtttgggattatgacaatgaaggtgttcataggagtttcttctcttgctttgtcttcttttttttcttgtgcatgtgtgactttataattttgtttcaacgcacagatggtgaagatggcaatggccgcggcagtggcaacgacggtggctgcgacggcagcgacgacgatggcggcggcagtggcggcggtggcgacgacggcggcggcgatcaaaccaccgatggagcagtcgatgcaggtaatactcgttcattttctttttgttgctgtgtctttttgctgcacgagttgaaggcctttgcatgtacacatgcacagtgccatgcttaagcaaactagccgatgcatgccaaccatagtatagcctgcatgttctcagccatcatccaccatgcatgtgtaggtatcaatattaagaggaggagacactaccctcctgatatgaaatgagccatatatgcattgtgtttggagagatcggatcctggtatgatgaaggagggagtgacaaagtcagttgctactgatatgggggttccatggagagttgttcagcgtgtatggcgacatggacaaattggaggtggaattgaagctttcgaatcgaagaagaagaagaactgtggccgcaagaaactttcttttaaccctgatgccatcaaagatgtaccgcttaggcaacgccgaacactccgtgacctagctaaagctttgcatatgtcaaaaaccacattgtttaggcgtttgaaggaaggaagatttaggcgccatacaaatgccataaagttcaccttgaccgaagataacatgaaggcccgtgtgaaattttgtatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggattttttccttcacttactgggaggcagccaagaggagtagtcgcactagggagaggggtaagttgtttaattatgtttagttactccacatatgacaactctactaattttgtttaatcgcatgatttaatacaggaaccaaggccatgacatctgtcacgagggacattatccagaactatctcattgaaaaggttttgccggccatcaaacataaatggcctaatgaggaacgaggacttccaatattcattcaacaagacaatgcgaagacccatattgcagttgatgatcctgcatttttaagtgttgcacaagaagatgggtgggatatacgacttacatgtcaaccaccaaactgtccagatcttaatgttttggatttaggtttttatgcagcattgtagtcattgtttcagaagtcatctccatcaaacatcgaagaaattgagacaaatgtgatcaaagcatatgaagaatatccggcggatagatcgaatcatgtgtttcttactctacaaggatgcatgagagagattatgcttgcaaaaggagggcagcactatgcaatcccgcatatgaagaaaagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcaccgattatacctctagtgaatcagttgtttttttccttggcgtcagtctcctctagtgaatctgcaacaaatgtgttgttggccagtgagtcaacaacgtacccaatgttgtcggagtcagtgaaacgatcggcgccggccagtgagtcaaccacgctgccctctcggattccggcgtcccctgccttctctccgttgtcacccttgccgtcgtcggtgttgcaacagcgaacgagctctgcttgcgctcgcagccgcatgcgaagggcatgcacacggagcgtacgagcatgagtgatatccatctgcgcctcctgccacatgcggacggcggcgtcgcggagcgctcggacacggccgagctccacttgagcacggcgtcacatgagcacggcgtggagacgaagtgatcgcgcgcggccgaactccacctgcgcctgttgccgcatgagtcgtgcagatgcaatcttctcctttgtcgtcgccatcgttggcatatgaagtgtgagcagtgtcacagaggggcggtgtgtgcagtgagagagagagaggaagcagtgagagcgagagagagaggggccaggagctgagctttttaaaagccaaaccgagtcatcagttaattctctgcatgcaccagtacaggagccgaggagtactcatcaattcctgcatgcaccaaggagttgccgccctgtattatagaatccagttgaaaagaagttacgccctattttaaggaacggagggagtaacagtttagtgtgctttgaccgggcccacacgcgatcatgttttggattaaatctaaactgaattgtcaaatatagtttgtttcataaagataaaataaagcttagactccctccttacctaaatgtttgacaccgttaacttttttaaatatgtttgaccgttcgtcttattcaaaaacttttgtaaaatatgtaaaactatatatatactaaaagtatatttaacaataaatcaaatgataggaaaagaattaataattacttaaattttttgaataagacgaacgatcaaacatttttaaaaaagtcaacggtgtcaaatattttgggatggagggagtatttaataaatttacatcattatgtccagaggtggaccaaaacttttttttaagatccactataatcaacggcatatatttttcctttagttaatacgttcatttctaataatccacaaatgcgaataaatatttctctatatgcggttacaaaatcatatgtggaaaaaacaaaaaacatatgtacagtgcttcttcatggaaagaaaacatatgttacacaaggtcaccctttgcgattccaatctaggccgagtttagttccaaactttctcttcaaactttcaactttttcatcacatcaaaacttttctacacggataaactttcaacttttccgtcacatcgttctaatttcaaccaaactttaaattttggtgtgaactaaacacacccctagagcacacccctagatcagtttgtagcagaaatcacggcatccgacgagatctaaccaaaatcgcatcagaataaagccatttagctcgctcctctccagtttccgtcaatattgatcatttcaaccaattatctgatccatcactacactcctccatcgtcttcaccaaaccacaatcaccgccagggaccgggagtggtgaatgtgtttcctctcactttctctctccctcccaccctagcaagctgccatagtctaacttgcacttaacattatgttcttattatttcaatttatttttatgcttttccgatttcaggatagatgttcttcggtggtatgagaaacattctgattgcattatttttacgataaaattatggcattatttttacgataaaattatgatttgcatgactacacctaagattgcccaatgcatataaaataaaactttaatcttatgatgttcatcataaatttaatttttctcgtagcaacgcacatgtattttttttccggtctactttaaaaacgaaatctggttccagcagaactttcgtttgtccatcgttgcttgcatcatcgtggcatcctcccatgctgcgcactagcgtgcgctcgtccatcattgggagtcagagtcaggtacccgcacaacaacgatcccaacaagcgatcgatcgcggtagcaacctcaattccgccggtctatccgttgtccgcctttcgcgcgtgtcagggtcctgcatgagaatctttgatgggacttttgtctatggcattcgcgtttcacgtctaccacagagtcttcaagcaagcggggttcgagcgagctgggccaaaattttatataggccgagtttagtttcaaatttttttttcaaactttcaatttttccatcacatcaacacacacataaacaaatgctagctcagctgctggtcactcgcccttcttctcgatccggtgtgctcgagctctctccttctctttctctgaaggactcgtcgcctccgctgccggccaaccggatctgtaggtgagagagctgtatatccaacgtcagccagttgattctccatctaacactttcctctgtcattattgccgccggcgtggtacggtgcagatcgatcaacttaattattgcctccgatcaggcgcaaagatccgcgcgctgcaggccggccgactgcgagtgagcgaggggattgaggagagctgcgtcgatcaacttctactattggcctggtaattaaccacgttctgccaggggcggaggcagaaagtagcatgagtgggggccaatgatctaccgcttaggtagactaacaagtaaaaagtgtagggggcatttgcccccattcactgcaaaattgagtgggggctatttgatttgcaggtttcataaattcatgatttccactgttctactcaagtgattggttcatacatccatgcatcttggcaaaaatcaggtgtatacaactcaaagcttcaaaatcaatattaattatgacttgtttatatatttcttgcattagtattatatcttttttccgtatgtgtctttaatatcttccgtaacactgaattatttacttaattagtagtgcaatagtaatagcaatactcgatttatggtttaaagactttgtattatttttctcctcaagctgatcacgtctaattttaagttgaataggtatttggtggcttttcctctttttcctggcttgtacttttgttaccatttcgcctattctttaatgtactgatgcataagccttttgtctattcaagaaaatgagttttttcccgcctcaaacttatatgtaagtttggccttgtgccactactatacgtatacgtactaggaaaacggctttaatttttgcatttgtatacttactttttataatttggcaatttccatcctcaccactgcaagtatgagataaactatgctcgttctatgcccccaaatggttaagcatcatccgtacccctttaatgattcacaactataaaatctaaaaataaaatgaaacatttcatgataagataaacatttccaaatttagagagagtttattgcatttgtaaagaaaaatatatgccattattttaattttaactaactttgtttaacttcttatttcagtctatagggaatgatggtgaatgcattaagcatcattggatttgcactattagtagggtttaccataggattatctacagatctttggtattttcagtgtgaaggcaagaattttgcatccaaaatcatatacagaagaaacttagatttcttagacactgccacgtaactcgcgggtcatggctaagtcaaggaaagagaaaatttatgctattacacagtgtcgaggagacactaatactaatacctgcaagagatgtgtttctgaggcagtacgggatgtgcaggtggtatgtgattcaagggttgaggctagcgtttattataacttttgcagccttagagtttctagtgaaaatgttcaattcaatattttacatgacatgaacatgttagctatacttggcaaccaatctcatgtcactcataaccgagtttctagtgaaaatgtttaatttaatattttacatgacatggacatgttagctatacttcatggttataaaaaaatttaaaaaaattaaaaagatgtattaacatgtgatatatcactttacaaatatacaagttcaaattcaacttctacgcctcgcaacaaaaaaaaattgactgtgaatatcgttaactagttgtagtttaatttgaaattgactgtgaatatcgttaactagttgtagtttaatttgtttttttcgttgcgagatgtagaagttgaatttgaacttgcatgtttgtaaagtgatatatcacatactaatatatcttctcaattgttttccattttttttcataactatttgggtgacatacaaacaacgaggggatatcccctcgagggatgaaaatccactcccaacttgcacttaacattatgttcttattatttcaatttgtttttatgcttttccgatttcaggatatgatgttattcggtggtgtgagaaacattatgattgtattatttttatgataaaattatgacctgcatgactacacctaagattactcaatgcatataaaataaaactttaatcttatgatgttcatcataaatttaatttttcctgtagcaatgcacttgtatttttttccaagtctactttaaaaacgaaatctgattccagcggaactttcgtttgtccatcgttgcttgcatcatcgtggcatcctcccatgctgcgcactagcgtgcgctcgtccatcattgggagtcggagtcaggtacccgcacaacaacgatcccaacaagcgatcgatcgcggtagcaacctcaattccgccggtctatccgttgtccgcctttcgcgcgtgtcagggtcctgcatgagaatctttgatgggacttttgtctacggcattcgcgtttcgcgtctaccacagagtcattaagcaagtggggttcgagcgagctgggccaaaattttatataggccgagtttagttctaaattttttcttcaaactttcaacttttctattacatcaaaacttttctacacacataaacttccaatttttccgtcacatcgttccaatttcaatcaaacttttagttttgacgtgaactaacacacccatagataggattccaagcagacgatcagctaacactaatcagactatgcatacatagtcacatgcgaatgcacatgtacagattggtttctgcccaatccagtgcatgcaacattgcaacacgaggattgataagtaagagcacacaagattcaagtatccaaccaggagactgcaggcttcatcttaggaactgtttagttggtgaaatgaaaatttttgggtgtcacatcggacgtttgactggatgtcggaaagggttttcggacacgaatgaaaaaactaatttcataactcgcttggaaaccgcgaga

SEQ ID NO: 8184 - DNA, 19428 bp, Oryza sativa
aaagattcgtctcgcgatttatatacaaactgtgtaaatagtttttctttttatctatatttaatgctccatacatatgtctaaagattcgatgtgatgtttttgcaaaaagtttttgggaactaaacagggccttagtccaatacacgaaggtaatgggaactggagtggagtaggagtaaatctggttcatctcaaaagcttttatatgtcgtgtttgaatttactgttgacacaatttgtaatttttggcgcccatgcttgtttggtgtaatagttgtaattttcggcgtccatgcttgtttgaagttacctaaagagcattaaatgcttatttgatagaatctacgtgattttagaaacattattttagtagatcatattattggcagaagttgggggtttgtcccatctcacctttttaaagctcttttctgttcacttctggactttttggctatgtgcctacgggtagaggccggagatgtaacccatttccattatctaaaaaaaaatgcttgcttggcattttcaccacttatgctcatttaatgcactgtgaatattctatccatctctcttgcctcaatcataatttgcatgttttattaggggtattttagtcattcatattctctcttggtatgtgagatgtgtactataactgcatttaaaataggatggaggaagtaagtaacataagttttatagctgatttacttacttatatatgtaccatcacgtacactgccaccaatccagggccaccaacgtggtcttgctgccgaggagcgtggccgcaaaatcccaccaatggttgatcacatgcctagctatgaccatgtgtgttagctactccctccgtcccacaatatctcaaaccctagaatcccaagggaattttaggacaggtggcaaaagactaaaataccctcagtgaaagtacatgcaatcattggagacaaataaaatagtagtactactcagccaccaagttggataagcatatttctgatgctgccattaagtgctcaatatacaaataatacacagcaaccagtgcgccaaatattttgaaactcagcattgcttcattggcgtcaagcattacaaatttcagcacacaccactacaacaaccctatataagtttgaaatgaacctcaatagcaggtttccctcccactgaatcactgcatgagtcttcaaaatcacctgcatggctcttgatctaaacaagccaatagatgaggcagatgaacaggctttgcctgacgtcaatgacgaaattgctgaagttgaaatccatcttggtcaggaggaggatcaacttggaggtgatgtccagggaggtgacaaccatgtgcttccttttgatctcaatattgatgcacctggccctcaagtgcttccttttgatctcaatattgatgcacctggccatcaaggagaaatgaatctaggtaactttgcaagcattaatatgaaatgattaacatttgtagcactgactagcataaataactcagaatctttgctagttctctgaaaagatgatcagtaacatgtgccttgatgcaatcgctatggttttggaacaaaatcaatctttgataagtatgaggaaattgttaggacttgattctatcaatgagttggccctaatgaagttaattccccttccataatatcacaggttatacatttagctagctgaactaatgcaatacttatctcctgttataatgcttatctaatgtctagaatcaatcctgatatgctacatactaaacaggacaaatcagaaatcaagaccggtgtttaaaatctgtgcactagactccctctactgaaaaacatggttgagggtagaataataaaattgctacacagaaaaactaaatttcatatgggtatatagttggtaccttgattgtggttatttgatctcataatctcctgtgttgatgttgtacagcataaaggaacatatattaatcattggttccattagttatgtaacataatagattagttagtaataaaagtattttggatatattggaaaaaaagtataaacattattcttttagtcacacacatccagtaaggcaaatatgccatggcatgtcaaatatcaagtatcaccagcagcgaacagggcacataatcatgttttctacaacatggcagcctttgtattacttactatatctatttgcacgcatagaatggatgaactaaatcattcagttatatatagagaaacagagatgatcactaagtggacatttcataggtctatctggaatagatgatactttgcaaattgaacacataccacttcagtattgaatcatgggtaaaaaggattgtgcttgcaaaaaatattgctatttgacatggtactaactactgaccgtggtaattgttattgtagacaatggcgatgcaatggatcaagttctgcaactttatggaggtcacatccataatgcctttccttttgatatcaactctgatgccttcgaggaacacctacaaatgcaagcaggtactattattacatcatgccaactacctagaataattcagcaatgccattggctgcattagttgcatcaatagttaaggattataaattggatatttcagcacatagtaaatcacaacgaatgatgggattaaggattataaatatgctaatatgttgtatttacatagatttttcatgttaattggctcacagccatagcaatctcaaagaaagcacatacagtaaattgtgccaatgtttctctgccttctaaatgatatgtatggttaaatcatattataaagtaaaccacatggtgagcctaacaagttgtgcaagaactttattatcaacatgagcacttaatatggagatcacatttccagttttgcctactacgattgttcagtacacatcaaattatataatgcatggtcatgtataaaaagtatatgcatgttgtatcagccataattttgcaagcatgttcatccatgacgataaaaaatccaccatctaaattagtgcagacaactcacctggaaattattgttgtagacatgcaggagtacggtttgtatgccggtgatgtggacattgtttttaaacacgaggagttggatgattcagatcaggaagatgaacagccatacaaaaatctgaccaatatacaaaggcaacatatatatatatatagcattggttgggaaaactaccaacagaatcctaaggaaaaaggctaccactgaagttgcagaaatgtttaatgtgaaaagagctagagtgcaagatatttggagaagagcgaagcaatgtcgtgcccaaggaataccaatcgatgtaagctctagaaagaaaaaaaattctggtcgcaaaaagaatgaaatcaacctatcagatattgctaatgttcccttgcaactaaggggcactttacggtcatttgcatcagccgcaggtgtaccaaagagcacgctgcataggatgttgaaagaagggatactaagacgtcactcgaacacattaaagccattgttgaaggaagagaacaaacgatcaaggctgcgatggtgtctttccatgttagattggcatactttgccaaatgaacccaagtttgttgatatgcgcaatattgtgcacatcgatgaaaattggttcaataccactaagaagacaagaaatttttacatggtccattgggaggatgatccatacagacctgtgcaaaacaagaattctattgataaagtgatgttcttggcagcagtggctaggcctagatacaatgaagaaggtatttgcacttttgacggcaagataggcttgtggcctttcaccaaaaaggtatcataacatcttcatatatgcatttttaattactgacggcaagataggtttgtgatgcaaaacttaattgttaatctaacttacataatttactatttaggaaccagcacaaagggcaagccaaaataggccaagagggactcttgtcaccaagacaatcaaggttgattgagatactgtcagatcatttctaattgctaaagtcctaccagctattatatcaagttggcctcgagaagagcgacacaacactatatggattcagcaagataatgctccctctcatgtgccggtggatgatcctcaatttgcctatgcagtatctcaaacagggtttgacatccaccttatgtatcagcctcctaattccccagatatgaatgcactagatcttgggttctttgcatctctgcaatcattaacatatagaaggatatcgagcaggaatttcaggcttatgatgacaacaagctgaatagggttttcctaactctacaatcttgcttgttagaggttatggaagttgatggtggaaatggatacaggattcctcatatgggtaaagagaggctagagcttctagacattctccctaatacccttagttgtggtcgtcagctatatgacaaggtcagaacagcattatccaaccaagtgcagtaaatcatgcaacatgagaagctctatcatggtttcagcttttggttaaatgtcaggttgtatatatggtaaagtaagatcagtattacgcaagtaaatgcaacaaatcatgtaatataggaagttttatggtggtttcagcttttggaatatgtaatataaagttttatgatggtttgaacttttggactatgtaatataggaagttttatgatggtttcagcttttggcttaattttagattgtacataagacattgtaatatcagcattagagtaaatcatggtgcaaacgtctccttaatttcagtcaccaccataaaccatcataatttgaaatatttcgatacattaccatcataaccacctaatatcatctactaccataattacacatgctttcatacaataccaaaagtgtgcctactttgacagactgtcaaggcttctattcataaccacctaatcttatctaataccatatttacacataatttcatacaataccaaaagggtacttatcgagttgctttgtgaggccaccattcataaccaccaaaccagcacacaaacatcacataattgaagcattcatctaaattttgcactcttaaaacactccagaaatttctttaccgatttttccaatgcatcttggtcttgcaggaggtcttctaggccactatcatcatatggatcttgcgtatatcccccaatgaccatgtcttcatcatcgtcgcttgacttcacctcctcgctgttcccctcctcgctgctcacatccttagcttttcccctcatctcctcgatgccgatttgcttgacgcttgccttcttctcaaacagtgccgtgtggtcgctatcgtcaaccaacattgtcctgaaaaggataaaacaatagcatttgtaaacaagtcacaacaaaataaccactttttttaacaatataattactgaagatatgcgagaagatgaaattgaaatttctcttgaaaaatatcacatttctgccatatatttatatttatatcgatgtaattgttgaaacaaaataatcattgttctcaaataagaaaaccttgattaatcattactgtttaaagaaattaattaggttgacaacttggtaagtgggttaggaatcaatcagatatgctgcatctatctatattcaacttatttaggcaaagcgcaaacaaacaatatcgatacgtgacataagtcctcatctattgctgtcacttgctgtcaattagaatgagctggctactgtggttgagaggaagaatatgcatgcaggttgaagacaaaaagaatatgcatgcagctttcgcccaagaagaaaatatgccattggacccaatcgagtacttaacgaaaaaaaacactgtctgtctcaaaacataaaaaacacactgtatatccttttcttttgtgccataaagcagcaaccagtctattaacacacaccgccgaatggtaatcattcatccatgagtttagttaagtgcttcaagattttgtaggctctgtaatttgaaggatcacatttcaatcacctagaaatcactttgggcttttaattagctgattaattgggtaagtcttgtgttgctagctacggagtagatttcttttgttagtttagttttgtgctaatgacttggagatgcagtacactgcgtagctatcttacgcacagaggaatatgagatctgcttagtatatcttaggatgtaatagcctgagaggcattggagccagggagatcgagtgggagatgtacctttgagtcaatcgacgcataccgccgccaaagaccctagttgttgatgccggaattagaataagaggctggtcagcctcgtcctccactgccccctcctttatcagatccgcgggcgccgccacctccttgagcattacatcagctgccttgcaaacctccgacgccgccgctgcatcccaacagcctccacccaccgccgccgccttcttgcaaacctccgccgccgccgccgcatcccaactgcctccacccaccaccgccgccgccgccgcatcccaactgcctccacccaccgccgccgccgccttcttgcaaacctcctccgccgccgccgcatcccaactgcctccacccaccgcagtcgccgccgccaccgccttttggatcacaaccgcaagccgacatgcctcctccgccttggctcgtgtctcttgaatcaaaaccctaaaattttccgccgcttccatgaacggcgctatcgagccaaacacttccaccgcagccatctccggcatccgatctaactactcgtaaccctcccccgccgcatctgagtggaagcaactagttggacggggaacttggcagggagatgtgggagcctggcggagcagcgtggagcaaggagggacgtgcggggaggagcgggagtaaggtagggagggagttggaagcttgctagggtcggtcatctggacgccgccgcgtcgatgccttcgatccagaggggtgaggggcgatggggaggaacgggagggagaaaaacgcgagagggggagagagaagcatacgagtagtatgcggctgggaggagataaggttccgggaggagagaggagtattttggggaagtcgccactcaccacccacctgtccccacacatgatacggatagagaggtcacgcggttttctgtgcaggaatcgatttttttcgggacaaagccctccctccaggaatcgagatattgtgggacggagggagtagttattagtcatgtagcccacgttttatcccagttatcagctctttcgaatttgagcccaccaatggttttatcccacgtttcaaacttaacaaaaccaaggctgtgtttaggccctgtttagattccaatttttttcttcaaactttcaacttttcgatcacattgaacttttctacaaacacaaatttccaacttttccatcatatcgttttcatttcttcaaacttctaattttagtgtggaactaaacacaaccttagttccatgcaaaaattgaaagtttgaaaaaattagaacgatgtgacggaaaagttgaaagtttgtgtgtaggaaagttcgatgtgacggaaaagttggaagtttgaaggaaaaaaagttggaatctaaacatgtctcaaatctcgttcaactggaggtagaagcttcgagatcttcagtttgtaatctaatctaatgccgttgtacgtaacgcacggacaccttcctagcaaaatctaaaatttgatgagggagaggagaaggcgtgtcaatgctgtcgtcccagggtgcccagctagcagctaccattggctcggtgtgcccaagtgatggggaagtggtaggggtcagcccaaccaacattccgacggtgtcaaccccttttgacctgcaggtgggaccaccgcaaacattccgagtattgtacgttttgtactcgaaaactccactctgttctccaaatggaaagcataactagtatcaaatttcaatgtacattttgaatcgaataagtaaaaactctagacaaaaacgctctctcaggcggtcgtgctagtccgccaaccagcactgcctgcgccgcccacgcgtcgaacacctcctccctgtccctgaaccgtatcctccggagccggttggttgttccgtctgccgggtggcgacggcgccagcgtgagcagcatcccagccacccactcggcctgcagctgcgccggcgccgccgcgacgcgccagcgcgtggttcccaccttcacgagcaatcaagatcttggtgaagtccctggtgacgtcgatggaagcacacatgcatctgcctctgctttgctctgctctgctcgtgggctcgctaggttgggggaaaaagacgaggtggattgaaatccagttccaatgcggataagaaaattcagttaaaagttcaaacgaggtggtttgatattctgcttcagcacgcactgaacgcaggctgagtgtaagtggataagaaaatttttgttatgccatattgccatggcgaaaattcacaatatgtattagaagaataatacattgaagatctaaaagataataaaacaaacataatacatcaaatttagaaagttttgctactacctcaaagaaaacaaacttcaggaaaaaaaaaagttttgccataatgtcttgggcgatgacttaatgtcaagtttttactcacaaacatcacaaaagatttcgggcgaggacttaaagtcaggaaggtttttattcaggtgggtgcaaatgcaacaatatattcagtgctgtggatgatcccaaatgaaatatcggagttcagatacatcagacagccaaaaccaacacaagcaagtagctaggaatacacttgtttggagttccatcttcagaatttcagatatttgcactagaattgcagaaccaacaaccatcaaacacacaagattcgtttgagttgctatgtaatttccctggttttcttataattcgaagaggggattttgatcaatcttctctatttacaagagaacattactgtacatattcttagcatttacaccgcacaaattcgtgcaaaccatgttgatcacaacctgggattagtagattacatgactgaaacctgcagctaagctagcagctatcccggcggcgatctcgctgcctcatggctggccgcgtcccagcggctacgactctgagaaacgacaccccgccgacgattcctcccacgtaagtggagaacggaacatggacggccccacctaggaagaatcctcaagcgcccgaattatgttctctacacaagagattagagtcgacaaggatgccacccagaaaccgagatcttggtgtcctgtacataagacatccaagcatactctcgaagattgcctggtgatactccatgtgaaggctgaactctacgcctgctgggaacgtggaattcagcatacttcaccaacgggtgctatttactgtctgatttacaagtccagatctcacgatcttacaagctgcaagatcttcctcaggaccttcaaactgccgcatcattgtgtccaataaccacgagttcaagctccgtgtgttgccaaggaatgagatgtagtgccgacttcagatcggttcgtgggatacgttggcactaacccaaacgagccatctgtgctaaacgtgttggaagactacgaatcctcttcggagccaccacgagatgtgaacgtggtcgacaccactgagatgggctgatatgtgggcccaatagtttttattttttccggatcagattgctacgtcagcgccacatcaacgttatgtaaatgccacataggacgaatacctagtcaaaggagccacataggcgccccatcagctaaaactggggaccatactgccgagagagctaatttgcaatgattttgtaagttggggatgcgtatctagttttatggtttgaggatgattttgtaattcggtaacaagatgagggacctctggtgtactttttccatgctatatactcccaactcccaagtagcattagcattaccgagaatggcccagacaggtttttacggtgctttaacaaaggtagttgctattgaacataaatgcaacaaaagctagggttttttcgtgaccgacatggttttgggctggcccatatcacatcttgggcccaaatttctgtcacgagacaaccatagtttaatttgtgtccacaagacaaatatggtgctaaccaaccacgaaaatcatgcatatttgtagcactcaaatatcgaccagtacagttgttgatccactggctgcggtttaatttttgtttgaccgttgatatacgatgcacaaccagatgtcggaggaggttttcggacacgaataaaaaaactaattttataactcgtctggaaaccacgagatgaatcttctaagcctaattaaaccattattagcacatgcaggttactgtagcacttatggctaatcatggactaattaggcgcaaaagattcgtctcgcgatttctatgcaaactgtgcaattagtttttgtttttatctatatttaatgctccatgtatatgttaaagatttgatgtgatgtttttagaaaaaaaaaattgggaagtaaaccaggccgaagtgagtgcagatgcacgcatgcaaccatggcagctagcagaggcacctgcagcagctaagctaggtttccctagatagcccgcctgcatgagcaaagctgcgtacgtatgcaatggcattttcttgcaagctttggccaggttgggtacgtctccatctgcaagtattttcgttcatgttatatttgggtcctttttgcttttcttttatttttttattttaagaaatattcacctagcataaaataaatttttttaattaattagactagggttcaagaatacataaattaattagactagttaagttattactccctccattttttttgtttgatgttagttagctcaaaattgaactaactaacgtcatacatttgtgcaaagaggtagtaatttgttagagtgaactagctagttattacacgattgacacgggggccttggcccccagtcccactcggtgtaaaattgttaaaattgttgtttagtgactcatattaaaagaacatcttggttttaatttaaaacattataatgatctttatagagagagaaaaaaaatattgcaagatgttcaaaaaacattaacagtgtttcaagaaacaagtcatattagggttgagataatttttctacataaacatggccagttgtaatcctttaccattagcattctatgaaacaacatatgaatacattatttcccttactccattgtctgttaaaaaatatttgatttatgacaaagaagtatttgcatttatatttgtgtatcgttattgtttccagacatttgaaaaaacaagtcttatattgtatttgtatactaattttttatgattttggcaatgcacccgaaccactacgtacaagtatgaataaacatgtcctttctgtgcccccactcagttataatcatcatttttacatccactaacaatcctcaatggcaaaatttagaaataagatggaaatatttcatgataagacaaaatagtgaatttattctcacaaaaacttagaaaaagtttatcacactttggagatgcatgatttttgttgcatgatgggaaataagtactcatgctttataccttattcagaaccgagagaaatcaagactgaatgccactgtccagactcggtttgttaccaaatctagaagaacaactttgattaaagaccaggttggcgtaatcttaggtgaactgaccatggagggctgaaagcagagggctaaaagcagttatcaatagtataaacacattttctgcaatggtaaagcaaacattaagacttgaaaggcactatctccaactggttatgttcctgatacttttcagcatgttgttcccctaaattctgaagaagtacattattctcatgctgaatatttggtatctccatatgcaaatcctcaatttgctaccacaaaaggagtgaatcctcatccataggaagaacatcaatgaactccccattaagcacaaaatgtgtagagtccttgactctccattacctcccatattagcaggatttaccataacaattctttgagccacttcactagggtctgtataaagatattttgtcagaactctgccaagaacactttctctgtgatgccaacgtattaacttcccaaaagtgtttgcaaccctataaatgtgagtctcatttctgtaatccgaaggaatccctaaaatcattatccaaccttcccgattgaaggggatatcaggtctcataaagtgttcttggaaagccccattatttagcatcaaatattggccggctatcaaagtatccctatgcaactcggaaggaacttggatcaggcataaaaagggaaacctgagggcgtgaatgacatgcatgttgaactgactgtttacggatcaattgcaacattttatatatgtaacaagatccacctcaacagtaattctgaatagacttaatgtttgttatacaatgtataatttcagactaagcaatttaaataccattattgtgagtaactaaacaacaattttacaccaagtgggactgagggccagtcaattttataccgagcaggataggggcttagcccccagttacatcgagcggttacaagatcaaaggatatttaggtcgctactgatgtagtctacatcctattaaagaaagttatactctctaatagatttttttgtgtttcttaactttggtcttgagagtagtataatatgtcgataggttagagggacaactaaaaaagtatagctgttagtgagaattgcaccatgtagttgattttctcccacctatcgacccactcaaacttggtacataggctagatcttgaaaacgaatataaaaaaatggttcaacttagctgagcattgggcctgatcataattatagctatattttgttagcttctcttcttatgtggcaaatcttctagataactttgttactttctttgaaacataagtagcgataagtgacacgtcttgtttagtaaccagttataaatgtcataaaactagttcacaagtatagctaatatgttcatttcatgtagtatactaaattgaatattttcactggcaattgcaattctaagactacaaaagttgtaaataaaaaaatttaaatacttcccagatgactggaaacaatattagacaataacaatataagactggatacaaatataatataagacatgttttctcgactggatacactaacaatacataaatacaaatacaaatgcaaatgcaaatacttcttcatcataaataaaatatttttcaacatgcagtggagtgaggaaaataatgtattcatttgttgtttcatagaatattaatggtaaaggattacaactggccatgtttatgtagaaaaaatatctcaacacaaatatgacttgtttcttggaatattgttaacaattttttctagcattttgcaatatattttttctcaatgaagatcattcttatgttttagattaaattgaagatgttcatctagctaggagaaacaagtgttttacttcttgcttctggatatcacacaagtactacttagaatccaaaataagctaaatacagtcagtgtagcatctgttctttgagagataatggtgctagtatattctaacagcatgtggcaatcaaataacaaaagataccagatctgcaaatagagaatcctattgtcaagtgaccgagtgttatttatgcaaatcctatatatgatagatatgtacttaatcctggatttataggtgtttctactatgaaggtattattgttgttaaaactgaattataagcttgaatgccaatatatttaaaatgctagactttgctgttaaaattctcattaccagcccattggtaaatatgcttgcaatgtgaccacagcaatgcctcggtagtggcagctgtcgtagtttaggtttgttggttgtgagtatgttcagttgtggttttagtttagtttttttattaactatgtatggtaaggttttgtctcatttctctttaaaatgaggtatataaaatacaatggtaatggcttggtctgtttagggaaaaaatgtattactaattaccatatgtctaccctaaacaagctaaaaagtttagattacagtaccactatctccctctcaaaataattataattctaggtcgtttagcatatattaaggtttgaaaagaaagactatgatgcccctcattaaatgatgtataggtaagagttgaatagtggttgagggtagaatagggagaaatttgaataagaagtaattgatgggacaattagtactttattatgataactattttgggacaaatttgaattgtagaaatacaattattatgggacggaggtagtacaatttatttttgaaaacaaatataagtgcaaatttggaaacaaaaattttgaggtaccatatttggaaaagtataaggtgtcatactgtgcattcaaacaaccatgcccttgatatatactccctctgttctttgatgggtatattaatggatggaggtagtattatattttgaatttattggtttcatatacagggagaaaaagtatgtttctagatgagaggggtgattatgataatttcttatgctcccatgagctcaaattaacttgacagattttctatctcagatttatatgaattcttctcaagccagaattgagcgaaaggaagtatctttttttacggtagcgctaatccacgcgctgcgcgcggaatattagttcgagcgccgtacaatgctccctccttccgatctttccgtttttttaccaccccacctttactccgtatcccatctttcctcagtttttttttgttttgtaccaccccaccttctatgtttcttttttctcttttccatcttatccgtgcttcatcaaaggacctttttgttttctgttccttctctctaggttttctgttttcgccttttagtaaaatatttaccgtttagtttttctttcggagttttttgtttttccagtgtctccccacgtttcaaaagtaataaatttagtctgtggagttttccatttactcctaacctcccatatctgctaattcaaaactaacaaatttactcgcatgaatgcccctttcaaaagtaacaaatttacttgcacaaatgcccccacagtgtacgtgcaccattcctagattgtcgtaaaagaattactaccagcatacaatgctagtaattctttcaccagtgttataaatattgtttagatttcgtggtctgcgactaaaacaattaccaccttcctatcgatatagcccatgatctcgtagccaccgtgtagtaatatgtttcttgatgtgtttaatacacagtataagagtaaaaactgggacttcgtggtctgcgagtaaaataattaccaccttcctctcgatatagcccatgatctcatatccacagtgtagtaatatgtttactgatgtgttcaatacacagtataaaagtaaaaactgatactaagagtattgttaatctgtataaaaaatgaccttacgaataaaaaaaattacatgctcaatcacacacaagtgatagaattactcacaagtgaatcaaactagaaaagaaaaaaaatgattcagcgaaaagtccatcgtgaaactgggatcctagtgactttgctggatcttgctataaaaatggagaggatggtttgtgtattgttaatgttaatggagagggcaaccgggtggcgagcggtacgtgatgatggaatcaagggagggtgtagtagcgtggtatagagatgggctcgacattgcacagtagcagccatccatcatctagcaagcacgaaaaaaatgcaaaaacattattgttcatgtcatagagacgacgagcaaaagaaaaatagcaaacaacctccatcaccagcggactccaccctatcatgtggctagacacatggagcacgatgtgcaggacctgtgcaagccatcaatttagatcagataatattggagattacatgttaatttgatttgcaaaaagaaattggggcttcatgcgtgaacgtgaaggtgaaggagagtatgcagatgcaaatcggagtgccatttccttacttgcttgttctatcaatattgccgacgtggagcagccgccggctgttgctcttgacctaggtgaacacctccttgctggttaaggtgttgctcggcgtccgatagcgaggcccggagcagcgccttcgcctcaaccgccgccggccgccgctgtcaaccaccacgatgttgtcgtcctcctccacggtgcgtcaccgatctatgggctgggatggtggatcgattcagatctgaaaaaaaaggaaataatgaagtgggggcgagagtggttggttgggtacgagaaaaatagaatatataccggaagcagggaagttgtttttatcgccgtaaatcatttactccgataatagtgggagcaggatgacgggacatagggttgtatcggaagtagggaagttgtttctattatcgaagtaaatcgtttacttcgataatggtgggagcgggatgatgggacatggggtgaggtgggcctagactaatacatgtttggcgctcggaatattaggaacgcgctgcgctcctaatagtagtaatattaggaacgcgctgcgctcctaatattaggaacgcgctgcgcttcagttattcctctgatcttgtatctactgacaccggcaagatgtgtaacaggaacaatctgaaggacaccctgctctctgtctacgggaacaatctgaaagacgccgtggacgacgaactagtcgaggtaatcaaaccaacgaccccaaatgaaatgtaattattgatggttctaatctctggcatcaaatttgtaaacactgaactatccccaaaactaatccatgaaactcttcctcgagacaagtctctccagttcttcactgctgccttttgtcgtcggaattttttctgttcgagctttgcacggccgcgtcctgtcgtcgttgtgttgatctgctgccaggcctagcgcctttcccctcgtagctcgatgcccacagacgcacgaacacatgtcccgatcaccacatctctcactgaatccacactcgcagatcgtcctatgctctctctctctctctctctctctctctctctctctctctgcaatcgaccaatcgtggactggctgattcggttggactgcaatcccgctgttccctccgagctgattttattgtaattattgcgtccgatttagagtctgttaggaaccacaacctctaatctcaattccactcaaatatgcaagcatccagtacaatagcaaccagtaaatagaggtagaagtgaggatgaactaagcgaatacaagtggtggaagatgccagaaacttctagaaggtagaggaagaaggaaggtaggtagggaggaaggaaatcgacaaggtgccaactggccaccaggtcgccgccgcggttcgccgttcgccaattgatctgttcgatgcctcgagcagggctgctgctgccttttgtatcctttcttcagcctccatgggctgggcttgtagtatggctaacatagcccatgtacagcccaattgagttcctaacagagtcaaaaaaatatagaatcccctccttgacttgccgagttctccgaagttcggcgagcctattttgtgcctctctgaaacccgtccgtcgtcggagctgttttccccaatccaggcaccgcccgcttcaccattgttgcgccctggcttctcatcgctcatcgccattgggggtaatggctttctttttccctccctctcttcctttcaccctgtcgcgttcgaaccagcactccatcccaaagccaaatcttctccccttcgctgggaatttggtcgctgctagcgaatcgatgtagcttggcaacggacctactctgccactcaccgccggtcatctccagtgatccagtgcctaactgatccgtctatcctcgtcgtccttctccactcgttccaatcctatgctccacctccactttaccctctcgtgcctccgttcgctggagcactgccggtcatcgatcccgcctgggttatagatggccatgtgggtcgtccggcacggcacggcctaggcccggccgtgcctaggccgaggcttgtcgggccggcatggcccgactgacgcatcgggccgtgccgtgccgtgccagcccacgtaacgcactcacggcccaggcacgacccaacacgcctcgggccgtgccgggccggcccgaaggcacgatgggctatcgtgcttttcttcagaataagcctaattttcgtccctcttattgggctgtgacatatatatagctaaaaaaaagtctattttacctccctctttttttggctgtggtagataaatagctaaaataagtctatttaaggtccttattctttggacaatgacatttatatgtctatttttagtccctatactttgtgtgccgggcctggcctgtcgtcccatcatgccgggccggcccgatcgtgccgtgctgtgcttgggccgggccaaaaagctgttccgtgggccaggccttcgtgcctcaggccttttggccatctatacctggggtcaactccctccggttaacagatgatatggctgccacgttgggctcaacgggcccgcgttgcgccagcgtccagcgagatgcggcggccacaagctaggccgacggccttggtagcttgcaaagcctcaaggcctagtaagccttgcccaccacaacatctcctcctccctcatggtccagaatccgaaatccaccaaccccctcctttccatgtggaataagttcaccggccgtccctcaaccacaaaaccagaaatatgtacctgaactatgtaaaaccgtgcataaaatgtcccaaggcagtatagaggcctagtcagcaaaaataattaaaattaatatgttgggcccacatataagtgagaaaatggtgtgggtccaacatttcaatttttttttcttttctcttctcttctctccgggttctctcgagcaggcgtagcgacagagggggagagaggtggccggcggtggcaggagagggagagagaggcggcgggcgtgacggcggtggcggga

SEQ ID NO: 8185 - DNA, 16318 bp, Oryza sativa
cgccgctgctggccttctacgccttggctaattcggcgctcgtcacgctgtatgcgatgtgttggaaggtgagctcgccgccgccgagctcgccgtcgccggctgcctcctctccttcctctcccttcgccgccggtggggacgcaatgttcttgttcttgtggcggcggcggcggcgacgtccgccggcgccagcgacaagccaacgtacgagaccaagtccatagacccgagcctcgccgtcatgacgttgccggcgcctgtaagtaagctatccatatccatctagttgcgccgccgtgtgcatgatctcgcatgcgccgacgatttgttcaccaccaggggcggcggcgtttgctcgccggagaagaagctggtggtgccggagagcgtgtgcgggcggccgctggggctgcagttccaccacgcctccggcgacctgtacgtggccgacgcgtacctaggcctcctgagggcgccggcgcgcagcgggctggccgagaggtggtgacgacggaggccgccggcgtgccgttcaacttcctcaacggccttgacatcgaccagaggaccagcgacatctacttcaccgatagcagcagcacgtactggaggaggtaccccaaattaaatcaatcggtcatgttcatactgcacagtgtgcatgcatcatgcagttaatcgtgtgccacgctcgccctccgctgctctgccgccgcgctcgccctccgcttctttgcctgcagctgagctcacgcccgccgccgctatgctgccgcgctcgccctccgctgcgccacctgcatccacgtgtgccgctccgcctaacgccggcctcactcactgaagaagagaaagagaggagagagaaaagagaagagaaggagaaggagaagaaaagagaagaaaaaatatgcagctgacatgtaggccctatgtactttttaaaatttcttttgctgattaggataccacgttagcgaaaccaccaatatatactgccatagaaccttgagtgaacggttttagtaagtttagggtaaacatatctggttttgtggttatggaacctcaaaaattctcgctattaacttgagagacctctggtgaacttattcctttccaagtcaaattattatccttcacctaagttccttttctcatgggccgattcacatgagccaacccttctcaaaccgaagtccaatatacctacccctcaaaacacagtatcagtactggatcttcccatggacccattccaacaaaatgtctctcctgctttacccccaaagcccaaaaggagggctgggaaggtgatcttgatggatttagaaaggaggagaagtgcaagtatcaacaaactttctgatggatttatgtcccctgatccaaacttgggtgtgggaaagccaaggggaaaggatagggcaaagagtaccaagaagcttaaaatgttggctcaagaaagtggtatcttactctctcttaaccctttgcctctggaacttaacgatcctaatgcttcagatgatgagattgatgcccctctcgccgattgttctatacggctccttcaacagattggcactgaggtctgtgggatgaacagggagatggtatctgccaaagccttgactgcccatgctggaactgggagtcaccctgctgctgcatcctaattctgtcccaatgaacagttctattttgctattttgtgaccctgtgttaggtctctcctgggtctgtaataatgaatttgcctttaaaagctgtgctactgtgatgaatgagtcatcttccatgaaggctccaaccgttggtctttggtcatgtattatgcataggactttatcttgtttctttttgatggacaatgaattcgcacaatagaaactggaatattttttgctggaattttaggggtctcaactctcctgcccgttgtcaggctacaaagcaaaagatagatgaaagtgcctgctcgattttttgtttataagaacaaaaaaggatcttttttatgctaagtttcttaagacgctagcccctaagtgatttgataatttctttttctctccttctgttggagcctcggggggtgttttcattggctggtgtaactctatgttttctagagttcacctacagcaaacccagcatgctttagttgtcatgctttagttgtcagtttcacttcaaagttaaatggacagaattgggttttgatcaatgtttatggcccttcccatggtcctcagagagatgagtttgtacagtgcctacatgatcttgatattgccaatgattattggatgatcctgggagatttctgttagaataaatgggctaggcctgatttttctattaaatctcaagagcccataataaatgttaaggataataataccacgctgcaaattaaaagaggagtatctcaacttaaatagggagttattggaggctccctgttgatcggttgaggtggggattggaaagccacacgcgcgcgcgcgtgcgagccgagccgtggcgtggtgtgcgtttgcatttctctctctctcctttttgcaacggaccagaatccaatcccgcgagatttcctctgcgtctctctctctctctctctcctttttgcaacggacaggaatccaatcccgcaagattgcctctgtaatatatagccgattcaatgcgattgatagcgtggttactgcggcaacgggcggattcctttcctgcgatattaggaaacagaggaccccgatcagatctgagagcttagtttccaaacgctggttcttcctcctagtgcctgtgctacttctgtttccccgattctgatcacttgcgcgcacgagtgatcggaaagagcagagcctccgaaaccacaccttcgtttgagatctgcacgggtaggcgggtgatcaggtttttggggagtgcttccgcacgactgctctctcttaatcatcgtcggtggttctgttcggtccgcgtcacggcgatgtctactagtggtggcgtcaacaaaggggccccaggaactggaaatgcaccgatcgacaacaccaacggaggtagttctgcctcacaatccagcggagggacctttacagggtataacatcctactgctatttctgttttcgttacttctggtaatcacaattttattgcattgtctacatgatgttgatgcttattttatcttaagcatgctcctggttatgtttaattttattactagatcacctcatgttgttcatgccatgattattgtcttaatattttggattaaaatatgccgatatatgactatatttccaacaatccaaaaacctgataggtcattttcggtagttggctttgctgctgcactgaaaccacatgcttttgatggttctaattataagagatggaaagcacgtgcactactgtggatgacagcgatgcaatgtttcatggggaaaacgaagtgaaccacctttctctcctgaggaagaggttaagttcgaggcttcggatttcctgttccgtggagcattgatcagtgtactcgctgacaatatagtggacgtgtatatgcacacgccttcagggaaggacatgtgggatgcacttgaggccaagttcggagtttccgacgccggcagtgagctgtatgtcatggagtagttctatgactacaagatggtcgatgaccgttctgtagtggaacaagctcatgagattcagatgttggctaaggaacttgagaacaacaactgtgagttgccggacaagtttgtggcgggaggcattattgccaaattgccaccttcttggtcagattttgccacttctttgaagcacaagagacaagagttcagtgtatctgatctcattggctctttgggtgttgaggagaaggcgagggcaaaggacaacggggcaaaaaggtcgagggaggttctagtgctaatatggtacagaagaagaaccctcatgcatcccacaacaacaagaaagtcaagcctgatgtcaaacccaaggctacaaccaattttaagaagaaaggcaagggaaaggcaaagggagactgctttgtgtgtggcaagtctgggcattgggctaaggactgtcctgagcgcaaagacaggaagtctgccaacatggtcatttgcgaggcggaggaatattggggtacggtaaaattttacctaaagttctctctgtttttcattcacctgattggtaggttgatactggtgctaatattcatgtatgtgctgatatttccctgttttcttcttatcaggtcgagagaggttcctccttgttgatgggaaacgggtgtgacatcccggcccaataaggattaggcctgtgtggcccatgtgagctgtgtgcgcatgtttagtaccaccttgctagtttagcacgagtggaaccgacttataaggcctcttccctccaaccacatcactcccttttacacgaaacgaggacgaaagtgtaagtggggtggtgtgtgtaagtgggcccgctcgtcggttgggctgggctacgcggttctagagggagggctgttacaacgggtcattgcggctgttcatggtgttggtatagtcgatctaaagtttactacgggaaagactgtgcagctgaacaacgtgcagcatgtcccttcaataaagaagaatctagttagcggctctctaccatgtagagaagattttagacttgtgtttgaatccaataaatatgtcatatctaaatatggaacttttattggaaaaggttatgacagcggaggcttgttccgcatttctttggatgacatgtgtaataataataatgttgtgaaccatattagcgagaatgatacgtctaatgtgtggcattcgcgactttgtcatgtgaatttcggttgtatgacgtgcttggctaacatgagtttaattccaaaattcactttggtcaaaggttccaagtgccatacttgtgttcaatcaaaacaacctcgtaagcctcacaaggcatctgaggcaagggatttggcacctctagaacctgttcattccgatctgtgcgaaatgaatggcgtgttgactaaagggggaaagaaatacttcatgacactgatagatgattgcactagattctgttatgtgtatctattgaaaacaaaggacgaagcattgcattactttaagatctataaagctgaagtagaaaaccaacttgaaaggaaaatcaaacggttgaggtctgataggggtggggagtatttttccaatgagtttacatccttttgcaaagagttttgaattattcatgaggcagccgaaagaaacggttgaggtctgattggggtggggagtatttttccaatgagtttacatccttttgtgaaggatttacagttgacacctccctattcaccccaatcaaatggggcagccgaaagaaagaactgtactctaactgagatggtgaatgccatgttagacactgcgggactttccaaggaaaggtggggtgaggcaattttgactgcttgtcatgtcctgaataaaattccaacgaagcataaagaagtaacaccattcgaggaatgggaaaggaagaaattaaatctctcatacttacgaataaggggctgtttggccaaggtaaatgtacctatagccaaaaagcgtaaacttggaccgaatactgttgattgtgtgttccttagttatgctattcacagcgtgggttatagattcttaatagtaaactctggagtacccgacatgcgagttggtacaattattgagtctagagatgctacattctttgataatgaatttcccatgaaaaatatacctagcacttctagtcaagaaactgtcataccccatgagcactttgcaccgatacaacataatgatcaagcgcctgagggaaatcctgaggaggataacattgcagatactcgtaagagtaagagacaaagggttgcaaaatcctttggagatgactacattgtatacttcgtggatgacactccaagaacaatagaagaggcatattcatctcctgatgctgactactggaaggaagcagtacgcagtgagatggactcaattatgtctaatggtacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggatttttttgacacctactcaccagttgctcgcctgaccacgattcgagtactacttgctctggcagcctctcatggtcttctcgtccatcagatggacgttaagacagctttccttaacggagagctagacgaggagatctatatggaccaaccagacgggtatgtactagaaggtcaggagggaatggtgtgtaaattgttgaaatccttatatggccttaagcaagcacctaagcaatggcataagaagtttgacaccacacttacatctgtcggctttgttgtgaacgaagctgacaaatgtgtgtactatcgctatggtgggggagaaggagtgatcttgtgtttatatgtcgatgacatattgatctttgggaccagcctcaatgtgaatgaggaggtcaaggactttctgtccaagagttttgaaatgaaggatttgggaaaggctgatgttattcttaacattaagctactgaaaggagaagagggggggattacacttgtgcaatcccactatgtagacaaggttttaagtggctttggatacagtgactgcaagccagctcctactccttatgatcccaacgtgctattaaggaaaaaccgaagaatagcaagggatcaactgagatactcccaaatcattggttcattgatgtacttggctagtgcaacgaggcctgatatctcatttgctgtaagcaagctgagccggtttgtctcaaatccgggagatgatcattggcaggctctggaaagagtaatgcgctatctaaagggcactatgagctatggaattcactataccgggtatccaaaagtactggaagggtatagtgactaaaactggatatctgatgccaatgagataaaggccacaagaggatatgtgttcacacttggaggtggcgttgtttcctggaagtcttgcaagcagaccatcttaacgaggtcaacaatggaagcagaacttacagcactagatactgcgatagttgaggccaagtggcttcgtgaattcctgatggatttgccggtggttcaaaaaccagtgccagctatcctaatgaattgtgataatcaaacagtgattattaaagtgaacagtttaaaggacaacatgaagtcatctaggcatatcaaaagaagactgaaatctgtcagaaagcagaaaaactccggagtgatagcattggactatgtccaaacggctaaaaatctggcagatcagtttaccaagaggctaccacgtaatgtgatagacagtgcatcgagggaaatgggcttgatacctacctaaggtcgcacaatagtggaaacttgtccattgtgatcggagatcccgtaaatttggatggcgaaacaaactattgtgtggctgagagaagagacccttgaaaatggctcattttcatgatgtacttctcttctattctgcatggtaggatggcttatgccttaatgtggtcctagtagcttttctaagcagagatgttgacctgcagaacatctcagaaggaacacacctatatgagttcgactgctagtcacagtctatgagatttggacgatctctagatactcatgaaagggcctggagtttgacttatatgctccaaacagaggggatgcaaatggcagcccagtaccagtcaaaggtttgagtgaaacctgatcacacaagactgacaattcaaggcatagtccattgttcgttgtggtctgatgtagctcatttcctatgtggaagttcaacttaacagtctctaccaaaacactggtatatcaaacaggttcaactttgagaacatttcttatgagccatgaaatttggtgaggattgttagaataaatgggctagacccgatttttctattaaatctcaagggcccataataaatattaaggataataataccacccttgaaattaatagaggagtaactcaacttaaatagggagttattggaggctccctgttgaccggttgaggtggggatcggaaagcgacgcgcgcgcgcgctgagccaggccagctaggccgagggcgtgggcgtgcgttgcgtttgcgtctctctctctctcccctttttgcaacggaccggaatccaatcccgcgagattgcctctgtaacggacggccgattcaatgcgattgatagcgtcgttactgcggcaacgggtggattcctctcctgcgctattaggaaacagaggaccccgatcagatctgagagcttagtttccaaacgctggttctttctcctagcacctgtgctgctcctgtttccccgattctgatcacttgcgcgcacgagtgattggaaagagcagggcctccgaaaccacacctttgcttgagatctgcaccgggtaggcgggtgatcaggtttttggggagtgcttctgcatgactgctctctcttcgtcatcgtcggcggttctgttcggtctgcgtcacggcgatgtctattggtggtggccgtcacagcaatgtctaatggtggtggcgtcaacggaggtgcgccaggaactggatacgcaccgatcgacaacaccaacggaggcagttctgcctcacaatccagcggagggacctttacagggtataacatcgtactgctatttctgttttcgttacttctgttagtcgcaatgttattgcgttgtctacatgatgttacttctgttagtcgcaatgttattgcgttgtctacatgatgcttattttatcttaagcatgctcctagttatgtttaattttatcactagatcatctcatgttgttcatgccatgattattgtcttaatattttggattaaaatatgccgatatatgactatatttccaacaatttcaacttctatagatctgttgacaacagaaataaaccggggggcaacatgaatgatatatttatcttcaatgatgtaatcagttccttgggcctgctcgagattcccctaagtggaagatcttacacatggagtgatatgcaagctgatcctcttcttgaacagcttgattgggtttttacttcggctaattggatcagtgtcttcccaaacacgcaagcactagttacggctaagaatacctctgatcatgcccctatcaagattcagattgccacctccattcctaagtccaatgtcttcaggtttgagaattactggttgaagcagcctgggcttttggatcaggtctctactgcatgaacagacattcctcacataactgatcaagcaaaactgatctttgctaaatttaagagcgttgctctcttaagaaatggagtcaatctatctctaagttgtctagaacaattgaaaactgcaacaaggtgatcctgtttctcgacaaattggaagagcttagacttctgaatgtgccagaactgagatttaggctgatttttaaagatcatgttgctcatctactccacggtcgagagctatattggaagcagagattcaaacagaactcagttcttttagggggtgaaaacaccaagttcttccatgcaatggccactgaaaggtacaggaaaaatgccatctcctccttgcttgatcagaatggcaatcaggtgtttgatcatgaaggaaaagctacaatcctctggaatatttacaaaaataggatgggagtttcggatttaccctctatggtttttaatcttccggatttgtttgacgataatggtgatattttctttctttgtgatcaaatctctactaaagaaattgattgcgtggttaagaatatgccaggagataaagccccaggcccagatgggttcaatggatgtttcttcaaatcctgctggccaactattgctcaagatttttataggatgcatgtgtgcagatttttggggtggttccattgacctttctgccatcaactacataattaatacatggtcccacctctcatacgcacataacgtattggagtacatgttacagctggctacaaatctgtagcctattttccttctctctcttctcttctctcctctacgtgtgcttacagctaacttgtagcctgctattgtactcactctaattggaatgtgcatgcacacattctacatccaaccactggacataatggacaataacaatttggcacattcaatgagcaataaaagtaggcaaatataacgacaaaggagacacaagctttgccgcagctaccagcactggtggagaaaacctttttcctcctggttcgtaacccccctttagtctcggttgtccaacagggactacgaatccgggactaaagatcgctatctttagtccagggtgaaataaccgggaataaagatgagtcaaccacatggtcggcagagccatctttagtcctgttggtgtagctaccttttttttatttgcatgggcaacagggccatgcatgtatctatatatgtaatacatatatacatgcataatagatatgtatatattaaagcacttaacattttatgtgcatatatgaccaaaacatatatttacactaaagtaaatgtgtacatatataaaaatagacatgtattaattacaattcattatgtcctagctagctacgacttcgacgtagtagtcgttatctcagaagctaacgacttatcaattgtatttccgttgtagtagaattcaccctcgggatcaaggacttgttcgttgatgaatcctatgagttgttcttgaaccgccgcgataaattccttgtgtgtgaggttatccctcatgtgaataacctatgaatatatgaaattaattagtaaataaaaaatcgatacgtacgcaatgaaatttggaatttatttatatgtacatcgagctctcttgtggtgtagatttgggttgtaaggcagtggcaatactcgcatacgtagtagccgcacaaattagttccctggtcttgctttgcacactacatatatatacatgacaaacggcgagagatttaatgaatatacacttatatttgaattagagattcaatataaatgtagagcatgtacttataggaaatttgaacctccgcctaagcttttctttccaattgccacagaccaaatgacggaagcgataccaagccctacatggagtttaaagctatgattcgtagtagcaattaatagcaaaattcataataacattggaacttatgacattacatgtctataagttcaaaaacctagtcaaaagtagactcatctttattcattgagtcatagacattgactctgtaggcctctaagtcaaagagtaaaaggacctagtggaatctgcaatatgtgtgaggtgatatatgaaaaattgtacatctatatgtatgggaacgaacttttttcggaagacagtaaaaactaacgctgtgttgtacggcaatagtatgaacgtcttgaaatgttgctccttcaggagatagacgagattgtcctctgtggcttgcggatacttggtgaccatttcgatgtttactttccgagggtcgatgaatctagtatcgaaaactccccgccgtcgggccctttgaatctccattctacaacgatataaaggaattgttatatatatggtgtacatatatatacaaggagctaattaaaggaacataagaaatataactcaacgatacgtacaaaatccatgcgctcagaatagatacgtcgagggcgtccagctggtatagttcgtagatatccttgaaattgatccagagaacatcttccccttgtaagaagtcggagatcttgatcctcgctccgataatctccctaccactggcgctcatctccatgtaccattgatggaatttgtacatctgtgtcagtagggactgcagctgctcaggcttgacaagtggtttaccgagttcgtagtggtgtctcacttctgcctttgggattggtgtgcctttaatcaactgagccctagttagcccggtgtcagaaatgaattcttttattccaatttcttgcccgatcaccaatagctcgacctcctggtttggttgctctccaagctgagggacttgtttgtactttccataatatgctttcttaagtgttcgctcatagtccgttagctttatggcctccttgactggtgccgacatactcctgaagaacttcttggcactcgggtccacaggaatcttcttttctggactccgaggcttcaattgcctcttcacttctgctgccacgtaagcgtcaagctcctcttgcgtgcaatcgtacggtggctccttgttcttagcggcatcaactttcgccttcttcgttgcccttgtgcgggcaaacggtggagcttggtgagttcttgacttggaaggtgttgtaacaccctgaaaatttcgaatctgaaatacggagttaaaaattcggaataatcaaaaatctttttaaacctttttgcatgctaggatttattatgcaattgtgtgtatttaggttgtgtgctaaagatctcgattaaatcttatctcctaaagggacgccctcagtccaatgtcttctcctttccttatctttacggtctgatttattaagtgcttcggtactaaataaatcacagaccttaatatataacccaaaaatcttttcttatgtcgcaatgcgacatatctttctcaattcttgccctccggttatttaaagccgttatgttaattcaactcaataaatcctatgtctacaatcgatcggcgcatttacttatcatacatccattcaaacatatccgattctattcctatcatgacgagtggattagtatgccacgcgtcatccctaaattcacttcttcgtttccgtcgttcgttcgtgcggacgcccttaaaataatcctacgacgatcgacgagttcgcttatcaggcgttaagcctaaactcctatttggcaccacggtgcatccatccaaacaaatcaaatctcatattgcaatccctttattctgtcccggtgcatgctcgaaatatatttacagtccaagtatatttctagtccaaacacagagccaaaatcaatatccatattctacagtccaaatgcacagcacattattcagtccggttacaaatacactgccaatttacaagtccaaatgtacatgttgtttccccccacccaaatccccttgcaaattcctaaactacaaatctcagaataatacaaaagttcctattacagtggaccgccttttagcccaagcccactgtcagcccaactcatctcacaacaagtctgttttttctccctaatctcagaattgcagcctaccaagcaaccttctcagccaaagtctgctctccctccccagccgatcatatgcatgcacagaacctgttcgacgaattgcctacaagccacaacagggttttacacccacttttgccgaaccacaacagtcttttgcaccaaattatgcggccattcaataccaggggcccttcccaaacaacaatccatacaccatacacccaatccacaaaaccatccacaaaatactccccaaacacgtgcagcatagtgggaagagttcacaccgatcaaacacaccgagttcacagagcagccaacaaacttaccttgccccctgtgttccaacagcttcccatgcaccagcagccggcaacatatataaaccatcgccaaaacgcggcctcacttgcacctctccatttcttcacctcctccctgctcgagctctactacagccactcctctgtccagcgcactggctgcctcctctccgcttgctccgccgcggccggctccgactgggcctcagttgagcaagaggacaggaagaccgccgcgccattgatcacctgagaacgactaactttgaacgattaacccctaacatctaacccttttgttgttctgttgcactgactcactaacccgctgactctttactttcggttgcactaacctctgactcactgactcactgacctttccatttttgtttcgctaacccgctgactcctttactttcgtttcgctaacttctaactcgctaacaccctgactcctaactcttacctcgcacctaacccgctgacgttgccccttcgcattgcgtgttcctttgttgacaacgatcgaacacgtggtgacgcgccactgtcgtgaccttaggacacggacaaatttggggataggcgggaaaatacaatttcccgcctatcctggcgctttttatcttaattcccctctcccttgctacagggtttcggttggcttttatagtgctcaaccataatctcaagatttacaagtttgccacctagggttgacatgaagttaccgaattgcccctagtaacctatgtctcataggggtatattggtgcattttgtggtccccaactgacattcagcgccagctggtgagagtggttgaagtggtccccatgcatggtatttccttgaaatgggccaattgctcgatggtactttccttcaatctttagcattcgaattgatctggccacaccaggagtcgaacacacactcccgttttctcagctccttggccacttcataagatcctgctcaaacacaacttcattaggaaaattatgtcgaccaatactactggaacgaattgtcctgttttgggtaaacacaaattcctagacgagagcaaacctcaaaagtggagaattacttcgagcatttttattcgactaaaaggaagaacttctaaaagcatgtttttcagccaaacttgggggatggtgttttaccccttgctacaacaagcccctcacgaataagggcgaagtgttttcggccgaaatcgtgctcgaaataaagatgtaagggataaaccgccgtcccttgtttgggcgaaaacatcttcgagttttcaacttggcgatcgttttaaaattccttaatttgttttaggcaaattaattaagtgattagtgagaggaaaagttttagccacccgtacaggattgaatgattagctaaacgattaattaaacaacacgtacaggttgtctttgatttgattgattgattggttaattttaaataatatttttattattattattattattttatttatttatttattattattatttttaatagaacgtgtaaagttttatgccatgtgtcgcttggttataggggtaatattggccagaacagccaagtctcttcggctatcacgcccttccccctcctgcagctatatatatggagccatgggtcactatccgatgattgctttcttttgtttcttcgagttcttttttccgataagtcaaaagcatttgcccatcatgggcaagtctgtaaagaaatccgtaaaaaagccaaagaccaaaaaagcttcttctggacttggtccttccattttttcggagaagaggctgaggaaattgcttaaaaaaggcgctattgcagatgccaaattagttatccgtcctgttgatgaatcgggtccttctcctcatcctgggtacactcttgtttttgaggatttctttgaggctggttttaggtttccttgcagttcttttgttgtcgaggttcttggtctttatgggattgagttccctcaacttactccgaatgcggtcgtccgtcttggagtgttcgagtggattatccggagttgtggtggcacgccgcatggctcagatttcgcttattttcatactatccggcgatacacaaagcaaaatacccaatttgggtgtgttagcttcacgccgcgctcgaatcgtggttgtccttggccacttgtctctaccatgcgaaccaagtggggatcaaaatggcaatctaaatggatctaccacaaaatcccagccgatttaaaagctatggagaaatgtcctttcgttttttcttgcaaggatccagaggttatttcagagcctgctgtcaatttgtcgaagaacttttcctccatccgatctcggattgaagagcttgtctccaagtttagcgttcgagatttagttgaagagttcatttgtataggaatt

SEQ ID NO: 8186 - DNA, 1989 bp, Oryza sativa
  unsure (1)..(1989): unsure at all n locations
atcttcaactagaggtaaacttgtcatgacggcttgcgttctcgggattagtgcttccatctttatgacactctaatcctatttatgtaaatcgtcgagttatcatatatcctatataatctctggcaatattggtatttaatccttaattagctaacatatattactggaaggcagccgattaggttaaatattaaccgttgacctagattatatagggtatccaccaccctatgaaacgtccaaccggttgattgtctagatattgtccttcttttctgtcacgcccggaatttctatccaaaattccaaacgcttacatgtgtgtaaaccctcgtccatgaatcagccgaggcacacaataacaaattgataataaagtacaattattactctaattaataagcgaataaaatatcattacagaggtagatagttcctctcaatcaattaaagttctaagcagcggaaaataaaagaaacagcgcaggcgacttctcttcacagtagcttgaccaggactaggcctaatcctcaacaccatcagcatcactatagaactcctcctctgatgaatgattgcaagtaagtatatgacatacctagcaagccacgcagcaaatatacaagtgcacaggataacaaaagatggcatagtatagtctcatttgcataaatagcatttaacaaatatttcagaatttaataaaacagttaaataataattaaacaatattaatccaacgctatacaacataccctgttgcataggcccaaccattctgaacaaccaatcccggctgcacagttctatctccaaaccaggaattaaccattctaaaccaggagctaaacacttattaaacagcatcattaatatggtgagaaatgtgagactaatcagaaagaacattgtagaacccgccattaaccgcgggcacggctattcaaatagtttaaactctacccaaaggtgtacaactgtaccaacaaaacacaacctcaacatcatgtcaaccaagcgtcgcaatactaaacaggtccccgaatagaaatggggacaataccctctatataatacaattaaaagcatgcaccggtcttggatcataatcacccccttataaacaaggtatggactccccaacgacccccgtttgcttatctccgccacttcacagtctggtgctctactatgaaccatactatacagaaagtaaagccgttgctcacgccggcttgtggttggacggtaaatgtttcacaaccgaaaatcgtgaaccggtccttaattgtcatgagcacaaccatcaaaaccatatgctcacaacccaccattatcaatttttagttggcacattaattaattaaccaatcatgattaaccatcatgagctaccattaagccatcattaaataatagtgaagcataagttatcccagtagtgtgctaatgtttctaagcataagttatctaatatccagctgaacccatatatataaagctcaactagtcaagttataataacccaagtatcanagaatagggtaatcaagaaataacaaagcaataggttatttccacccaatgacattcaaaaataaatgcaattgttgaataaaaacaatagctttaaacgagatcaacatgctcaaaggattgtttgggatctgtgtgacttgccttgctggccttggaactcttcaaagtcttctcctgcaaattcggactctccgggaacgtcggaatctaaagagaaaagaacaaaatcaccaaaacagcacataaacaagcatgaacagtacatgtggatatttttaacatgtagatctcaattttaaaaaaatttaaagacttgaaccaactaaatccgagctaagatgaattagttatgaattttcaaagattaaatcggattaaaacatttatatagattttaattgaattatgacacaataatgaattatttttgaaaaggaaaaagggga

SEQ ID NO: 8187 - DNA, 1704 bp, Oryza sativa
gatctcggggatcattttccctcaaacaatttcatcggatcgagaaagggacgagcgaattttgaagggcggcggcggcccggcttggctagggttcagccgggcgacggctggaggtggacgacgagtccgataggtgggccccacctgtcagcgagtgggacgcgcgcgcgagcggcgtctcggctgcaggccaacttgggccggggaggagagagagagggttttgggccgactttcggcccaaagccaaaaggaggatttttaaaacattttcaatttaaattattcatgaaatgcaattccatttattaaaaatacttccttggctcaaataaatcccagaaaaatccaggaactataaaatcaagtaaagtatttaataaaattttatctagccacttttacattgaatttattatttaaaattagatcttctcttctaggcttttaaaatcaattctaataattccaattaaacaaccatttatatatttaggatttttagggtgtgaccaacctatccccctaaaacggaatttcgtcctcaaaattcggaaaaactggcgaacaaattcggaaagctgactttaattcatcttcttgttcccaagtagattcttcctttaagtgattactccattgaacctggcaaaaacggataactctattcctggttcttcttcatctgtttccaagatacggattggtttctcaacataagtcagatcctcttggactcctatctgttcaagattagctttttcggtagggacccttaaacactttttcaactgcgacacatggaacacattatgactcctgccaaagattgaggtaactccaactgataagcgacctctcctcttctactgacaatcttataaggtcccacaaaacgcggtgccaattttctttggtgtgaaaacgatgaacccctcggagaggcgtgacacgaaggtacacatgatctccttcttcaaaacttaaatctctgcggcgattgtcggcataactcttatgacgagactgagccacacgcaatctttcttgaatgatctttaccttctcttctgcttcccttaggatatcagtcccgaaaacctgacgttctcccgtttgatcccacaaaagcggagtgcggcacttccgaccatacaatgcttcataaggagccatttgaagactagcttgataactgttgttgtacgagaattccgcgtaaggcaaattcttatcccaacttccaccgaagtctaaagcacaagctctcaacatgtcttctaaaatctgatttaccctttcagtttgtccgtctgtctgcggagataagcagtactaaagttcagcttggaacccatctcttcttgaagcttcttccaaaactttgaagtaaactggctacctcgatcggatactatcttcttaggaacaccatgcaaacacacaatccttgccatatacaattctgccaaccgacttccggaataggtggtcctcaccaggatgaaatgagccactttggtaagtctatcgactatcacccaaatagagtcatggcccgatgacattctgggtagacagtgatgaaatccataccgatttcctcccacttccattctggtatcttcaaaggctgcaaaaaacctgcgggtttctgatgttctgccttgactcgctgacaaacatcacatactgctacat

SEQ ID NO: 8188 - DNA, 1124 bp, Oryza sativa
gtggtacgccaccggaccaccgttgcctccccgaggagcccgcccccggcttcctcgttgtagtctcgccgtcgccggcctttggtgagcatccctcctctcctccccgcgctgtcgccggccgtcgccgcgggtggccgcgccgccgcgcgccgtcgtttggccagccggctttgtgccgtgctgtgccccaaccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttagtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacaagggatccgggtattacctatctgctcgcttgttccatgttaacttgatatctgtcatttgtcaaccatgggtaatagatcgcctagcttgtgttactttgatgacttagctagaactatatgcttacccatgcttatttaccactagctcagtcgaaggaataattgcagtattagacattctatatcttgttgagctgcgtgctcgagacatctggcgatgtttcatggtcgtaattatccaactaaaatgcaactgaatggtgggctgtgggtgcatggttttgctagtcgcacccatggcaattaaggaccggttcgcgggatgccctgaagaacttatcgtacttaccacaagccag

SEQ ID NO: 8189 - DNA, 677 bp, Oryza sativa
gtcacccacaatcggttctggcagtgggaactcagcttctgttacagaaggccgattgacaaccttcataaccatcaggtttaaccaagtttgcagtagccaccagggtccacctgctccaactgccgaccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccaaaagtaggtggcggcagccatcagaggttcgtctttggcagaattggctatggtgagggctagtgcttggccgattccaatctcatccaagtgaactttcttactagccgatacacgttgataccaagtggaccaactcctgtcggg

SEQ ID NO: 8190 - DNA, 362 bp, Oryza sativa
tcaaaatgaatagtttgaatttatatgaatttaggtccaaatttcactggaatcggatctacggtttaggagacataggcttctaaaaattgggatttgaattaaatctaaaaaatacaaaaagttactgttgatgggcccacctgtcaatctccttttctttttctctctccttctctcgtcttcgtcttcttctcttctctgttccagagagagagagccgagagaagagagaggagaaggcgagcggggcggcggctctccggtggctggagggcggcgacgtcggcgtccacgcgtgttcccgagcaagacacacccggggagggcggtggctggcggagagagtgaaggagttggcc

SEQ ID NO: 8191 - DNA, 1720 bp, Oryza sativa
actacatatatgcatgtactgattaaccggccagcatgccatttggcctaattagaatactcaggagcatttgatatatttcccgtgttctctctttccgtccaacaccaaaactaatactccctccgtttctaaatattggcaccgttaacttttaagaactgtgttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtcagtagcaaggagccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaatataaaactaccacacccaactaattgagttagaattattatgaaatatgtctccatagtgcatttatttatattatagatattgctatacttttctattacttattagattaacttagaaaaaggattaatgaaaaggaccattattgaacctatgctattataaatgttcggataaacactacacctactatttggtaacaccaaaaattagaaattaaaaatattattaattacatatatttttgtttatagacgtatatgggcgaaaaaatagggcgccaacaggcgcaccgattttctagtttatatgtctatttttagtctctatactttgtgtgccgggcctggccttccggcccgaccgtgccgggccagcccagcatgccggttgggaggcccaggcacggcccggcggtcaggccgggccggcatggacccgaccccagtcgagccatgccgtgcttgggccgagccaaaatgccgtgccgtgggccggtccttcgggcctcgggttttatgtccatctatacttgtcagggaaaatcaatccttttaattttatttttcatccttcctctcgtcttctttcttctctggttcgttcttcccaggtagagcaaagggagaagagaaggggggcgccggtgctccggtggctgggtggttgcgacgccggcggccaaacgtgttcctgagggtggggcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggc

SEQ ID NO: 8192 - DNA, 1046 bp, Oryza sativa
cgctctccgccgccggtcggtccggtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccccttgatgacgtcagccctgggacttattgcgcaataaatgatttaaggactttttttatagtaataaacacagtgaatcttctaaaaatcataactaattcatccgtgctccgtttaagcccattcaagtctcagtaaatcaagaaaaatgtgtagaatccattaaaaatggttttgttctctgtttcagtagtcttatagcctgtttgcattgtttgccttgtatgtcgttaattccggttcttctacgctccggtgtattccagatagtcgccaaggttcctccaccagcagagcaaggcaagtcatgtttgtcacttgaacatgttgatcctatattgcaaatgctctattgtttttcttcaaatactgcattgttttataatgttactatgggatgttcacctattgttacaaccatgctattttggtaccatgctccttgttagcttgggttataacatgaatagactttggactaggaattgcttagccatgtttagttcaactagcacacaatgagggagatcctattactgtttagactgtaggttctaatggtaatgttgaattagtaccaccgctttggtgttgattaattaaaatgaatcacatggtgggctgtgggtgcatggttttgctagtcgcacccatggcaattaaggaccggttcatgggatgccctggaagaacttatcgtacttaccacaagcca

SEQ ID NO: 8193 - DNA, 430 bp, Oryza sativa
gacatgattgggcttacccggagcacggataatttagttatgatttttagaagattcactgtgtttattactataaaaaaagtccttaaatcatttattgcgcaataagtcccagggctgacatcatcaagggggggtcggcgccgacaggcgggacccgcatgtcagtggcgcaaggggtggccggtataccgtggaccgggaccacgcgggtggtccaccaccggtccacaggatcgacggtccggatcggcccagggccgatcggacggtgcggcggctgcctggctcggctcgactcggcacaaagccggccggccgccatggcaagggcggcggcggcggacggctccccggcggcggcgacgaccgaaggcgacggcaagtgcgggtggcggcggcgcaccgggaaaccgggaaggaaaagaaa

SEQ ID NO: 8194 - DNA, 1435 bp, Oryza sativa
  unsure (1)..(1435): unsure at all n locations
ggggaaaaagagagaggggatggcggtggagcttatataggggagggggaactcggacatggccagtaggggcatgattcccggccgacgtgggggaggtggaggtggagagagaggcgggattcggaattcgaatcccggccatcttgggcgcggcactancgggaatagggggatgggtttgggaaatccgggcataccccgacgttgccgacttggccccgaagaaggcggaccttggctcccgcggccgttttgcgcgtggtgggcaacttggggacggggggccggaggaaggggacaaaccccaaggggggggccccactttcgctttcccgggaaaaaagggaaggccgtttgggccggccccaaagaagaaggcccccccgcngctgtcgattgacttgccccaccgccccagtagaaggaaaaggggggaaaagaaaaagataagggggaaaagattttccctaggatttaaaattgcttgtgctcaattttaattggttaaaattttttcgagggctttgaaaattccactaaaaatcattgttagggtatttcgacaggtagaactcaagaaaaattccacatgctaattccgattattatttttattaatttataaaggtttactcttgcttaacactggtattttttgagcccattaacactccaatttaggcttggaaaagaacttcggggtgtgacaatcaataagggtggtttgcttttaaggatgcaacaaaacctcaactggcaattcccaaatttaatctttcaaattccttgcataactccaacggcaactgtggtccttctgtagcattacaatagcctttcctgctgagagcatctgctacaacattagcctttcccgggtgataattgtcggctcccaaaactaatgattcggaaaccgacatgtttaactgtttcaagccctggatcagtagattgatacaggttcaacaatctagatcttcatcgcatacatttggtaaagactccaaaggagatatctttatataaaataataggacatttacaagtttgtggctaactattacagcagaagctatatgatgactcaactctgtcgttttactatagaattaaaccatctaactatactactagacttgaagactaggtttaaagggaactaacttatgtgattgaactcccagcttcggcaaaaactccaattaaactctgaaaaagaggggttgaagcaagggtgagtacaacgtactcagcaagctattatattattcaccaatgaatgcatgagaggtaatatctgtgtagagctagatttacttgcagaaggctgagaataaagaggtagaacttcctgaaatgtatgatatgcaacagtatttaagaaaatcttgaattatatttctaaccaaagtaccatatgagtccccga

SEQ ID NO: 8195 - DNA, 132 bp, Oryza sativa
tataaagtccattccaatctcctcccatttccattccggaatttgaagaggttggagtaaacatgctggcctttggtgctcttccttcactcgttgccaaacatcgcagagcgcgacgaattcggctatttc

SEQ ID NO: 8196 - DNA, 1210 bp, Oryza sativa
tatctgatcggctacgctataaatatatatagtcctgttattgatatatatttcgatctaagtgatttatactgtctcagcatggtgtccgatctatgccaatcactcgatttaagtttccatcgatttagggagtttttttcgtaattttctttacccaatcgagagaattaagggttaattacctattcatggacggcgaacgaaacacaaatgacattgggttcaagaataatgatatgtcatcggcattctaccgatcggctatcatttataaatttaaccgcggtttctttgcttctatttcttgttgattacaggatcaaatcaactggcacgctaacacatccgaaggcgagctttggacctgcactggagttaagcagatctcccagccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacagaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagccggccggccggctacagcgagcggcggcggtgcacggtcgccggcgatggcaaccggcggcggcgaacggcgcggaaggcgtcggcgtccgccgaaggcaatggcgcgcacgcggtggatggcagtggacacgggagggagagaaagagggaggacagggagttctcaccatggggttggccggcgcgggaag

SEQ ID NO: 8197 - DNA, 1051 bp, Oryza sativa
gcctcatctggaccctggccctcaaattcttgactggtctcaccctgttccacataacacaaaaaaggaaatgaatgtgatgatgattattattaagaaaacagatagcgtaaaattgcattcagtaatccccttcttggtcagtttctggagctactaattgctgaaatctctcatttttgacttattaaaagcatcacacatgttttgcaaatgttggaagaaggatacagccacagctcaaacaagagagcaacaagtgaggagtcaattaattatacaattaaacgattagatattagaagttttgcagcatccaagaaacaaataataataggagttgaaactaagaggatgaattaataatcaatgtatccaggtctgatcgagaacttaccaataaacaatttccacaatcatactctaattggaatctgctagtcggacaattgggaagcgtctcgatggtagctttgatgaggcttacaacagacctggtgatgctatcgtccatatcttgtgccggatcatagataccgtcagagtaaatgttgccccatataccaatctcaactttggtaagggtggagagattctggatgccaaaatcagaagcaccattcaggcaatccattccatgtaaacggaattcaagctggaggtgctcaagctttggcattgaccctgcttcaaactccagcatggtcccacatctcttgattcgtaacgagaaatatctcaagttagacttctgaatccttggttgccacagatgatgatccttccattggtgccacagagagttctgactttcgagaaaatgcaagctgggtattgctccaaggatcttaacatcatttggtcccattctacggatccagagttgtaattcagtgagggtttccaagatagctcatccagtttgggaccttacggttgtaacagcctttgatatgcagcttccggatgatgcaaggagtaggagggtaccaaggatccagggtcagtggggccgccagtcaaatatagatgatgaaggttgctagacagt

SEQ ID NO: 8198 - DNA, 1082 bp, Oryza sativa
gaaatcaagaatgatgtcatgaactcgacatgccttcgcctggccatattttaaatcaactgggtggatcaaacttctattgataagatcattaaaatagttctggccaacttcataggggctccatccttgtttctcatgaaccaatccttcagcaatccatctatttatcaaacgttgcttggtaaccttgtaatcttctggaaatatacccaagtataagaaacatgttctcagatggtggggaagttcaaagtaactaagagataatatctttgtcatgttcccagcatctggattgttagcaagtgcacaaccaatatcatttagcatcctgtcccattcatcttttgcatgcttgcccgctaacaagctagatactgtaataattgccaatggtaatccaccacacttagccaatatctcatcacaaactttttccagatggggattgtataattccctggaacgaaatgctttttggcaaaacaacattttggagtcagcaaaattaaggggttccatttgataaacacaaccaccatcacttgagcaatgtgatgcaactgcggcattacgtgttgtcatgacaattctgctaccacatctattattgaacaacgctaggctgacaactttccatgcttccacatcccatacatcatcaattacaacaaagtacctgtttcatgattttaacagggttattaaattatatatcatttaagtatgctttactatcctactgcaatcaggactgtataccagcatgcatgcttactctagcactcaggtcccctatgttgtaagtatgaatggagaacctagttagcaacatgggtatgtcttttcaaaagatatgtatgatcagcttctgcacaaacaaatttgcaagtgaacatgtgacaacatatctgtaatgcatgaggtttttgtggactttcagtttttcggaatgaaaaactttcacacgtgttagtttctttccggtagggattgggaaaaattcctgcactttcaaatgaggttttaacgttcacatgtgtcgtcattcgccatcaagcagtccacattagcactcc

SEQ ID NO: 8199 - DNA, 11538 bp, Oryza sativa
atctaaacagggcctaagatcaatactgaggtatggtatgttcaagttcaagttcaagtttaataatataccccactgtaaactccaaattatgggtagccaattcatacaataggggcttactatactattaatatctggtcctacctatcatatacacattacttcttggaagtccgtactgaagctggcttcaaatcggaagcccgctgctctgggttctcttcctttatctctttaaaatatgttaatacctggctatataccttgctattggacttgctctaatagaactagtatgttcattttatgtgtgtgggtaagatttttcttgttatgattctcagatcaaatatatcaattaaaaaattacccgttaaaattatatcccttaaaaattacatatttcaaaattttatcacgataaataataccattaaaatttagtcatatcccttaaaaatacaagtgtaaagttagttggaaaatattagtaaaatataggcggatgtgatatgaatgatctgttggagtggaaagagatatgaatgaggaatcttttttggatggccatccatatggacatactgaggatgatatttggatgatctcctgctggaaactcctctcctcggcgtggaccttggaggtttcggtggattacgcctctgttgattgaagacggaaataacgggttgtaagtggtagcccaggttcacaattctgatgaaaactggtcgaattccatgaagtttcgacgtttcgacatggctcggaattaagttttgattggaatttcgaaggtaaacaatagatttggtcgaaattcaattaaaatttatcaaaaaccgatcgaaatttatcgaaaatcgtgataccgatggggctcgagatttagtactcaaccggtaactgaaaccctgcttgtagccgtgtctaacggatgaaggcgtaaattcatttctgactattcgtgtacaaggcgtatttctgatttcgatggttttaattggttaaaatgttaaattgaacacctttacaaggccggatccgtggcgcaatggtagcgcgtctgactccagatcagaaggttgcgtgttcgattcacgtcgggttcaaaatccccgaaccaaatccggatataatttttttatttttccaacctaatccttttatttatccattatagttttccagatcaggttttcaaagctacttttattttttagaactagcaaaattgactgtgcgttgcaacgggaagaatacttttattttttttatttttccaacctaatccttttatttatccattatagttttccagatcaggttttcaaagctacttttattttttagaaatagcaaaattgactgtgcgttgcaacgggaagaatacttttatttttttagaactagcaaaattgaccgtgcgttgcaacgggaagaaaagatgagaaaattgatgaaaggttgataaagatttacatcatctaatacttgaaatacaaattttccagaatatttaggttttttttaagtagataggtatatgattaaattattttactaataaagtaaatgtgacaaataaaatgttatggttagatttaatttttatgaaattctccatattaattacactttttgaatttttattagaatttccatagcttaattgctaattttgataatacaaacatcattttagcatttatttaaataaaaatcccgctttcagcccgcaaccgagccggcccactttccctaggctgcaagcaagagcctagccctggaagcaaccaaagtctaattagcctccccaactcctcctcttacttatcttgtggaccataaccaaaaatctaattagcccgcgcgtggcccaacagggctgcggttcggcgttggagcctaatgctcgatcaatatgagctgttcgttttgatagatggctcagattagttccgaatcaattaaaaccctggtgccaaaaaaatcctaacccaagcttcattcctacccccaccgccatcgccgccctcctccccgcacccagcgccgcctctcctcctcccccgcccctcaccggcgccgtctctcccttacctctcaccccaccgacggtgcctcttccccttctcttccctcccctctacccatcagtggcaccacgccctctccccctctccttcccgtttcgtcggcacggcgtgacgacagcggggtatggcccggagacggcggcgacagtcgtccctccctctcggcctctttgtttttgtcggcgacggcaccttctccaccctccagatctcgatggcttcccgtgggcagatctaggcttggcaattttgcccatgggtctgggtatccgcgcgaatacccggttcgatgggcacaggcttgggtctattttgttgcccatgggcacgcccgcccgagacccgaaaaagtagcgggcagcaaccgggttttaatttctacccatggataacccatgcccaacccatgggtaacccgtgtcaaagccggttctttttctcaacttcaaacttcaactttttcattttctgttagcacgcttttcaaactattaaatgtggtgtttttgataaaaagtttttatatagaagttgtttaaaaaaataaatctatttttcaaatttataatagtcaatacttagagcaagtttaatagtatagccaacgactagctccaaatcatctatagctaatctaataacacattcatacaatagttaactatgaaaaaatactacatcattagagcaagtttaatagtatagccaactactagctccaatacatctataaccaatctaatagcttattcatacaatagttacatactacactattaatacctggtcccacctgtcatagacatactacgtcttggagtccgtgctacagctggctacaaatctgtagcccgctgctcttctctctccttatttatcttcttaaaatatgtttgcagctggcttatagcctgctattgtacctgctcttaataccctgtctcacctctcatacacacgtaatgtcttagagttcatgctgcaattggctacaaatctatagcccattttcttctctcttcttttttcttctcgatatgctggcttatagacttgctcttagttaatcatgttgtgatgagatttcttgttttacgtgcaaccaaaatctatctccaaaccgctgcatcgatcggggccgtcccttctgttggcccatttatagcccattaatcaaagaagtatgaggccatatcctgtgaaaatgcaccaaatgttgcaaacttggaaatactaatctccaccgttgcatccaatctgaacgaccatgataagctcccatccactctctcacctgttggatgcacttttgcagaaaaccgcccgcacctggctgcatatgttacaaaaaaaaccctatactcatcttctttatagattctatccctctcatcttgtaatgtactgctaccatgatttgttccaacaaagctcactggtcgactcctatggccagcgagacggcggtcgccggtcttgagctgcgccatgagccactccatctcggcgcgcttcaagaccgccttcaccttcaccccgccgccgccgccgcagccgtctcttctccatcctcctcctcctcctcctctgctggttcttccctcagcaggtggacgaatccatcctccgcggtggcgatggcgaacggcatcggcgctacccaatcccctaaggccgttagcaacctcgcccccgaccgctcccctgacctggacattgagttgcagggctacgaagggaatcaagtcccaaccagatctgggccaaggtattctcttctccctgatgatggatctgtgcattggagcctggtgaggtagagcaaggattggagggagagcacataagtgctcttggttttttttctctgatttcttagttagaaatgtgcaataaccctggaattgttctctgattggagggagagcatgagaatattgcttgcatgctggaattctataaatgtaactcacacatcatagtccctgaaatgttttttagtttctaaaatgtatatggatctctatttgggaaagtcactctggatgcttgtgctttttattatataattttttttacaaatgcatgtgcatctatccaaaaagattcatgtacaagtttaatttgattacgcgagatgttgctcctattatctctttgtgcaactaacaacataccatgaataagtatgtgcatctgatcacaaataagaaacattctacatctgggcatgccaatgagaaacattcagtagcagttgaattttgttttgtgtctcacaaggaatagttgttttttttcctatagagaacatctgcaaattgtgcataggaagattcaaatgtggggaggaggatgttgacttgaaaagaagatggaagatggaaagaagatggaagatgagactgtttaagattactcatttgattttttttcaaggagttgagagatttggggactgatagctctagagcactagtgataatataatttcaagaatgggataattggggcataccatcttatgcagatattgtgttcttcttttgtatgatcaatgcatgtctaaaagctttcaaattactctggtgttatcctgtgagaagtagtctttttatatggatgacaaacaacctaccggcttgaggtgagtttattggccagggattccccctcgtcaccaaagtgtccctgggtgagtttctccatcttctccatcttccccaatcatgggttgcaacaaaagaacactactgcacccaatgcaagtgggcaagcttgtgcagaggaacacaacaaatcaaatgcataaggaacaaatcaggtcaagaacaaatgggagcacacctcgattatgactgaagaccagccccatctgccaccgccaccccaaaccctaaccctaaatgaacacttgttgagcttttgtccatacctctggagcaggaatggaggaggaagattggatgcgaggaggaagctcgagggagtcagggaagcacataatcgtggggatttctcatcagttcgaatcggaaggagggggtaggggactagctgagggtgagaccttttcttttagatggagaggagctgagaattgaggtggggattttggaattgagagcgggataacatggtcctgatattttcagtaaaacatatgttaagtggggtggtaaacgtaaaatgtacagttggaaggggtacattatgatctcatcccttggaataggatctaacggttggtttgcatatttccaacatttaccctgtttgcacctgatatgccctcaagaagtatatatactatttaaccaaaacctaacctaatccatccacccatgacccgtacattcccagtgagaaattggcgattttaccaccacaaaataatagtttcgttggaataccattgctttaaagtgattcactacaatatcatcttaaattaagtggtgttcaccaaaataccatttttattctttttgttaatagaaatatttttactctattttacacttttctcaccaaaatacccctacctatatcttctcctttctcccatgactaggatattgcaaccgtcccaaatctcacatataggcacaataatctcgcatattttgtcccaccgacatagatagccattttaacatcatattaattaaatctaggcataaaattggatcgcatgtaggcgagcatcatattaattaaatttgaacagcacgtagacttaaaattggatagcatagatatgtaattgaattttaaaaaaatgtatatgctatccaattttatgtctatgtactgttcaaatttaattaacatgattcgtctatatgcgatctaattttatgcctataggttgtacctatatgcgagatttgggatggttgcaatatgctgggcatgggagaaaaggaaaagatagtggcatgggtattttggtccgagaaaagagtaaaatagagcaaaaatatttctattaacaaaaaaaaatgttggtgaacaccacttaatttagaatggtattgcagtgaatcactttgaagcgatggcattctagcgaaacatattgttttgcgatggtaaaatcgccaatttctcattcccagttccccagcaccttctaccgccgaggcttttaactatttgccactcttatgagtggtgtttaatgatttgtcactagacccatatgtcatggacagtgagtgacaaattattaattaccacgttgcaggagtggcaaatagttaaatttccccctaccgcccacgctcagggcggcgcaggcaagggacagcgcaggcagtcaggggcatagagcggcgctcgggcacggctaggctgcgggcaaggggcgcgcgcgtggcgtcccccagggcggctgctcggtccagggacggcggtggtgcaaaaaagggttgcgcccggcggcgacgggccatagggcggttgctgctcgtcatttgggcggcgactgctcgatccagggatgacgatggtgcgggcaaggggtgcgagaggcgcctgagagtgtatatggctcaacgcgataatcatgttgatacacgaagagtattacatataggcgccaaccttccatagaacactcgaccgatttatggaagcatgatcgggaggttttaggaaagagggctaattagagatacatgccatatacagtctaacacccccccgcagtcgcaacggcgctagcagacgttgagactggagcgaaactcggtgaagaccggtgtaggaagccccttggtgaagatgtcggcgtactgcgatgttgtgggaacatgaagaacacggacggcgccgaccgcgacacgttcccgaacgaagtgaaggtcgatctcaacatgcttggtacgctgatgctgcaccgggttggaggagaggtagacggcactgacattgtcgcagtagaccagtgtagcccgcgacggcggagaatgtagctcctggagtagctggcgcagccatgtgacctcggcgactgcattggcaacggcgcggtactcggcctctgcactggagcgggagaccgtgtgctagcgcttggaggaccatgacaccaagttgtctccaaggaagacggcgtagccagatgtggagcgacgagtgtcagggcagccggcccagtcggcgtcggagtagacggcgaggtcgcaggcggaggaccgctgaatgtggagtcccaggtccacagagccacggatgtagcggaggatccgcttgagggctgccaggtgaggctcgcgagggtcatgcatgtgaaggcagacttgctgtacagcataggagatgtcgggccgggtgaaggtgaggtactgtagcgcaccggcgaggctcctgaagtctgtgggatccgctacaggagggccgtcggaggaggaaagcttggcagtggtgtcgacaggagtgttacagggcttgcaatctgccatgcctgcacgctcgaggatgtcaatgcagtactgccgctggctgagcacgaggccagctaaattcctggtgacgctgacgccgaggaagtggtggagggcgccgaggtccttcatggaaaactcgccctgaagggcggagatggtccaatgaaggagcgtgcgtgaggaagccgtcagcacgatgtcgtcgacgtagagcagaaggtagacggtgtcgttccctcggtgaaggatgaacaaggacgtgtcggacttggcctcaacaaacccgatggactgtagaaaggtggcgaagcggctgtaccatgcgcgcggggcctgcttgagcccgtagagggacttgttgaggcagcacaccatgtcgggcttggcggagtcgacgaagccgggcggctgggtgcagtagacagtctcttgaagcgtgccgtggaggaaggcgttcttgacgtcgagttggtgcaccggccagtcgcgagaaacggcgaggctgaggacagtgcggacagtggccggcttgacgaccgggctgaaagtctcatcgaagtcgacgccggggcgttgggtgaagccgcgaagaacccaacgagccttgtaccggtcgagggagccgtcagcatgaaacttgtgcttgaagatccacttgccggtgacgacgttcacgccggcaggacgcggaacaagatcccaggtgcggttggcgaggagagcattgtactcttcttccatggcggcgcgccagagcggatcggcaaggcccgcccggtatgtcttgggcaccggagacagcggggcggcatgaagattaagccgatgaacaggcttgtggtgaccggacttggcgcgggttgtcatgacgtggtcgttgacaaccggtgagattcccaggccggacagtggagttggtgcgccggtagcacgaactgatcgaaggcggcgcgggacatgtggagctggcgggagatgcgggccgtccagtcgaggaaggccgggaggagccgggcaggtggaggctgatggagccggcccagctgaaggcggtccaggtgaagtcgacgccggcccaatcagtgcaggggtgggggaaggcggcccgagccggctgtctggggaggacggcccaccaggtgttgaggccggcctggtgggagaacagggtggcggccgctcaagcccatgcaccatgggcgagctggccgtctgtgttgtcggcgccacagctggtcgacgagtcgctccaattggtgcctgtgctggagcagtgaaatccttcaaaaaatcgagatcagtagcattggagacaccattagtgagctcagtaaatggaaacgagtgctcatcaaacacaacatgccgtgaaataataaccctgttggacaggggatcaaaacaccgatatcctttatggtagagggggtagcctaggaaaacgcacatggtggaacggggggcaagcttgtgcggtgtggtggcggagaggtttggataacacttgcaaccgaagacacgaaggtgcgaatatgagggatgggtaccatatagggcaaagtgaggggtgtggcgatcgagtgttttggtggggtgtcggttgatgaggtgtgtggcggtgtgaagcgcttcaacccagaaggatccggggagcttggcctgaaacagcatggagcgaacaatgttattgagggaacgaaggatgcgttcggctttaccattctgaggcgaggtgtgggggcaagacatccgaaggtgaacaccattggtgagaaagaaggtgcgagcggcggagttgtcaaactcacggccgttgtcgcactgaatgctgcggatgttagtggcaaactgagtcttaacataagcaaaaaagtgggacaaggtggtgaaagtgtcggatttaaaacgtaaagggaaagtccacacataatgtgagcaatcgtcaagaatgacaagatagtatttaaacccggaagcactaacgacaggagatgtccataaatcacaatgcaataactcaaagtttgtcgatgcccgagaagtagaactagcaaagggaaggcgaacatggcggccaagctggcaagcgtgacacactccggtgaggtcgccgcgtgtcatagggacgacggcagcgaggcggttgagggcgtcgtgaccaaggtggccgagacgacgatgctagagaaggtcggtgctggagttggcgaggagggcggtggctgctggtggaggaggcagtgcatggtgtagggagtagagaggaccggagctattgaacctggcgatccggtcctggtgcgaagatccttcacagagaagccaaaggggtcaaactcgacagaacaccaattatcaataacaaatcggcgaacggagataagatttttaataatagcgggggaacaaagaatgtcacgaagtgtaaaggaacggttagggtgacaaattttagagtgcccaatggaagtaacaggaatagtagagccattaccaacgacaatatgagagggggagttgggattaggtgggtgtgaaagggagaggataccggtgtcggaggtcatgtgtgcagtggcaccagtgtccatataccagtcatttgtggcgggttggtgtagcgtcgtggtgttgaaggagccggcaagggacgcttggtcccactgcgaaggagcaccaccaaaccagcccaaagggtgttgaagagccactggagtgggtggctgtgatgggccgaactggcccacgccaccgagctgggcctgctgccccaggccagctgctgtctggtaggggacgggcgccgggtagacttggccaggcagcgggccgccgctcggcccagccaaagcagcaccagcaaagggggagggtgccggccttgggccaagcacaccacgacccaacgggcccggccacatgtggatggtgccggcccatggattatgtggggaaggccactggaagccagccctccactgggcaccttgcgcctgtgctggaacggtgctgccgcctccttggttgctgttaccgccgccaccaccaccgccaccgccgccgccgttgccaccgcggcgacgccggttgctgttgcccttgccgccaccgccttggttgccggcaccatagccggtgccgtgcgctggattggcgcccttgccgccgttggtcgtgctgcccgtggcgaggaagacggcggaagaagcagacgcggcgtggttcggcttggagagttcttccaggcgaagcatggagcgaagctcggcgaaggtcgggaatggccgctgcatgggaactagagaccggaggttattgaacttctcggacaaaccgctcaaagtgttgaggacgagggtgcggtcgcggacgggctcgccgacgtcgccgaggctgtcagcgaaggtcttcatcttgcggcagtactcgtcgacggagaggtcgccttgtcggaacgtgtggaattccgtcgtgaggttgagggcacgttgctcgctgttgccaaggaattgatactcgaggccgcgccaaacgagacgagctgtagtgtcagtcgcaaggacgtcttggagaaggtcgaggagatggtgccgaagagccaagcgaggacgacacaatccatttgcacccaatcggcgcggtcgaagtggtacgcgtcggagaggacgtgatccgtgagggcgtacttgccgagtgccacgaggaagaggccatgccatcgtgtgtagttggtggcagcgacgtcgagagtcacgggaacgagtgccttgatgttgaggacgctgacggcttgagcgtggagtgctgccaaggcggcgtcgtctagaggagtggcgggtgggcgcgagaagtcggggacggtcggctccggcgtgtggacgccatgcgcgaggcgcgcagaggcgaagagggcggcgaggtcatccggcatggtgccgggaagaggcgccgtggtctcaagcgccacgccgtgggtggcg

SEQ ID NO: 8200 - DNA, 1176 bp, Oryza sativa
atgagagtggatatggctcaacgcgataatcatgttgatacacgaagagtattacatataggcgctaaccttccatagaacactcgaccgatttatggaagcatgatcgggaggttttaggaaagatggctaattagagatacatgccatatacagtctaacagcggcagaggcgcaggcaagcgacaacagagcaggtgcgggcaagcggcgacataggcgcaggccgcaggcaagctgcaacaacggagcaaagtgtgaacccggactgggtacctgtctatctttgctatttttctttactgatgtataataattaacattgcaaataatttattttattttacactgatattagggcaccaagagcagcatgattcttggttcttagtttttttaatgcatgaatcggactttttttttcgcccttctttactggttttttgttttcttatcgcctttttacgacttttttttctttgtgtcaaatcggactttcttttttcttgtttttatgttttttcgcagagatagtgatgcataagagatacaaatagatatttcatgatctcttcatgatcagagattctatctttttttctgttttttaatttttttctctattttcatattattttcgaactcttctcctcttacgagtgtatcaaaattttattcttccagatcagaggttttcaaatctacttgttttctgatatcctcatagtcaaagattctatttgtattttcagattttttttcccgatctcttcacttcttttaaattcagaggttctcatttttagttcatttcgtatttgctccacagaatcttcgtctacctgcagtcccgtcgctctctcaccagcagccatggccgcggatcccaccaccggcggcggcgaggcggagtccttcttccgcgccgcgccgccgctccgcgaccaggaccgcgtcgccggggacctcgccgacttcgtcgcccgccactccggcaagtccctcctcccctcgcctcctccttccctctcctccgatctcatctccttcgatgcgtcgcgtggtgggtgagtttgctgatctcgatcgtgtttggtggtgggtagggagcggaggaggggggaggctctcccgggtgtcctgcttcacctccggcggcacgacggtgcccctgga

SEQ ID NO: 8201 - DNA, 5243 bp, Oryza sativa
agttcataggagctgaagttgttactgcatgctcgtttacgatcattgtgtagatagacagtgcttgggacgttttcagggaataaagaagagacaaaaaccagtgtagatagacagtgcaagctgttttgtttacttttctttcttttttgatttgttttagttctcaatgcctcatttagtggaagagttgtgagtgacatcagcgcctctttgcagtgggagcaagcaaccttactgtaggtttcttccagaggattcctttcttgatttattcgagcttggtgaagaatcagatatccaaggttggggattgatcctaaattatttatattcatgccaactgaattatctgttgtttttgcttcttttttttcactttttagatgtttgaccttaattataaacatttattgatatgaactgaaaagactaaatgataaactctcatgtaagttacttacctcagtcccagaatctcatgccgcggttgtcaagacagcaataagaaattatcggaaggtataaacagttctgttttaactccatgaaactagtctcatgcgctggttacaacttacaactggtcagactggtacagttgtgtgaccattggcttggttccttgattgcaggcgattgatgaaggcctattgctgaaacttcctttcaccactatctttgagtaccttcaggttttgctcattattcctacagaaacatgttctcatatacacgctatcataaagacagaggacttagtcagtctcacgagaaaggcttaggggtcttccggctagcaccacctgggttcgagcctcacccctatcctaataaatttcgatctgagagcccttcctctcatatccagtgttttttttttcagtcagtctcacacatagcgatgcaagtggatctggatggacttggcccaatggcccatgctaattcatttgcttgaattataattcgaatgcatatatacatatttgaccagaaagtgactcatcaattgagtaaaatgggccaatggccaggtgtccagtccaattgcatttgtgctcacacgtccactactgctggtgtttcaaacattttataccttgtttcattgaatatattattatatgacttagcattgcaaaagaattcaatcacgatctgtctccaatacattaaggtggggagatgcttggattttgaaaatccagtcataatttagactgtcttagatatcgaatgctttaggaacttgccaattttctgttatgttctacagtaaaagattaaccttggcatactgttatactgatgaggaatctgatatatctcttctgcttgtttttccaatagttactgcaaatggtaggtacggcgatgaattgcttgggacgccaaggaatgttttaccttgctgcggcagtttctgacttttatgttccatgggaaagcatggtaggctctactcttctgatcatttcattgtattaaaacaaacaaatagcctatatgttcactgcatttggtgtatatatcagttaatgatgctcgtaggcttctagatggcgtttgtcattggacattataggtgcctggcttttccctaaatcaggggatccttatttaagagatcacagccccctcttacttacaccatgttagagttataccatttcaaaatcttgaaacttaggaaccatgtattggtattgaaacatatgattcttttcgtaactagttataaaaatggtagttacgtagcatagtaatggactccttgttatcagatgtttcatatatattggcatattgcacccaatgcactagtagttgcaggcaacatggtcattatgtacctcgcacatgttttggcaggctaaacataaaatcgagtcagcaagtggtcctttgaacatgcaactcaatcaagttccgaagatgcttttcattctgagaaaacaatgggctccttcagcattttgtgtatccttcaaggttagtttgatgtattttcacacttccatatggagctatggttgctcaagcttttttctgcattaaagaaaacctcagtgtaccttcattctgctcgtgttactctcgaaatatcttattttctagagtcgagatgactagacccaccttactgctggcgcctaatacctgcacattacagttgaacggacccagatatccttctgcagaaggcagaggcagctctgagaaagtatggtatgaatgtcgtggtcgccaacgagctagcgaactacaaagatgtagttgtgatggtcacaagcaatggaaggacacccgtgcgaaggcccagcaaggaggacgacgtcgaagaacagttaatcgatctcttggtagagatgcactccgaacacatcatgcagctcaatcaagacgtgcacaagctgacataacaattatactgaatggaatacgagtatcagaattcttggcaactacatcatccaaagttgttacaacttacgagccacgagctgaactatgaatatcatgacttgtaaaaaagaaaaagaatagcatatgcccacaaatggtggtaaagtatgtatgtaccacattcaggtgtcaatgttacgcctggtgcttctgtaacttactacatgttaattccctgggaaagggccttgggagataggcatgattttttttttctaagttttccttttctcaaatcatcttgttgtgatttttggacgttttgtgtagtcttccatgctcctgcttcaaattccctagggagatttttggacgttaatagattcattaacatctatatgaactgtgggcaatgctagaaagtcttataatataaatgtagattcattaacatctacatgaatgtgggcaatgctagaaagtcctataatatgaatatgaaacggaggaagtgcatttaatagcactatgttggtgcatacctagagaaaaattatcagaactttggagacgagcttgcattatttaatatggatgaagggggtgatccgatgctagtactaactgattgaaagtcaaaattgttttcattattatgatttatgacacgatatgtaaattcacgcctatccgatgctaggatcatttgatttttttttctagtcaaacttttttaagtttgatcaaatgtatagaaaatatactattattttcaacacaaaacaaacataatatcaaattatatttaatgttagatctaataaaactatttttatattttagttgttaaatttttatataaactaggaaagtcaaacaactttactgtatgaaatggagggagtaaatgacactgtgcttccccctcaaatgcacgcttagagcacccgcaatggtaaagtaatgtgctatctataaaacatgtacatctcagcaatagactagattaatagtaaatcacttcaatggtatgtctcaatgggtatctatagctctctaattcattgcctcgtttttctctatagactatctctaggttagtagataactttgctctctctcttcatttaatctcttccaagtagaaaaatatgctgacatggatctcttgtagatagcatatagataaccattgagggtgcccttaggtatgacgcggcactatggaggcctaagagttacggtgaggctcaaaggttgcggctggaggttgaagaccgttgacgagtaggcctattggcaatgaaaaaggatactaacatacgggggataatacgggggcttatcgccggttatggtagctgtcgaaattgctacatctgcgacaattcaaaacaactgtagttgacagccattgacaattgtcacgactatagcggctgcgacgacaagtttagccgaacacgtctataaacacatgataacgatggcccagtaacacatgatactcgctccgtcccaaaatatagcaacttttgcttagatgggacgtattctagtactacgaatctagacaaagcaaaagttgctatattttggaatggagggaggaggttccatggatagtattgacattttttttttcaaattgataatgttaccaattcaattaatcctattacaatacaaatgagcaaggtgaaacaggagacaaaagagaccctgtttagatgggactaaaacttttaagtccctatcacatcagatgtttggacactaattataaatatcaaacgcaaactattaataatcttggactaattcgcgagacgaatttattgagcctaattaattcatgattagcctatgtgatgctacagtaaacattctctaattatggattaattaggcttaaaaaaatttgtctcgcaaattagctttcatttatataattaattttgtaagtagtttattaaattagtgtctaaatacaccgaaacactagttggcgcatacgcgcgaggtagcgaagtcgcgcgctgctgcagggcaggcccaccagggccacgtgatgtcacgcggaggtacgcgcagcgcgatgtttctttttttttccattttttggcgctatgacgtttcttttttttttttttgccgtggactacacggccctgtcacgtttttttttcacatttgactaccgcacacgtaaagatttaaaactttcaactcaagaatttttaaaatttttcaacttagatttgaaaacttttaactcggacttgaaaactttcaagtcaagatttgaaaactttcaactcggacttaaaaactttcaactcaaaaatttttaaaatttttcagcctagatttgaaaactttcaaatcaagatttgaaaacttttaactcggacttgaaaactttcaagtcaagatttgaaaaattttaactcgaacttgaaaacttttaagtcaagatttgaaaactttcaactcggatttgaaaattttcaattgaaaatttgaaactttcaactcaatttttttaaaaaaatcaaatcaagatttgaaaactttcatctcaaaattcaaagcattcaacttaaattttaaaaactttcaactcaaatttaaaactttcaactgaaattgaaggtgaaagattcaatttataaaatatagcacgaaaaaaaaccgcgcgaccacgcgaagaaaataagggagcgattcaagaaaaaaaaagcgaaaaccgaaaaaaggcgaaaaaaagaaaaaactaccggggcttagtgcgtctgcgtgtgcgtgggccttgcggcgtcgttactatgcta

SEQ ID NO: 8202 - DNA, 993 bp, Oryza sativa
ggggctgcccgccggcgcgtgggcttgccggcaacgcgggggctggccggctgacggcggcgtgccgcttggcggcggggattcctttttttttctttttttttttcagatctggagctaaaagtttgccaaacacttttgatgggtctgtaactccaataggagctagctccaactggagtaggagtttggagctggaagttgaagtttggagccctaccaaccgggcctaataagagttactcccaccacctgaagcggatggtggtttttcctgcttttagccatggggcccacctgtcagaccacctcctcagctcgcctcctccctcgtaggcgtcgacccttcccctccacctcaaagccggcggcatcctttcccggtgatggcagcgcccggcgagctcgcaaacgacggcggcgacgcaagtccggtgactcccatgcccgctgggggtggcggcggcaatgcagcttctcttccccgtcctcttcctcccgcgcggcctccccctatcctccctcgttgtggcgtcgtcctgcggcagctcgcgagtgcatgcgcggcggagttcgaggcgtggaggatgtgcgccctgcccccgccagatccagctacgtgtcaccggcggcgtgctgtgtcgcccgccggcgggtgcgggtccaaggggatcaggcaagctgctgcgctcggcatcggcctcgtactaatcgtcggggggaaaaatggctgtgcgctgacgagcatgtggacatccaggcatgactcatgaggcgatccttccttcttttgcctcgcagtcgcaggcagcgatttcttgcaaattactccaaattgctgcagatcagctgaccttctagcgtacagtgacatttagttttggttccttgattccttgtgcaggaagagggcagggaagaaccgggggagacgacggccatgctggagaatttcgtcccaaatgtgggttctatcaattttttttagtatat

SEQ ID NO: 8203 - DNA, 1261 bp, Oryza sativa
gaaaaaaagttaagcgtacggcagcatgatatttctgggctccaataagggttagtacttatgctaacaacaaagcaatagacattgagtcgtggtccacgtgaataaagaaataaaaacaagttatttattattatagtagtggtccctatgtatttaagaaaagggtttaaccaatggaacgagaacacaaacttgagtatatgataatatgacatttctcggctccaacaaagccttccactatccgtgctctgtcaacattctctatatatcatggcgagaccaagacctcgtagctggctggcttgctggctctgtttccttgccgtgcgcccatgccagcatcgcattgccgccttctagccttctcctgctggtgaggttcctctacttctaggctcgagagcactactctttttttaggggaaaacggcaggagctctgcctattcattaagaggaggaaaaagagtttgatacagattctgggcacctccaagagatgtcacaacaaaacatgaaaacatgaaatctgtgaaatctaggctcgagagcactactcttctagttcatagcttcgtaatgcaatctgtgattgctactagagtactatcataatgttatattgtcaatttgtgattagtgaacatgtgaatatgcaatttgtgattattgtttagtgattactgattagcttgcctcattgatcatacccatggctaattaattagctcataacttaggctgctgatttgtgatttgtgaatgattgaatgtgaataaataacttatgttattgtaagattggtattgttttatatttggtaaaatatgaagaggaatgggattggtattggcttaccgtaatatttcaacattttgtacttgcttgtgcacattttggacttgtttgttaaattagtcgattattgatgttgatattattgctacatttgcatcgtcttttaaccaaatttgtaattatatattgtgtttgaggtgtttgcaaaattttcatgtgtgatgtgaacttcagaagtaggactacccaacgaaaaattcctggctgtgccaatgcctttctcaccctcgagcccatgaattcgctggcgaaatcgccacctagcaccacacctttggttcggtgccttccctggccaccccctctaagccgggggaacctcatattcatcctccttattagggcaatagcaatgcgccacggatttttacatttcctcacatgccacatacactaa

SEQ ID NO: 8204 - DNA, 1218 bp, Oryza sativa
tccgccgccgccatctccccttctcctccctaggccgttgccaccaccatcttccttctcctccccaggccaccgtcgccgccatcttccttctcctccctaggcctccgccagcacctcgtcgagctcgacagatccgaccttgggtttgccagaactggcgagcggcaccactttaggggcgacacacttgctcgggggctacagcctctcaatgcgccgctccacctgcgcgcctcgccccgcgcctacaagttttgacgaagaacgcgtgacttagtttggcatctgcggtcttgagttgggaatgccacgcacacatcttgagttgggaacgccacgcacgccacctgcttctcgcctttgagcccacggatcattggcacaactagtgtcctacgactggtttggtgcctcctcttgcaattcctctaatcgcgagtaaccccttgtctatcctactcatgcaaagtcccgacatgaaaccttaattaagggggctcattagagacaacaagaatttggctcctcacacaagcttcccaatgcaaccttggttcatgaggtaggcatacacattttagaaccagtgttattaaactctcagaatccaggtattcaaatcaatccaagttttatacaattatcagtaaggtactaagtcctgatgccacaatactaatcacaccgtgcatgtaacagcgagggagttgtctctagataccatttatgggctacacacctacataatggatcacttctgctttcaaactgattgatggaggcaatttaaactggtgttaattaaatgttcagaatatggtataacaccgtaatatgtgaataattattcctttcattcatcaccattctatactaaatctccgacaatttagaaactactgaaaagtacagtgaagtggccttacaactggcatttagcaagtgctctacccttctagtgccgcgcatgttaatccagcttaaggaaggatatgtggccgcttgtatgtgattaaataaaaggattgcaatgggctgtgtatatacaattttaatgataacaacaaacactgtatctgcaaaagaaattaaattagcattggcataaatgtaactagcatgtattggcaaaaaaaaataaaattaactaacaatgtgatagcataaaatgtgtatgtaacacaaggtgttaatttctattttgcaaataatgtt

SEQ ID NO: 8205 - DNA, 2988 bp, Oryza sativa
tatgtggcatgcaaccctgagctttttgtccacccaggccaatgaaatttgtagattcgattataaattgatgttcagcactccatatttgtgaagtgatcccatggatagtggtgacaccaacggtttctcatcgttgctcaactcttgttacttctaagtgattttagtggttcctcatcgtagcatgttaggggtttgtctcactactaagtgattttatttttattttcttaggtatatcgttgatatagaagatgggatgtaaaatatgtttctttataaaaaaacacacaagaagttgcaatccctttacaacttgatggcagtaagtgagaaagaacagcaagagttaagccattgctcccatgaataaagaataagacgagttgctatttttttatgttgtacatatgtgttaaagatggtaataggtaagagcggcatgtattatttttgtgtcccttgtgaatacaaaaataagacgagttgtttgttattattttagttatcactacatgtttaaggtggtagtaggaaagagcggcatgggttggacagttcccgtgaataaagaaagcatgattgtttattgttttagtagtggtccctgcatgttaaaaggaagggccaaaccactaatgaaaaaagtagacttgagcatatatgtggtgatgatattattatttttggctccaattagaccttcttctacttgtactctaacagcatccgttccctatataaaggggaaggatgatacattatgcgaatagccaacttgctcacccaacttctcctagctgctcaaatactcatatgcatgttgcctctgtgaccgcttctcgtcttcaagcccatggattcatcaagacaactaccatcttgccatcctacagtgcctccccttgcttctccctaagctaagggaatatcacagcctgacttttcgttttaggacttataaattgtttttataatttatattaaatgttcattaatttacaagtaaagttaaatatgggaaataaaatttcctaaatataaagcatggctggatttaatttgtattaaattcttcatgattaattatactctctggaattttgtcggatttttttcagagctcaattactaattttaataatacaaagaacatttcagtaattatttaaataatgaacaaatcattaaaggatctggttttaatgttgttaaatactttgagtgtccaattattttcaggatttttcttgaaattatttgagcactagaaatatttttaacaattcagagatcatttcagtgattaatttaactagaaaagtaaattaaatccccttttccttttccggctgaaactggaaaagtctatctgtcatcctcagcccatccgtcctcttcgccctctgctctatttatggcgacggtgccgacagggctccacctctcctcctcctccaaccagcggcccaagtgggggactgcgtggcaggagctcggcggcgcgcgagtggagaaaggcgcagcgggatcttgggaggcgcgaacaggggacaacaggagctcggcagggcagatttggtggtgtggccctcttcgccgagctgctgctgtacgttgtggtcctcggctacgcgcaatggcgacaacaacgaggtttggtcatcatatccaccgccgccatcttcccttctcctccctaggccgttgccaccaccatcttccttctcctccctaggccgccgccgccaccccgttgagctcgatagatccgaccttgggtttgccagatctagcgagcggcaccactttagggacgacacacctactcggggtgatggcctcgccagcaaccgccgccgtcacgcatgggatgtgagggcgtcgcatggggccatagcctctcaatgcgccgctccacctgcacctcgccccatgcctgcaagttttgacgaagaacgcgtgacttagtttggctccgcggtcttgagttgggagcaccacgcacgcatctggtgaggaatctcctatgtggatggggcagaacaccacctcagtgcactgtgaacgcccttagaggctcatcaaagaagatggtgttgtggcttttgctcaaaagcttgccaagacacaactctggcagcccacacatctccgtgtgacaggttgagaaagtagacgaatttccaatagtaattcccaattctttattggtaaatgcctaatatgctactaaattttttaccatgtcttttattaagccactaattaccttactgactcaggagtctaaacatcgcatatctgacattttattatatcagtgatattatatcttggggagatgagcaatgcatcgttgtctcaacagtggttccaaccttttgaaaaaagtagttggaactaccatcaaaaccaatgttcataaagcattgatacttggggggcccactaccaaaaacagtttccccacttatctcccccacccacttcacacacacactctctctctctctctctctccatgaaaagatcattcttccccgcccctatccttatctctctctctctctctctctctctctctctcacagaaacccatctctgcgcccctcagcccgtcactgttgtgcctctgcccaccttgtcctcccctcctctctaaacccctcctcgcttctccccaatccaaatcaatgaccaaatcaaagacaatgatacctcgacgatgcttctcctgttgttgcttcctctgtctctcccgctcctatcctctcattcttagtcaacaccgtcaaccacatccaggccatggcttggggtgatgagctccactgttgcatagattgttggcggctagggttgatgagctttgcggcgacgcggggctgctcaaagcctatgaatgagctcagcttcgaggtagatccgtccaagtgcttgacagatcaggtcatggccaagtcctcctcggcagcggcggca

SEQ ID NO: 8206 - DNA, 9182 bp, Oryza sativa
taagttcagcgctatacgatttggcgctgaataaaaggatcatttttaaaataagttttggctacggttcatttataaaattagtttttgcaaagagtcaaattgtcaaaatttgtgtatatagctgtctctaaataacactgcttttgttcctcacactaggtaattgacatgaaatatagacatctttttgttcattgcattaggccaatgaaatcgagttcaacagagccgagccacaatttcccgcccctctccacaacctcactgagcgtcacacccttggcagccgtcagctcctcgacctcgacgccatcgccgtcgagccggacgccgacgaggtgcttcgccggaggagccaccgccgccgccgcggtggcgtcgagccgcgccttctcctggttgagcgccacccagtatcccccattggcgtctcgccggacgttgtcggggtaacccggcaggtcggcgaggagctcgtactcgccggcgttgggccccttgatccagtaccggaacgcctggcacggcaccgtgtgcgccaccacggcgtggctcccgtcgcggctgacggccacgccattggcgtacggaagcccggccctgagcacggtcacccgcttcgtcgccgcgtcgtactttagcagccgcgccgtcgcatcggcattcatcatgatctcgctgttaaacctgcatccacatgaacacacaactcttgttagtgagatcatcaggaagtggattttcattcctcgagagaatatccccttattttacgtataccactaattaaagaagttataagaaaatttagaaacttttgataagatggatcaatatgagatatgttactatataaacaagttcaaattcaacatatataattgtaaaaaaaataatgaatattttgactacaaatattatgtgttatttgcaattaaatttgttattttttttacttgtataaattaaatttaaacttgcacgattgtgtgaagtgatatatctcataatgattatatcaatttttttatagaaaaaatagtggctatttgaattacttaaaaaacttagggatgaaaacactttcccaaaagatcacgttgttgctacgcattgcatacacatttgcatgttgcaaaaatgatttgattttaatttggatcgtgttcttttggtaattaccggcgtgggtaggtggtgctactatcggtgaagtagacatcaccggtggcctggtcgacgtcgatgccattgacgaagttgaacgggacgccgtccgcgccggcggcgagcaccttggcctcgccgccgcgcggcccgacacgcatcaggcccttgtacgcgtcggcgatgtagaggtcgcccgtcctgtcgtggaacgcgagccccagcgggcgcccgcacatgctctccgtctcctccgccggcgccaccggcgtcgtgcacatcggaatcttcctgcacgcacacggtcgaaccatcaatgtcaatcgatcaagaacgcgatggagtggagatttttcattttctagatttttttatattttaatttcattaatagactttttgaaaaaaaatattttcagaaactaaacctccagtggctcgcgtggcagcgttgttttaccacgccagctcctcgtgacgtgacaaggttatatggccatgccagacgggatggcgggatcaaaagtttatatttaacaatactttttgaaaaaatctattaataaaattgaaattgaaaaaaataaaaaaaagtctaaaaaaaattgatggagtgaggtggtgtgtactttaccggtagttttcgtggtgcgcgaaggtggtccagccggcggcggcgccgccccagcggaggacgcggccgtcggagacgccggtgtaggggccatggttggaggagtcgaaggcgaggctctcggcgccggtgacgccgtcggggagcgggaggtggaacgcgaactgcgcgtgcgacgtcttgacctgctgcgcggcggcgcacggcggcgcggcgaggaagaaggcaagaagcaggcagccgacgagccgcagcagcgtgaccaacgtcgccggaaaacctcgacgacggcgagccatggctgatcaacgttgatggtttcgatggagatcagcacgcacgacaatctgtactgcttttattgggagagatcacacggcctaattctaattcaagtcggtatacgactgcacttgtgtacagctcgatcgactggtggcgagtccgattgcttcgaccgattgatccggccgccagagtcgattacgattagaatttcgccggtcgccggcgctgcgttccgacgactaattgacaacccttgcaatcagatctttgttgatttttccttttttttttcctaccttactgttatgttaggctaggtatatgtttgaaggctttcttccatgcatccttgaagaggtatattataccttctcacaatttgagagataaaaataacttgttaaattgattagaaaacaagtttttattagcaccagcaatacttttctggtcattgtgaggtatagagagtatatgtatcttatagtgttagtccggaggtagaaatacgtacctcttaattggcacattaatatctatacacaaattagtgatgatatgttgcatatgcatgtaccagtgatgatacctatcaggtatcaatggtggtacaatagatacggggatatggatacatgtacgcgatatggcaataccagaatatgtggcatttttcaaaagataatacgggatatgtttatatatatgaattaaatatagaaattatttactacaatcaccgtagttgatagcttcaagtccactatgtttaaaaaaaagctttaagcccattaactgtgtataactaataagagattaaaaccaagccgccagttgacaacaatcaaaagaaaaatccgtggaatcaacggttgctagatgcagtagcacttagcttccagttcctaaatccatcggatctaataaaaagatagttcttgtactgagaacataattaagaaggcaattacacagtcatgcagattcatttttattttttttaaaaaaaaaggcattgcagatcaagaatggaaggctagaagaggagcaaaggaaacaaacaacttgatggtgttagggttgtgtctagtgaccggcgtcaaagggactgtgttgggcagcggcgaccctagtcccttgggcatgccggtggaggagttgcatctagcctgtgggtatatactgccatgctgcccctaaagatggcatagggcaaggagatgtcgcactgtgcacaacgatggcgcgggaaaggtgatgtgcggttgtgcccgatggcggcaacaacgctgcagcatgtggagtgcgtcggtacaccacaagatttttgaggtcgacattggacgtatcaatgttgtattagaacttagaagtgtatccaaattattttatttatttgaattaaaatcataaaactgatgatacatacgtatctgatagagatactagacttgagggacatatccaggtaatgtaggcgatatgtagttaccagtgatgatacttattagttatgatactttcgaggatggtaccatgatagtaccttcatagtttcagtatcatgatatcacgtggtatcatgatatctagtatgtagcactgtagttatttgatatctcaaggtaccattaaagtatcattaataactcaggcaggtaggcccaactagtgtggaaacacgcacatcaaaagcagaaacagaagctttaatcaggagcgtgtggagagagagagaggcgtggaccccatatggatgcttggtaaaggcgaatgtggccctatgttggaagaggtcagagtcatgtgatgggtgctcgcacgagtcccatgttgcatggacgtcacgaatggcatcctatttcaagcatttttctaacgagaaatctataagtagttgtaaccagtttgcaactagttggtagtaagtgataaaaggctgcaggggtttagccattgcacctgtgaataaagaaataagacaagttgtttattgttctagaaatgccccgtaaatgtttaaggtggcagtagacgaggaagagagcaagcggttgagacgactcgtgaataagaaaataagatggtttgcctattagtcttgtgttggtctctgcatgtttaaggtgatagtaggtgtgaaagaacaacaggggttaagtcatgttacccaagaataaaaaaaaaaagaagagtagcttattagtatgccagtggtcctaacgtgtttaagcgaagcatctaaagagccgatgagaaaaatataattgagcacatgtgtagcgtgatattacttggctccaacgaggccttctactacctatgctctatcaacatttcctatataacgaggaagagcaacacattctaccatactcaccaatcttctcatagatgcttagtttctcaattacgctcactttctaagccacctgcttctcgtctttgagcccacggaacactggcacaactgctgtcttgccaccctacgattggtttggtgcctcctcttgcaattcctctaatcgtgagtaacctcttgtttatcctactcatgcaagaccatgtcccgacatagaaccttaattaggggggggggctcattagagaaaacgaggatatggctcctcacacaagcttcctgatgcaaccttggtgcttgcagtggacatacatattttagaaccagtgttactaaactctcataatctaggtattcaaataaatccaacttttagacaactatcggtaaggtattaattcctgatgccacaatactaatcaccgtgcatgcaaccatgagggaaattgtctctaggtaccatttataggctacacacctacgtaatggatcatttccgctttcaaactgatagatggaggcaattcaaaccggtgctaattaaatgtttagaaaatggtataacaccgtaatatgtgaataattatattccttccattcatcaccattctatactaaatatccctcattttagaaactactgaaaagcgaaactactgaaaagtacagtgaagtggacattacaactggcattcaacaagtgctctacccttcaagtgccatattttaatccggcttaaggaaggatatgtggtcgcttgtgtgtgattaaataaaaggattgcaatggattgtgtatatacaattttaatgataacaacaaacactataaatgtaaaagaaattgaattagcattgcataaatgtaactaagatgtattggcaaaaaaaattgactaacaatattgtgatagcataaaaatgtacatagcacagggtgttaatttttattttgcaaagtgtcaatgacatttttgcctgatattgtgcttatctcatttttctgccaatacaatgttaattccatttcttgtacacatatagcattaatcaatatgcattatcatcaaaactaaaagaatataacacattgagattcttttatttattacatgcaaacgaccacatgtccttcctttggctggataagcatatgtggcatgcaaccctaagccgagctcacgagcctgagctttttgtccacctagtcacagcaggccaatgaaatttgtaaattccattataaattgatggttttcactccatatttgtgaagtgatccatggatagtagtgacaccaatggtttctcatcgtggctcagctcttgatacttctaagtgattttagtggtttcatcgtagcatgttaggggtttatcccaccactaagtgatcttatttttattttcttgggtatatcgtgatatagaagacaggatgtacaatatgttcctttataaaaaaaaacacaagtagttgcaatcccttgaaaacttgatggcggtaaatgagaaacaacagcacaagttaagccatggctcccttgaataaagaataagacgagttgctatttttttttaagttgtacatatgtgttgaagatgatagtaggtaagagtgacaggagttatgttgtgcttcttgtgaatacagaaataagatgagttgtttgttattttagttatccctacatgtttaaggtggtaataggaaagagcagcatgggttggagcggttccaatgaataaagaaagcatggttgtttattagtctagtagtggtccttacatgtttaaatgaagggcccaaccactacccaaaaaaaataggcttgagcatataggtggcgttgacatttcttttggctccaataagaccttcttctacttgtgctctatcagtatccattccctatataaggggaagggtgataaattatgtgcatagccaactggcccacccaacttctcctagctactcaagtattcttatgcatgttgcctctgtgaccgtttctcatcttcgagcccatggattcaccaagacaactaccgtcttaccatcccatcactggtacagtgcctccccttgcgtctccctgagccaagggaacctcttgtgagagaatacaatgatgtgtctatacatgtgaacttgccaagacaactgtggcggtgcatgcatctccgtaaaatataatagagagggagaggtacttgcgatggattgataaagtaggtgaatatcaaatagcaattcccaattcttcattcatttggtaaatacttcatatacttctaaaattttatcatgcctttattaaaccactaactgtcttagtgacgcgaaagtacatagacctggcatgtcttacatttattatgttagtggtatgatgcttttgaataaaaggtccaaccactagagcaataaaggttacattcaagtgtatgcatgatgtggaatcatttaacaccggttgggtttctagttatgttattaataaccttcttttcataaggacagggaaccattagcaatttttattagcaaaaaaaaggttatcttctttttttttcatctaagaaataaaggcagggtggttttttgctgaaatgctggttgaagacttgaaaatggatagacataaaaatttgtgttttcccatgcttggaacttttttccccaagacaaaggacagctgatagaacaaaataaaaatataagaaatgtgatctctacaccctcatttttatgagaaaattactagcacaataataagagaatggtaaatttaatgtaaatatggcattcgcttgctttctcaatcccacgcaagtgcctcccttctttaaaatgggaaattagatacttaccatttaatagggtgtgaccaagaatttcccgtgttgatagaagttaatttacttaatatattgccactttggttaattaatttcgccacatttcaccttctccaagctacgtcaccttttctatttcccaaattgcccccacattggcctggccaactagcagtgatgaaagaaccgttctcacaagtgaatcatggcacttcagtttattaactgcaatactaagatttaaaaaaaatgctacataactaaattgacattcagacagtggaaaataaacaaaaatcaagagaatctctattgccaggaaatgctggatagcactgttgttcaataggctttacaagatgttcttataaaatgtcatatgagaattgtatatatttttgttcagagctccatcgtggcatcctcttggtgttaagccaaacaagaccaatatctcactcttccaattaccaactgactggagtctcaagcaaaactgtttcatgtgaatcttcaatccaaaccaactaatgtcagaaactcagaatatcgagatgaacgaagttatttagccatgggtgactaaaaacacgcttgatcgtagtctcacatgaaatgttcgcatgccaacttctgaatatctagtgacagtttgtgaactatatgaactgcgggttctgaatatccgattgatctaatcagagtctgcctcagaaatagctgatttgtcatctggcatttcatcagagctactcaactgagagcactcatcagaagcccagtcgcttgatgcttgttcctgatcaccgttctcgctctcagctcctgcactctcttcttcgagaactgaaacagatgtcttctgtgtattatcctgtatggttccattataatcctttcccctccaaacaataatctgctctttgtcaaaagagacaattatgcaaggaacaaggtcctacagcaaaacagaagggaagaaaatgctctgttacggatcgtcaaggaaaatacacgcattaatatatgcacataataaactcaccctgagcttgactccaattttccgataatcactttttggcaatcctttagaatctatccggaccaactcatcagtcaaaaaggcatcccgaaccattggaacaagactagcgtaatacccattcttggctgtgaaatagcgcagttgttaagtcctctcttcaaccctacatatatgtaagcgaaaaagcggtacagcgtttacctagcttcgtcaaaacaggaacatataggcctttcttcctcatttcctttgtctcctcaactgtcagtccttctattgttgttttaattagcctcgggtatacaggttcagctggcttccacagcattaacggaataacaggtcttttctttggattataatgccgtcccctgtacaatatcaactgaccaccatgcctgtggatgataaggccaccagttttatcctgaaagaagtgggcactactcatcatgctttctaatggacagaaatgtaacaataagctaaaatcaaacaaaagctactaaaatggcatcagtgtattcacattagtacatgcaggcaaagatgattcttatttattagacccaacacagatgaagctacctcaagctgatggcacacattctgcatatcaaccgtcggcacgccgaggcatttcaccctgaccgcctcgtcgttcttccagtgattatgtatgtcatttagcatgttgtgagtgagcccatctctccctacaaaaatcaccacccaatcgaatcataatcatcatcaccacatcttgaaatggagtaaaatttaccaactaaaaacaagtcctcttcttttttttt

SEQ ID NO: 8207 - DNA, 1642 bp, Oryza sativa
agagtagtcttacccagaccaccagaacccacaatggacaacaccttgacttttacatctcgtatccccttggcaaaccactccatgatatgctcctttggtccattgattcccacaagctcatcaacctcaacgtagagtgctggaagcctagggtcaatatcacaagtggtacagctggctaccagaccaataaaattatacctcttgtgcctcttgcttgcctctatcacacgtgtcttgagttcttcgatctcattagagatttcatggcaagccttcatcttcttcagtttgtatgagaatcccttaaagaatgtagattgttcatcttgcttgtgatcaacaaggaccaagaaggaatcaatgaaatcttcgatatcataggccaactcacgcacggtgtccctccaatccttgtgcaggggatcaagttcctctacagattcaagcatttccaaggcagccttcatgctggtcaactcatctctaaagaaggccatttgactgtgtacacctttgagcttggtgtacttgtcctccaacatcttggagagcttggacaggacggtgttcatcacttttgtagaaacacgcacaagcatcatcgccattactatcttatgtcagagctctctgttagatgatcgaattgtaggattcgtgggatggagaggtgtccatgaggtagtttgatggtactagtcatgaaactaggaagcttcttgtagttgtggaggatttgaagaaatgttctgtgttcatatggtgcctaggcctgcatttggaagaaagatgatgcactgagtccactcggtcaagtcaagtcaactagtgttttctggccgcacaattgttgtcccaaactcatcattgttatagttactttcagttataatattctccatctttattggctttctgttaggaactttccttgtttttctcatcacaaggcgttctttcagttgtctttctctgaatgtacacaacacctaccaagttgtcttgttgctttcggccttgattctaaagttgttttaacaattttcagttaacagtgaaccatcatataactctttaggccttgactctaaagtttgttttaggaaacactaccagagatttgatattcattcagtgacatgaatcatcatgacaaaatacttgggagaggttctatggctgcagagcaattgcagattcaataaggaataccaatttccatcttcttgtatgaatcatgctagcttaattttctcattgatttgcgggtactcttctaaactaggacagtgcttgggttattctttcactgttggtccttcaaatattggaactcggaactagtgggaaggaatgtttggtccattgtaaattggtttcttcaaatggtttgcttcatctttcatccaaagtactgttgttcagctggttgagttgtcagcttgattcagtttacagtggttccaatgcctttccattgttcctgtctagccatctatatttgggtattatttgacaggcctgtttttttgcttggtttgacagtctacttgtatgttttcattttattgttctgttggtcaatgtatgtacacacaatggttttgcactgacataatattttcttaccatacat

SEQ ID NO: 8208 - DNA, 1138 bp, Oryza sativa
aggccaaagtaataataccatggtttttccttacatttggtccaaaatagttaaatgtcaccaccagtcagtccaataatcacaggtccagcaaacagccgcagcaaccttaatcctagctgctaccttgtgagctttaacatactgggatcttgttgcaacttgcaagcttgcagcagccactcaggaccagggtttgacttaccatctgtaaccgcgcggttaccgcggttaccggccttaccgcggggtatggtaatagaaaaccacggtaacctccttaaatttaaataaattttaaaaataatttgaatttttaatatattttgcatggtttcgtacggtttttcacagttaccgcggtaactgtgcttaccgccagggcacggtaaccccggccgcggcggtttgtgaaaccctgctcaggacactagttccttgggatcatgccgttttcggagcactgatatccaaggcagcacatcaaggaaccaatcaagcaatatacatcaaaacatagttgtagctggctacattgggccaattggttggtatgataaaaatcactcttccgacggacaagaactagcaactaccagacaagaattagcagcaaactaccagtgcgcaacaatcatgtccgtcaagtcaacaatccactctgagttccgatggtcaagtcaacaatccactctgagtttcaatgagggccaagctctgagggcccaaaatcaggagacgttggctcaaccggaagaaagtcttgctacatcccaaaagggagaaagccttgctacaccccaaaagctacatcaagaggtgagtgactccccccacttttaagttagttcaactctctctaaataaacaatgtgtgactattcccaacaagctctacctcctgccgtactacttctatcttctgccactcctcccatctctcggcaaggccatcaccttcaagcatcctcaccacctccgccatcttagggcgttttacaggggagccttgtgtgcaaataagcgcaaccttgattagtgattctacctcaacatgaatgtaattgctctgtagatctggatcaaccaacattttcagccttttctccttgagtaatcgtttgacctgcacaaagca

SEQ ID NO: 8209 - DNA, 1793 bp, Oryza sativa
  unsure (1)..(1793): unsure at all n locations
ctaatgccataatgattaaaaaaaggactacttttaaaaccttactgggactactattttttatatgatacaattttggacatacataaaagtaattttatctaactcccaacacaacatcaagccacaaaaggacatgaatatggactgcaattcgaattgaagattgtgctagtcaattacccagtccagtagcatgacgtcatcatcattggctagacgagcaaggtcaaaggcacgttgtcctgtaataagctccaaaagcataatcccataaccaaatacatcagttttctcagagataattccagttgaaagatattctggtgcgatatgcccaattgttccacgtactgcatttgttcatcggtatccatgtgatccattagtttggccaaaccaaaaccccccactaaggcttcaaagtcttcatctaatgaaatatttgcagctttgacatcacgatggataatctttgggtcacaatgatcatgtaaataggacagtcccctggcggaacccaatgcaatcctcctccttgttcgccaatcaagtggaggttcatatggcggccgttctataatataaaacccaaatcaaccctctaattatctgaaagatacagggatgtcagactagaaaaaaaaaaggcaacgtaactctaagacgtgatgcaacggttccattagacatgtatggatagacaaggaacctttttgttggcgttatgcagaatccatgaagacgcatcaggtttctatgcacaggcatctcaacttgtgtttgaaagtgccatgttctccaatcaatgtttgggataacccatgcttaaagcccggcttatataatcctctttaacagctactactgagccatctcctaatcttcctttgtacatgctgccgtcgaatcgaccacgttgaagaacattgctatcgctaaagcaatttgttgcatcttctatttcccgtagtgaaaaaatnttatgctggcgaggataggcctcatctggaccctgaccctcaaactcttgacttgtctcaccctgttacacatggcacaaaaagaaaatgaaatgtgaggatgattattattgagaaaacagatagcggaacttcgcttccagtaatcccttcttggcagctactgattgctttgtatgatccaatctcacattttttacttattaaaagcatcaggtgaggtacgtcctgcaaatgttggaaggaaacaggcacagagccacagctcaagaaagagagcgacaagccaggagcgaattaattgtccaattaaacgataagatattgcacttttgcagcatccaagaaacaaatagtaataataacaataataggatttgaaactaagacgatgaattaacaatcaatgtctccaggtctggtcaagaacttaccaataaacaacttccatgatcatactctaaatggaatctgctagttggatgattgggaagcttctcgatggcagctttgattaggctaacaacagacctggtgatgctattgttcatatcttgttctggatcataaataccatcagagcaaatgttgccccaaataccgatcttgactttggtaagggcggagaggtgctggatgccgaaatcagaagcaccattcaggcaatccattccatgtaaacggaattccacttggaagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8210 - DNA, 874 bp, Oryza sativa
gcaacttgcaaataactgaacaaaattaactgtttatcctaggctgtagctacaggtccatcacctaatgaactatgaaatcatgtgggtatgatcgatgaatataattgtaacaaaaaaatggcatcatttttaacacgatgatggtgtttagttttgaagttatggagtgtatttctttcgtgcaatagcgcgtgtgcttgcgtcgactaacatgagtcaggtcataagaaatcttggtatggtagtctattgatttgtaggaagcttggaataaatcttagtcaatagtgaggacttggactaccactaagggaagagctgaaagacacatggtagattgacattggcatcgtttgattgacatcgtgtagaaggattgatgtgacatgtgactcattagtgttatgttgctcgaaattatggtagcagaattatggacttacaagaatgttgaccttgccgtcgaacaaagtacgtaccttgccggcaatctcctctttgtcggtgcgcaccaacacgttgcagacggagacgatgatagtgaggcttttgatcatccactcctcatggtatatactcagctccgcgtcaattggtgcaggcgtgcattgttgcgccgaagcccacgagctcctccacgatgaagcggctgcacgcgtggttgattctataatggacaatttggtagatagatgttatgtagcgtgttggtgaataaccacttaggggctgttcagattgatgccattttcacccataccattttttgacaaagttgccaaaaaatgtctacgtttagtttgttgccaaatttgataaatacaaaagaaatcctgccaaaattttggcattgccaaaatttagtaaggtt

SEQ ID NO: 8211 - DNA, 2968 bp, Oryza sativa
ggtccatcttggccagcttaaaagattttcgctacgagaacttcaagttgcaacaaagaccttcaacaataaaaacattcttggcacaggcggttttagcaaggtctataaaggaagactagcagatggttctttagtagctgttaagagactaaaggagcagagaacacctggtggggaactacagtttcaaacagaagttgagatgattagcatggctttacatagaaatctgttgcgtttacgtgggttctgtatgacacccacagaaaggttgcttgtgtatccatacatggctaatggaagtgttgcttcacgtctgaaaggtacctcgccttccttttttccagtcatgcatccctatatctttcaaacaattagaggtttgatttgggtcttattttgtagaacgaccaccatctgaacctccacttgattggcaaacaagaagaaggatcgcagcaggttctgccagggggctgtcctatttacatgatcattgcaacccaaagatcatccatcgtgatgtcaaagcggcaaatattttattagatgaagactttgaagctgtatttggagattttggtttggccaaaccaatggattacaaggatacccatgtaacaactgcagtacatggaacaattggacatattgcaccagaatatctttcaacaggaattctctctgagaaaactgatgtatttggctatggaatcatgcttttggagcttattacaggaaaacgtgcctttgatcttgctcttctagcagaggtgagggtgtcatgccactggactgggtaagtaactggtacattcctcaatccaaattgcagtcgagatgttcatgcccttttgtggcttgctgctgtgtcagagttagataaagtaacttttctgtatgtccaaaaatatcatctaataaaatgtagtttcagactttcaataaaggtcttaaaaaatagtatttttatggttatgtgctctgtgcaggtcaaacgattaatcaaggaggaaaagctggagaaattgattgatccagatctacagaacaagtacattgatgctgaggtagaatcactaatccaggtcgcgcttctttgcacacaaggctcccctctggaacgccccaagatggctgcggtggtgaggatgcttgatgaaggtgatggccttgctgaaagatggaaggagtggcagaagatagaaatagtacagcaggacgtggagcttggcctgtatcagatggttggactgttgactcaactgagaacctccatgcggtcgagttatcagggccaaggtgatgaatgctcaccggtaactttctgctgattcttgtacatcggaagagcaattcgtactgatcaccctagtcgaatcaccatctgtcatatttgtttgatgtataatgctttttcttgctcgacgcacaaccatggacattgccatattggtgccacggaaacagcacaacccgaggaactagtgtcctgagtggttgctgcaacaatgtcccagtatgttaaacctacaatttagtaggatggaactgggtatcatttttgcctcctttgggaaggcttcagatgatgcaattgcccatggtgtacttttatttgggcatttcgttatgtctgtgtttcctgtaaaggatatatacctagttctgaatcaaatgtaccttctgcacagagatgtaatctttggtaagaatcgcttctcttttttttcttttcctaaggtggattggacaatttggtcctgttatggccgtgtttttcttgggaagattatatgtttatctccgtcttacactgttaggcacattatccgtaagtttgttatttaaagaaaactactagcagggtagcctgcgagtaattgctcggctagcacttttataaaattatctggtttttacacatgacttttttaaaaaatatactaaatagtcatctaattgttttaggattctttttttttttataaaagaagtcgaatcttctcattagcaaccaccagcaactacccctcgctcatttgcccccattttacttgcttgctcagcttgccatggcttctatttatactcacctttagaaaaaccaaaccttataaattttagagttcaaaatagaacacacatgtaccttttgttcaaatataaaaatcaagttgtaattctcatgtaactctttatttatttttcttaatccataatattataatctaatttcacctagactttaggtggccgcacgggcattgatattgttcaaaggtaagactatagtttgtttagaaattatctcatagatagcgaactaaaggttggacgatgtcattttaaaatgattcagggggtcatatttttatccatagttttgtgtgtttagatccatgggtgtaaagttttggcgtgtcacatcggatatacggatacatatttgaagtattaaacgtagtctaataataaaataaattacagaatctgcctgtaaaccgcgagacaaatttattaagtctaattaatccatcgttagcaaatgtttactgtagcatcacattgtcaaatcacggcgcaattatatgcttaaaagatttgtctcgtaatttacacgcaatatgtgtaattagttattttttcgtttatatttaatactctatacatgtgcctaaacatttgatgtgacagggtgtaaaattttgctagggatctaaacaagccatttaaagaactttaaaggttttggtgcacacaaaccacctaccctattaacattgtttgaagcaaatttctttctttttcacatgtttgattattttctttgaaacaatatttatttcaaatataatttaggactgagggagtaagagccaatgaaccaatctgatgggaaaagaatgtgggggtgtcagtctcaggctctcagccacccaacatcaggcggagatgacaacat

SEQ ID NO: 8212 - DNA, 15697 bp, Oryza sativa
tcatataatagcatatatgttttctcaatgtattattcaaatatattaaaatgacaacataattttaaattttatagtaactttacgaaactactcatgtgtaatattcatattgtattatatatatatatatatatatatatattagttattaattatttttaatattaaattttagttatttgtaaattatatttttatatggattctagactcgtctttcaatatttcttttttaattctaaattttcattatctgtaaattgtatttttatatagactctaggctcttcttccaatattatttattttttaattctgaaattttattatttctaattgtatttctatgtggactctaaactcatctttcaatattctttaatttttaatttcgaatttcagttacttctaaattgtgtttctatattgactttagactcttcttcccatattttttttaatttcaaattttagttatttataaattgtatttttatacgaattctaaactctacttttaattttattatgtttattccgaattttagtttgttttaaattcctatatggactctatactctacttctaatattccttatttttaattccgaatttatattatttcttaattatatttctatatggactctatatatactctacttataatattccttatttttaattctgaatttctattatttcttaattgtatttctatatggactctagtctcctcttccaatattccttattttttaattccgaatttcaactatttctaaattgtatttctatatagactctgtttttctttttctccgattaatatgagaatttttaggccgcgagagcgaacgtggagggtcctttttctattcctttaataagttaatagattggcattagttccaaaagagaaatttttcgcgcatgcaaaacgagaaaacttattaacacatgattaatctaatattactaagtatgaacttgaaaaaggatttatttgaattttttaaacaacttctatatatgatttttttttaaaaatacgtctttgaaaaatgtgctaatagaaaacgagaaagttgaagaaaataactagacctaagtgaggatgaactgtataggtttataggatttctggtgaatgtgtgttaaccgtgaaatttggtaaacccaaagtcatcatcggcctagagtcagcatcggcttcatagtcctggaatcggccgatgagaattatcaagttgccaggattcttgctatattcggttaaggaaattaatctattaaataaagtttatccagaagagaccgagttcaagaaagatgcggcatgacagtttatctattaattaggaatactctattaatttccttttatctttagtaaagtatgtttagtgtccgataaagactttatgttttccttttatctttatgaaagtttctctcttgtccaacaaggactagtatctacccatgggtataaatatgtacatccggggtcattgtaaactatctcaattgtaaactatctcaacgatcaatacaattactctcggcacatcgccaccttttttaccgaggttttttacttatcattcggtggaatttggcacctgacacggggctgcattagctttcgatctccggcgaaggggtaagtcatacgttccgccggacctggcaattgtattgcttcattggcgtcgttaaaggctacatcaatacattcgacctcttgattgctctggttcagttgatatatttgcctacctatctatcatatatcttagttaatcttgtcttagtatctcaatttagccatattggtcgattctcctttagggtttatgccggtattggctaaatcactttaccatattagattagctaaggtatctaccaccctgaaaatcagacaaaggcttgattatctagatattatgtttctttttatatttagtgttgcatcagttaagtttgatctactaagtcatgcttagaaccataatctctagcctgcttcttgattgccaataagggtttcatcggggttttagccgatgagttatctggacgttgcatcagcttataaagagtacatacaagttggatttagccgattacgacaaatgtttcactgtttatctaatcgtttggattttatgacatcagacctctagccgatgtattctttaaccatcggattagggcttattctatcatatcattattagccgattggtttctactggattagattgttgtcttattatattaccatccgccgattgtctttatatcattatttacatcaagtgtcagattctacattaaccatatagccgattgttcaagacctatcgacatcggctggtatcagcatcggcatcggctggaactaatccatcggcttatcagctgatcggctcatcagtcgatcggctctttcatctgatttttatatatcttgtcagttgcaggatcaaattgactggcacgcccgcatcccatcaacctttagatctgcactagagctaagcagatctcccagaccaccgtgttttcacatcaacaatgtgtaatgcctctagcttaaagtcctctttacttcactttttagtttttacatagatcagttctgtcctgctgctcgttggcggttgcatgtcactttaagccgtggtatttctgacggttgtattgctgacttgctgaggcaatagaaccacggaaggagcccttttctattgttattttccttaacaagtaaattgtgttcgttaggttgtcactgttttcaaataaacaaattcagcttaaaaaaacagtttggatttatggaccaaagccagcaggttattatcaccagttgccaacaattaccttttttcttttctcactccaatcagtttttaattgcggtcatgtcacaataaacgatgcattaactatgaagcattcagaaataaaaatgaaaccacttgtgagtttcgactgactttccttgggagtatagatttgattatgtcaccagcaccaataggctcacagaaaccttgataaacaatccttaaagaggattaggtaaagcatcccaaactgacagcacttctaggtgcatgattggagaaaattaatctaggtttgaagaatgatgaccattttttctactccgtgtttctcttttctatttcggcccattgattggcttcaggtaacgcttgtttggctatgaatgtaacatagatattatatttgagaaaatctattgtatacccctgaaattttagctaatcccttttatgtccctgaattttgcttacttctttgtataccctaaaatttgattttgattccttccatacccctcccatcagttgaccatctaatttctataaaaataaccattttaccctttggatgaacacaaaaaattatgaattacattattaaaaatgtaaaagtttgtcgcatgagactattatagttacgagtttgttgtgcaatgcattatttatcaaaaaaatatttttagataatgaaataaaaaaaatattttttttaacaaaaggaggatcattcatagaaagatgggactaccaatgctcacagtatttttttaatgaatgctcggtaaaaaagaaatccattgtcctattaaaattttagataaatattttaatttattacatttttttattttcaaaatttatgtcaaaatttcctgctctaattatttagtctcatcagttttataaaatgcacatattgtgcactcaaacaaaatttttaatcgtttttcaagtttgtattcaaacttaaagcagcaaaagcgaaaaaggcatttacaaccaaacgtaatagtgaaatgaataaaaatgtaatggtagggacatggaagggatcaagttaaaatttcaggggtatagaagagattgggtaaatttcagaggtatgaaagggattgagtgagttttcaagggtacacagggaatttactcattatattttgtgttgtgttcagacctttaaaatttctttgtacagaagatgcatcaaaataacgacttcgctaaacatatggtgacctctctctctctgcacgaaatcggtcaaatttgcttttgtggggatcactagcttacagcgtggcccattaattaacagctgtgtttttttttgagagggaaagagaggagctctgcctatttcatattaggagaagagagaaaaaactagagtttttacaaactaggttacaaaaggatcctatgggatccctctcgagaggttgacaaaggaggtgtcaacaattttaagacaatgcaaagcaactagaaggaggatatgagaactactcatctatgttgtgtgctccatcataggctttacacatggcgattattgactcgacaacttgcattactgtgctgtaagccccgttaaagatcctagcatttctttgaagccaaatgccccaggttgtgtagatgaagaggccatcaaagttccttctctgttctttcgccatctctctcctgcaggctatccaccatcctagcatgtctccattgaaggaggaggccagaggcatatgaaggcctaccttctgccagatgaatctccagatttgctttgcaaaggagcagtccatgaggaggtgagtggctgtctccggttccacacctcaaagagggcagatgtgactgttgtcccaaccacggagatggagcttgtcggcagtgaggatcttcctgtgtatcataagccaaccgaagaacttgcatttgttttccacttttgccttccaaaagaaatccgacctgttatcctggatgcctccgacgaattgtatcctatatgcggtgtttgccgagtaggttccatttggagaccaccgccatgtaatcgtgtcatctgtttcttcttgtaggacgacctgttggatttgatgccataggaggatgaattctctgacttgtgttgtggtgttcattcttctcatctgtcttagccaacgattgccctgtagctcctgtgccactgttttgttttttctcgttgcaagctggtagagggaaggggttagctctttatgggataacccatcgagccatctttcatgctagaattttgtcctgtggccatttcctaaggtaatcaccgtggaggccctaaaaagctgcttatctgtttcatcacaaggaaggactgatccctgccaaggtttgtccaccgccgtccattcttgccagagccagcgtagccttaaggaacggccgaagcgttcaaggtttgttatgcctagccctcccatgttctttggtctacagaccctcttccagtttactaagcagtgtcctccacgtgcctgttctgatcctatccagaggaaaccgcgtcggattttttctatcttttttagcccatatcttgagggggaagactgtacgatgataagttgggagggccgaaagggtggatttgatcaggaccgtccaacctgtcttattcagcaatttccctttccatgttggaagccgagctgaaaacctgtcaatgagcggttgcacatccgactttttgagctttctgatgtgtagagggagtcctaggtaggtgcaagggaaggccttcctctgtgctgggaaaggggagagaatattttggaggtccaggtcttcacatcttattgcgtagacttcgctctttgacagattagtgaccattcccgtggaaattccaaagttatggagaatcgtctgtactgtatggagttcctgtttatctggccttgtgaacaccactacatcatcagcatataaggcaacatttaaacgagcggtccacttgtgaaaagggtgaaagaagccctcttcctgtgctctcgcaagtaatttctgtaaggggtcgattgcaaggatgaagagcatggaagaaagggtcaccctgtcaaagacccgttccatgcaagaagttgttacctgctttcccgtttagggggatctttgatgaggatgtagataggatagaaatgatccatccaatccacctgtctccaaaccccaggtatctgagtctatcaaggaggtatggtcagctgaccgagtcgaatgcttttgcaatgtctagtttcagaaggatcaccggggttttgcaggaatgcagttcgcgcaccatgttgttgacgaaaaggaagttaatcctggatgtttcttccctttatgaaggcactttgattttttgagatcaactcctgaagcctaggggccaatctgtttgctagtagttttgagaagagtttcccaaaggcatgaatgaggctgattggcctgtaatcacctacctgtagtgcttcggtcctcttaggcaagagggcaatgtaggccgagtttagtaaccaaaggctttgagtgtcatggtttgccacctgatttatcgccagaacaacgtcttcctgtatgatctcccaacatttgttgaagaaggcacctgtgaagccatcaggacctggggcattatctgatctagcttggaagatcacttgttttatttcatcttctgtgaagggatcctctaggtcagttaggtcttgactctgttcctgtaggaagctgtagttgattgctgtggaacgggatctactttcacctaggtgatgcttgtaaaaggtgagcaattcattttcttcttcctcatgagagtgagccaccccattttcagtcataaggtgttggatgaaattttttcactttctcgcacttgctttgatctcgaagaaccaagtgtttgcatcacctgcttttatccaagtctgtctggatcgttgacgtaatcgtctagtcccagaagtttctattttaggaagcgtctgaacgtgagctctgcaggggacatactgcgttcctcctgagctaggtcgagcctgaaaatcaattcgctcgcaatgtctgttctcaatttaattccacggaccctgctcttgttccaaacacttaaggcctttgccgtcctagaaagttttgtgtggaggcgcttgattgcatctgtcgtgtgtactgtcttgttccaagcttgttggactgtatctaggaaatctgggaggcgcaaccagtacttttcaaaacggaagatgttactctttggtctggagggatttgcagtgagtaatagagggcagtggtctgagaccaaggtagagatggctgctaggaggcaatttgggaatctctcctcccatccctgtgagcaaaacaccctgtcaatcttcgttaaagttggggactccgtttcactggaccatgtgtaacgctgaccatttaatttgatttctagaacttccagatgatttagggcagccctgaaggcttgcatcatgcccctattgagatttgcattgtttttatccctgtcatgcacgatcaggttgaagtcccctagaattaatcaaattggtttcattacctgctttagttgttttaattcttctaggaattctctttttgcatcatcctgttgagggccatatactcctgttaagctccaggtggctctatcttccttctctgtgagtgtggccgacactgtgtaagtacctgtgtgtgcatcctttaactcatatttgttgtcatttgccgccagtaagacacctccccttgtacctgaggtagaaggaaaacaaaagttttctgagaatgttggccctaataacctattgaaatttgcctggtcgatgaaatctaattttgtttcctgcaggcaaacaacagtgcagttgaggtctctaactaaattcctgaccacctgttgtcgggctggggagttcagccccctaatattccagctcagaatagcacattcatttgtaaacattcattttgcttggtatttatctgtcagctggatgaggacatggacagtagaatcaatcggctgaacctgtacagcagaacctggacaactgaacatgtagtggagtgcaggatcaatcagtacaaaggaggcagtggaagacacttttagtttcttcattagtagcatcattatgcttaagatggggctagcagggtacaagggagcaaacagcctccctatcatcacctgacacaacccaaaaactccaaaagcactttcctgccagcaaactacaacctctgggaaccatctcaggtttcaaacaactagaagctaagacagacttgcacagattagacctaagaaacggcataagaaactagggacaacactgatacattagctagtcacacacacagcacaagtcactttggcttcttgtcatcaccaatggcacagccggccaccagggtagagaaagcatcgatcacttctgcggacaggggctgcttgaatagcttcacgtattttgtcatcgcttgatctgttttcttgccatctggggagatcaagccagctttcttcatcaggtcttcctgggcacgatcaccaggcttggccggagcgaggcgagaagcaaccttctttgccagccgtgcgctcctttggagcctggcgcgcttgcacctggcgagctggggtcggcagcggcggaggctggacctcctggaaaacatgctcaaggaaagccgttagcttatcgtgcaaatcaggcggttggacctgttccggcggctgggcctgcggctgttccagggactgctctggcggcggagcgatgttgccaaggccaacctcctccaacattgggtcgaccgacagggggatcgccatcattggagcatcgaagccggcgatggagttagctagctggtcaacttgtagcacagtcgcaaaaggagtagtcagtggaaaaggcacaatctgcgattcctgtgggcgaaactccgtcagcccctctgacggcgggggagggggggaggctgtctggggtaccagcgggcgaggggctggcggaggggactgcctgttgcgaggggacctggtgcgctcccttctaaccggagacgtcgccgcccgctgatagccaccataggaaccacccctgtggtctggtggcctggaggaggagcgcctggttggagccgtcgtgcgagcagggggaacatcccaacccgaaggccggcgatgctcatgcgccggcggagagcgggagcatgagtgagagcggttgcgtcctggtcccagcctcgccgccacatgttcgcgaggggcgcgctgtccatccttgactcctaagctccaaatgatatcgtgccgctttggcacctcttcagtcactgaggccgaagagatcatgccactgccctggctactagggctgtagccccagactggctccatcggaggaggactggagtcaagcacttggtcaaggtggatcagcacctgataagtgagaagcttcgacgagacagtccgtctgcgttccagccctgactcccccaggtcctcaagccagaaggagtcaggagagttctgcagaagcggctcctccagctggaagtgaaccgccttcgggatggcatcaggatcctcggaccaaatccaagcacacaggcaggcggtcttggtctccgtctttggctcctcaagatcctggaccaggcaaccctcatcgaggatgcctgcaattgtatccacagaccaagtatggctgggaatgccctcaaagcagacacgcacgctaaagcgccagtctaccaactctgcctgaactcgcacggcttgaccgagaagttgatgtcctcaatagagaacggactcgccgccaccacgctgtcactgagagtgctcaaggtgcaggtgaggaggtagacacctttagggaaaaccaccaccgtaagctcgtcccgcgggagctagaacttggtcacaatcaacctattgatctaccctgcatttgtcacaggcatgttacctgtgatccggaccacagccgcagacctggacagtaagccctcctcctcacggaccgcagtcgaccacggtatgcagcgctgaatgctgtccagccggttggctaggtcccctggacgcgccattgtagggaggggaggaacaccaggcagctggcaagtggaggggccggcgctaggcgaggagacaggggctgcttctggtgaacctgtttcttctgaactgaagcccctgggcagcggcgagcacggtggccagaggcaaagcagaggatgcacctgggtgggtctctacagtccgcaatgcggtggtccttggcgaggcagcaaaaacatcttccagttgccttccttttaaagagttccaggaaggagatcctgctttgaattggctgaggaggctcatggtaaacctgcttgttgcctggtaggtggtgaggagtgaagactcgagcgttgaaagctttctcagatacgctgggatttgaattgaatgctggtagagaaggtttcttcctccatcaatgcttcggcttcacaatctgccatgcctgctgcgaaggatatgctgggatttcgttgggaatgcgcgaggcggaagtcgtcgcctgtaccatcagcgcaggaggcttctgagagtaactccccttacctgcacagaggaggcagctggcggagtaactgctgtagccacggctcgacgaaggagcaccagagggtgcgaggatccagccgaggtcgcggagccggatgagagcgcggaggtggcgccacctgctcccttcaacgctggctcgagcagatccgccaggagcatctgggggcggaataaatatgtcctcctctgaaccttcacctgaaagggagccgagactgacacggaaacggcgatgtgaacggaaagggggaacctgcaaaggggattgggggacgccggtaccgaattggaggccggcggtggggtgggtgctgggatcgcagtggcccccagtgagggcgggcggggtgggggtggggaactcatcgtgaaacttgctagtggcctgatactactcctaatgtgcctgatatacgttccttcccacacaccacttaacttctctccctaacacaacaaacaaacgagtatgggcttgaatatgaacagatgcaccaagtgaagcatgttttatgtgcatggagtcaaatctggtttagtttgatgatttaatattctatattttctatccttgaataattagggcggttttccgtggagatcgagggcaagaaattgtggagattttgcttgttctcctacatagcgtacgattcgaaatttacattataatatttaaaaattaaatatcgaggatgtgcacagtacaccaacactgaacacaaacaatgaacacgaggttcattgacacatccacgtatcgtgaaatctgaatgaaccaacccgtgagctctctgtcaaacaattccttacctacgtactatttgccactctcttaaaatgccagtgcttaaatgccactctcccaaatttcattcctaaatgccatccggatccacatgtcagcctcactttccattcaaacaaaagtgatgcgggacccgatactgagtgagactggcatatgggcccggatgatatttaggaatgaaaatttgggagagtggcatttgagcactgatattttgagagagtggcaaatagtaaattacgtgggaggctgaaagaacagctctatatgcttacaaaatgcaacattttctttctagacacatatctacacaggatatggatgacgtataactgctacaaaacaagaggcgagggaggcaggttacagtcagccgaacggagaaagtgctttcaataggaaaacgatgagaaggttgtaaataattaattaatattgacagttgaccccatagaccttaatttctttcatgacaataaataatagagccaccaattcctgtggcttctactacagtatctaccagctcagtgcatgctcagcgtcgacaagagagagagacaagagatcgatcgatcagccatggtgggcgcgcttgcgagcgcttccacgggggtgatgaactccgtcatcgcgaagctctccaagctgctggaagacgagtacgccaagctcaagggcgtgcagcagcagatcgccttcctgcgtgacgagctccgcgccatgaacgccacgctccgcgtgctggccgatgtagaggaagacctcgacccccccgtgaagaggtggagggacaaggtccgtgagctcacattcgacatcgacgactgcatcgactcgtttgaggtccgtgtaataagccatcagcaggagagaggcgagggcctcatcaaggggatcattctcaagctgaagaagctgagagctccccatgagattgccaaccagatcgaggcactcaaggcccatgtcgtcgaggagagcaagcgacacaagaggtatgatcttctcaagccatggtccagcagctctgccacttttactatcgaccctcgactgccggcgctctacgaggaagtagataagcttgttggcatcaaagggcctagggagcacatcattgaatggttgaccaacaagaggagtgatagatcaagagaagatcttaaagtcgtgtccattgtgggttgtggcggtcttggcaagactactctggctaaccaggtgttcaaggaaatcagacaccaatttgattgttcagcctttgtgtctgtgtcccggaaccctgacataaagaagatattaagagacatgctgaaagaagtgaacagtcttgacaacacacaaccatggtctcctaatgatgatgagaggcaactagtcaataaacttagagatacactccaagataaaaggtatgcaaacagccatggcattttacatgcatgattgtggaattaaaattcgtatttgatcctagatagatatagcagatgcttacatggtctaagtaacattctttgataaggtttaatgcatataaatattgcatcagtttttttttaaaaaaaaaattcttcaattgttgtgatatatgcgccccaaccgatttgaactctcaatgtaggactaatatattcccgggtattatgttcacctccattaatgaatgatatgatgccctcagcggctcagcggcaaaccgtatgtgcaactgatatccagaaccacggcttgtacatgatcgtgttgtatgcccatccagggtcctatatacacgtgcttgtgtagggaaggtttaaacgctaataccaattgtaacatccctagcttccaaaatccacattaacctagctcttccatggagcaggtccatgtaaatagcgccgtacccaagaatttgaggccctagcaggatttacgattctgagatggccttccgttttgggcatacaacaaatttccttttttataaaccaaaatttgaatacaaattcaaattcgtaaaccaaaatttgtagattccgaacaaatttcataaaccaaaatttgaatacaaattctctgagtttaccgataagcttgtgaaaaccggtcggctttggcgaaattccgagcgaaatcatcgaaatttcaatcaataactataaatagaggtaaactaaaattgttttccttttttaattcgttattcttttctttcctattgtaaatttcagtaaatacatggaatacatcagtttttttgaaaatttatatcccaataggttctatgaatatcatactatttataagattttatttgattttttccttttttatcaatttaaatttgaatttggatgaaactcatcgaaatctcagacggcttctactttcgagcctcgtcgaaacctcgaaatttcgcggaatttgaccggttttcgtcgaaattatgaacatatataggatggagggactaagaaattaattcacaaaccatggtagcactttgcctaattttgggaagaaagggttgtgacattcagttttctgtagcaagtacaaaaaaaaatcttcaatgtttgaaaagcgtgttcttatcattaacatgaactacagttatttgatgcagccctgattaccattgtacacttattggagaaaagaaaaacaatcttgttataaccagattagtgaaggagaaataagactggaacttgaaaaatagaatgagaaagtcctgaaacatgttgtaacacactggcttggattgaaataaatttgttttgaggcccctaattttagggacctgcagggtcgctcatcttgcacttgcctagatacgagcctacacgtacccctagcatccaggcacacttttatcatcattttgtgtaaaatggtataattcagaggtagagtactaaggttggaactcatgactcgagtttatatgccgcccccatcacatctgaactcaccatgtggactaatcccaccaacatgtaccagacgctatggccagatgggccaactactacttgtacaatttgtagcatcaccctccctgattattgtctcactatcttacttttgcacggtgtgcaatacgctttgtttcaccattcccttccattggggagatttgcaataataacactgcaaacattaatccctacttaattaacaaggaaattagtaaattaaagtaattaaggctaatgcaagaatatactccatccgtctcaaattatagggcaccccttttaaggaaaatcaaactcggtagcttttgactaataatcatactaactatatctatactaagtattatacatgctatatcactaaattaatattttaaagtagtttatgtgatgctaattttatatttgtggggatcatagaatgaaataaagtactagacaaagtatgttattgaagaccgtgtaaaaaaagtatagccttataatttgggacggatggaacattagtctcccatgctacaataatcgatataaacttccaatcgattttagtctactacattacagattaaatcatatatagtctatatgtagttgtatgtattttatatgtaagcttatatctcactaggcttgccttggcttaaaaaattttctagatccgcccctgctatgatctatcttgaacagctagccatgcaaagaatttgtattattcaatggtattcagatcttccaaattatttctgtgcacggcatgttggctacttggctgagccaatgaatggaactatgcaatataggtagactagacttaaatgcatagcagatactccctccataaaaaaaaaagagtaaattgcactagcggtccttaaacttgtaacgatgtttcacttaggtccacgaacttgtaaagcgcacatcgagattcctaaacttggtttattgtatcatcccggtccaaagccgcgtttaaccatggtcttgcctacgtggcgtgccacgtagacgatgacatggcacaaattttaattttcctttttttctccccatcttttctctccttcctcacctcgtgtggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgcagcagcggggcagcagggcgagctcgtgctcagcggcgtaagctcgacggcgacaacggccatgtgagggcaaccgccggagtggtggggcgaagaggccgaggcgcgcacggggggtggtgt

SEQ ID NO: 8213 - DNA, 4486 bp, Oryza sativa
accaccttcctcctgagctgtgcaacctccctcccgtgcgcgcgcccggccgtgccgccgcgctcggccaccgccccgctgcctcgtgccacgcccggcctgggcagcctcctctcccacaccgagctcccctcccttatcccaccggtgcccctctcccggcgccatgccaagctgcgccgcgcctacacgccgctgtcgcctcaaccgcgtcgtcgcgtgccggctgcctcgcacgcgaccgcccgcgccgacgccactgccctgagctcccccgtgccggcctctcccttccatcgccgccgcccgtttccgctcgagccaagacgacgccgccgccgagttttcctctcctctcgacagtcgctagctcctctctcctgcaccgccgccaggtcgccgaccccggccacagcctcctcgcaccggtcggcaaccgcctctccccgcctctctcctgcgccgccggcaggtcgccgaccccgcccacggcctcctcgcaccggtctcgctggctccctctctccctttgcctgccacatatgcatctagaggtggaggaaggagagaaaaaaggaaaattaaaatttgtgccatgtcatcgtccatgtggcgtgccacgtaggcaagaccacggtcaaacgcggctttggatcgggatgatacaataaaccaagtttagagacctcgatgtgcgctttgcaagttcgtggacctaagtgaaacctcgttacaagtttaaggaccgctagtgcaatttaccatggtttccgtgtccaactttgactgtccgtcttatatgaaatttttttataatttgtattttcattcttgttaggtgataaaacatgattaatattttatgcgtgacttgtctttttaattttttttcataattttttcaaataagacggacggtcaaacgttggacacggaaactagggtttttcttttttttttgactgagaaagtagtatcttaccaaattgcaggcccactagtgataggatattactaaaaggtttcatgaactctcttgaacctcatcttgccatttcataaagagtcgcatttaattctaccaaagtgatttttatagtccttgtttagccaacctctcctctatagtatgtctgctgtccagactctgttccacagaaccagccatgtaaagaatttgcatttcggtggcgcccaacattttcaaattgtctcattgaaaattgttctcgctgcccctaggaattggagtctgtaaactgtgctgtgtattccctgctcagggtgagcttccagacgatgctgttgtggcgttgtcccaatggggccatattgtgtatcgaggttcatagctcaacttattgtcgaaggtgttctccccccgtaatttggaatgaatttaattgatctcatacacattcttgctgaggtcagggtccatttttggttgaatttttttgtatggtccattcttgaaataaatttctgaaaagatccaaatagtcaaaatttcagcaaagagacaaccacttccctcttcctgttctttcaccttcaccatagcaaaatgcctaatgaaatcataacctttaagcactgattcaaatctaaaatcctgcaggtacttagttgtaatagatgatgtatgggctacagaagcatgggaaactattaaacttgcattgctgagcaacaactgtgacagcagaataatcacgacaacacgtaacactgctgttgcatcaaagtgctcttatcatggaggctatgtttatcatatggaacctctcagctttgtcgactctaaaaggttgttttttaaaagagcttttggttcagaaaacctatactatcctcatctggaagaagtttctaatggaattataaaaaaatgtggtggcctaccattggcagttataactatttctagtttgttggctgatcagtatgcaaaagatgaatgggtgagggtgctagcagcaatcggttttgcacttgcaaaggatcctaatgctggaaatatgagaagaatattgtctttcagttactatgatcttccttaccatgtaagaacttgtttattgtacttaagtctatttccagaagatcacaagatcaacaaacagcggttgataaacagatggattgctgaaggcctcattcatgaagaagagggaagtgcatataaaaccggtgagcattatttccatgaactcatcaatagaagcttgatccaaccagttgatgtccaatatggtaaaccagtggcatgtcgggttcatgacatcatttttaatttcataacaggcaaggcagctgaaaagaacttcaccactttattagatacaacagagttcaaacccatcccaattgacgaacctcgtagagtatatttccagaataacagaaaggaaaacgtcatcatggcaacaaacctgagtctgaaaaatgtccgatcacttactatatttggttactttgtgaaaactccatcattgttggatttcaaagttctacgtgtgctagatttaaaagattgtagaaagttacaaaaccatcatcttactggtatagaaatgttgcttcatctgaaatatttgagtctcggatcaaggtatataactgagctcccaaaaaaactcggagaattacgatatttggaaacactggacataagagagactatgataaaatcccttccatcagcaattacaacattccagaggttagttcgtctacttatcaatcatgacactacatttccagatggaattggaaggatgcaaagcttggaagagttacaaacttttgacatttttacatactcatcaagaaattctttacaagaattcggccagcttacaaaactaagaaagttgagggtgacatggaaccttgataactcattagaagatcatagaacaaccatagaaggttcaatgaaacatttattatctctatgtgacctacattatctccttatctggaatgattgtcctggcctctcactggattcatggtgccctgttactctcagtagcctccgggagttccagatcgaatacggtagcatagctaatgttccgaaatggatgaacatgcttgcatgtctcacagaattagatctcactctgtgcagcacaaaacaggaagatattgatatccttggggagatacctgcctgcttgtctcaggctcactacttctcatggcaccaatggaaggatcttcatcagcagctacaatgctttccgatgcttgaaatacttctttcttcacataaatatgtgtggaacattattggaatttgaagaaggatctatgccaaagctccaacaccttatgatcaagttcaatgcacatagatggaagtgtctgaatgggggctttgatttaggcatccgacatctctccaacctcaccatggctgaggtcattattggtacagattatagtcatggatgctataacccagaggaagagttaatgaaaagcagcaccaattttgctgctagtttgatccagtctgcagttgagacacttcccaaccgtcctgttcttcgttttcagttacagcgtgaagcatgcatacagtttgaagagaggagtgtgaattatgaaatagaggtcaatctaggcgaagtaagagatgttggcaaggtggatcaaggtgaaacaagagttggatcaactaaagagccactttacacgatatttgaggtattaatggattttatcgatcggttcaccatcaaatagttatttatgtttgttttatgatgctttttactactccctccgtttcaggttataagacgttttaactttagtcaaagtcaaactgcttttaagtttgaccaagtttgtagaataaagtagtaacattttcaacccaaaacaaatttattatgaaaatatattcaattattgatttgatgaaactaatttagtattataaatattattatactactccatactcataaaggaagtcgtttaggacaatgtttaagtcaaaccttgaaaatataaatcatgaataactctcaatttgttaagtttgaaaatgtaaaaattatatgtatagatttgtcttaaaaaatactttcataaaagtatacatatatcacttttcaataaatatttttatagaaataagaagtcaatgttatgttttggagactgagtcgctgtcctaaacgacttcctttacgagtatggagggagtatttgtttataaacttggtcaaaacttaaaatagtttgactttgaccaaagtcaaaatgtcttataaccagaaatggagagaccagaaatggagagagtacttagttattttttataatcatactccatccattccataatataagacacaactacattttaaagttgtttcataatataaggcatgtatgcaagcatatcattaactagcacatctttttcactaaaatattattatgtaaatttaagtaaaaaaat

SEQ ID NO: 8214 - DNA, 1908 bp, Oryza sativa
ttttttttaagcggatgtggatgacgtgcggatgcggatgcggagcggattatttcggacgtcggattcggtgcggagtcggtacggggttcgaaaatggataaaaagttgtcggatgtcaagtttgtattcaatccatacagcaaaagggcggcaatacaattagccttaatacaatggcaaaacatcattagttcactacgttcatttcaatagtataactataagtgttcactgttcagttcaatagttcactagtcaaaataatccaagatgcatccatgatccatcaaaaacataatataaatgttcagttcaatagttcactggtcactgcgttgcttagaatgtaaaaataaaagtcatcactcatccgcatgaggcaagccatacaagcatacaacacagagcagtagagcatacaggatcctaataaatgaataaatgatgaacaattaatcaaattataacttgctattgatgtaatttccgcaagcaaagctcatctttacatttctaatacccaaatttgaaacttcaaataatcaaattggattgcaagtgtacaagaaaacaatacatcaatagttcaatacctaatctatcgttggccgtcacctcgtgtcctcgtcgatacaggccgacgggccgacaactgtctatactggggctggcggcggcggcgccagctggagctgaagagaagcggctggcgcgccatcaccttgtatcctcgtcggtacaggctgacgggccgaccctggggatggtggcggcgccgagaagccgacgacgagcagcggcggcgccaactggagctgaggaggagcgacgctggctggacctaaaaaggaccggccggcacgaatggaggatcggcggcaccaccagccgacagtggcgctccggcggcgcgtgtgggaaacagggtgaagaggaagagacagacggcgcaggcatttggcagagagagagagagagagagagatttggggaggattgagtggattaggtcacaatagatgggctacaatagatgggctacaatagatgggctgaaagactaaaagttgcggattatccgccaaatagtacatcggataatccgatcaaaatatcggataatccgcatccgtcggatatcgttgataccacatccgcatgataaaatccgcatccgcatccgcatctggccggatatctaaaaacccttaccatatcctcacatcggacggattcggagcggatcggagcggataatatccgctccgttttcacccctaagtctatacccccttcttgttcaaataaatggcattactgactttatttagttaagcttttgaaactttgagcatcaaatatatggcaaactccccaactacatatatggagtagttttcaccggtgatggacacaaatgtgattacaaacgcccttttgccaccggtcatccatggatgtgcgaccgtttcttcatcgatcgatctcccaccggataacctcattcaaatacctatctagtttgaccttcgagaagttttacggtccttgagaaagtacctcgaggtacctaaattttacactaattattttttacctcgatgtacttaatacctgaaggtttcaagttttatacttaaaaactttgatatatactttccagtaatttctcaaggatggtaatattgtcctggctccaatcattgcacatttgcatgactagttgtgtattccatccgtcccataaaaaactcaattctaactctaaatttggatacttgcttgtcaagattcatagctagagttgatctttttttttaaacggagggtgtgtgtcactttcatggataggtatgtacatggaaattgtcaaagatagagattggttccaactctatagatgtt

SEQ ID NO: 8215 - DNA, 105 bp, Oryza sativa
ttttttttttttttttttttttttttttttttttttttttttttttttttttttttttttttttttttttttttttgtttttttttttttttttttttttttttt

SEQ ID NO: 8216 - DNA, 270 bp, Oryza sativa
ctcttgttaattaaatgtaggagctggtgaatgggattacaatttcccgcaggatttggcggattctattgggatctgggtgggtgtccggtacttttgtacttacgtttcatgttgcgctctttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccga

SEQ ID NO: 8217 - DNA, 21213 bp, Oryza sativa
tgccctatacatagccagatgagcacatttgtttgccccaaagttaggggacaccaaagttatgtgtcgccgatgcgatgaagactctgcccatccgtcctgacgaaatacagcggactgaaccagcacagatagagatgcaagccgctcaagaagttgaagtgccacccccatcacccacaggaacacaagaccacacgtccatttttcggtggcagaggcagagcatccaagaaccgaataggctgaagactctttcactggcagtagctgaatgtacactagtagcctgtccgatagttactccattagatttggatttgactgtagagaccacagtagatactgacctgtatgagactttcagatacttgatcatgaaggaagtgcagaagcatgctgtcttcatatgacctgttcagcatgttgtggcattcgtaagactgttactggaatgtcctgttcctgtcaggcctagcattgcagttggtagaactgcttgccgaggtgtcactgtgcctgtgtcacatatatactcccgtaaccatttcttttttgtatttttgtccatactttttgtcacaatggacaaagcagggcacaccagggtttcccaaaccgccggggccgaggttaccgcgccccagcggtaagcacggttaccgcggtaaccgtgaaaaaccgtgtaaaatccatcaaaaattcaaattattttttaaatttatttgaatttaaggaggttaccgcggtatttacattaccgtatccccgcggtaaggccggtaaccgcggtaaccgcgcggttaccggcggtatggtgaaccctggggcacacacgctagccaaaatttgaattttgagaacttaattttagattttctttttagagttatttcatcgtagtctatttttttttacaatggcttttaaaccgcaaacgagacataagtaaaagttttattcataaattaccttcagttgtttctgtttatctttcacgcattaatctactatgggtgggtcaaatgatgagtcaaaattcaacttttctcttacgtgaaatccacgttcttctaagggtgtgtttagttcacgtcaaaattagaagtttgaaattaaaacgatgtgacagaaaagttagaagtttgtgcgcgtaggaaagttttgatatgataaaaaagttgaaagtttgaataaaatgttgggcactaaacctgacctaagttctgtttgggaatcatggaatcgaaacgtacttaggttgcattctttttaaatgcttgaaatagctaattagtcacacgtaaaacgagaaacgtaattagcatagtataaaacaataaacttaattagcatataattaattaaatattaatatataaaaattttatgaataaatttattatattttttaaacaacatatatataaatagttttcacgtaaaatataccgtttaacagtttgaaaattatgctaccgaaaattgagtagctcagctgaaatagctgccttagggcctgttcactttgatgccattttcaaccttaccaaattttggtaaatttgccaaaaaagtgattacatttagtttgctgtcaaattttggtaactatataagaaatactgccaaaattttggcaagttgccaaaattttggtaattaccaaaatttggtaaggttttttttgcattaaagcgaacatgcccttagagcacctttaatagtatagccaactactacctcggaatcacctatagtcaatttaatagccaattcatacaatatttacctacaaacatatactacactttaatatctgatcccacctgtcatacacgtattgtgtcttggagtctgtgctgcagttggctacaaatctgtagcccgctgctctcctctctcctctcctatctccttaaaatatgtttatagctggcttatagcctgttattgtacctgctcttaggttctgttcgttgctggaggttcccaaccagaacagtgtgcacgcaaaacggagtgatccattagcgtgtgattaattaagtattagctatttttttttcaaaaatggattaatatgatttttaagcaactttcatatagaaacatttaaaaaaaacactttttagcggtttgagaagcgtgcgtgcggaaaacgaggcaaatggagctgggaacgagcacttacgaacagagagcatctgtcggtgctggaaacttcttttgaaaagaaaaaaaaaaactcaaaccgaaactaattcccaactcatcctaaccgtccgatcgtaacgccccgagatggaatccaacttgctttggggcgaagcaaacctccctcgcgactttctccctcccctccccacggacaaagaacccagctccacccagaaacaaacacggacctccggacccaccccatccaccgtacacgtgtccacatctacggcccagatccctccaaaagtggagcaggttcgggctaaggctacgcgtcgccgccgcggccgcctccacctcatcatctcccacctctcgccgtcgccgccgctgctatttagatcgaatcgaatcgaatcccacgcggcgcggagccctccacttgcgctgctgctgctgcgagagatcgatcgagaaggcgcgaaccattctcccccctctcggatcggcgggtcgaattggggcggaggagatgctggacgccttcttcaagggcgccggtggcggcggcggcgggttccgcggcgcaaagtggtgagggtttctttgaggggatcttgggtggattcgtttcttgctgaggtttcttttgatttgtttttgattcgatttgtttttttttggtgatggtgggtgtgagtagcaagacgctgctgaagctgtcgatcccgcggatcaagctgctgcggaacaggcgggagctgcagctgcggcagatgcggcgggacatcgccaagctgctcgaggccggccaggaggccaccgcgcgaatcagggtaaggaggagcggggtggattggctgggatgtggatttggggctgatttgctttctggtcgcttacttcgtggtgcaggtggagcacatcatccgggaggagaacatgatggccgcgcaggagattcttgagctcttctgcgagctcatcgccgtccgcttgcccatcatcgagacgcaaaagttcgtcatgttcttcttcacatcattccattgcagtagaattcactagtttatgtgatggtcatagtatggactgttatctgcataatctcatctagataaggccgattttccgacgacatatggcagagtttatggctgcacgaagatattcacttgcacatttctggttcagaaactcaaaagatgttgattaactgcataatgttagttcaccgctaaaacagattatggatgcttttgttattatttcctagctcattcatttggtatgatgatgcatatttggtacagactactcctaagcatcactttgtttacatccaatttcctaatacaagagagagaattttgattattacaccctctgcatgctggtatatggtagttgtctatctctgcacttgttttggtctgaattccctggatagcactaagtacttcttttaataggcattattgatttttttctagtttttttttttaaaaatcaaattcgttcttaaactgtccttctgaacgattgtgtaagacacatcagttacggcttttaggtaacaaaactgttgcaatatttcatcaattggtgggctcaaatgtagtagtgatatcattaatatgtgcatgctacaagatgaatggggctgacttgtgtttcttttcactcctccagggagtgccctatagatctcaaagaagctatatccagcatatgtttcgctgctcccagatgtgcagatctgcctgaacttatgcaagttcagatgatgtttgcaactaaatacgggaaagagtttgttgctgcagctacagagttgatgccagattgtggggtcaatcggcaggtcatataatgagttcaactgaaagaaatttaattatgttatttgatcattatgttgttactgaaatagctggaataaatattcctgcagataattgaactactttctatccgtgctcctcctgttgatgtaaagatgaagctgctgaaagagattgctgaggagcatgagattgattgggatccatcagccacagagacagaatatcttaaaccacatgaggatctattggtaaatatttacctaccagaaaccatttgttagctgcttgttttgaatcttacatgtgttctcttttgctagaatggaccaacctacttcaatggttctacacttcctcttccaaaggagaaacatgaggaaacactagctgcaagtgctgccgaacatcctgatgaagactatgagtctgatactggtttagagtcattggatttgcctgaagtcccaaaagcagccattcgcccaccttctgatactccagcaacccctgatattgacacacacgtgcaaagctcccagccaacttctcatgaattctcaaacatgccaagctcccaaccaacttctcatgaattcttaaacatgccaagctcccagccatcttctcatgaattctcaaacattaaaagctcccagacaacttctcatgaattctcaaatgttcaaacctcccagttggcttcgcatgaattctcaaacccaagtgacttggaagagaatccaacagctaatgctgctttcatgactcagccaaaaggttcagaacatattcctacaccattcgctcaaccaagtatgccagtttcacccaatgaaaagaaacattttgttccatttgcctctccaccgccatttgctgttccctctctagtggagaaaaatgagtccattccgtcaccttctccatctcctccggtgaagccaacagatccaggaatgttcaggacgattgatgaagtgaccccacctccaacagctactgattacttgttctcaaaacaaccagaacagttacactcaacctctgctgagaacattgcaaacattgacttggatgatgtactttctgctgcccagacagctgccgaaacagcagagcgagctgcatcagcagcccgtgctgctgcaaaccttgcacaactgcgcatcgcagatctgaagaagaatagtaaggcttatgagaactacagtgacagtgtccgaaaggaaagccatcctcaatccgaagtgacacagaaaccagtatttgatcaccaagattccttttccagtgacacacagggttatgtgccttctcatttgccccagaggtcgccattgatggaggatgatccgtatttctcctatcccaatctgttctcgtcaaaaccttgagggtggaaactcggtgcgacttagtttttcagcatagttcgaagtgccctgcgatgttgcatcttcagccttgtttaatcttgaatttggctgttgccgggatattctgtgtatgctgagttgatacttaaaggggggtactggcggggtactggcgtactgcagttttactaggtcactgcatggcttgttcaatgtctgtaaattgtaaatgtgtgctgcttgtaccaaatttgtgatacattttaccacctccacaagaaatttaaaaaaataaaggtgaacattgttccttgctattctggaatcttggatggtaagtataatgtctagtgttctgtatgtgccgagatgcgagatgtacctaaatgagtattctatcggtaaactctgcatttgtagtgcttgaaccaaatttttgaaagtttgctaatctttactggaaatagaaacttctcaactccgcaagctgtcattcgttaagcaattgtgtatgcctgtcacattcgcatgctttgagatgcattttgagttcttaagttaacaaatttgtgtgaacgactagatgtgcctgtgtgatttgatccactgattaaagctagtgtatacatattcttgtatgacaatgtgcaattagtacagaggttaactcttgacacctccattcctcacaacctgaaacttaggccagaatttcagtcttccgagagaaaaagatgatatggtctcatccagtaactcacaatctgaataagctgcatgtacaggatcactagtacaaagtacagagcacaaagtctgacagcttattgttctttttcaggacataacacattttgggcgtgaaggacagatgaaacagaaacaaatgcccttctcaactctgaggaatatacttatttccaggatggctataaattgggtctagctgcagagcaattccttcagagttcaatgcagggttattagtgtggagcatctgaacatgtatggttttgttgttcctgagctgtactgttctagctagttttgaggtgtttgtcaagcactgaaagtgagagttggatgaaagcaaactgactgatgatcagacaactccagcagatcactgatcagcttgttttcctccaatatctcaccttcagcaaattgacttgtagctacagcctacagataaagaaaagattttcgaagaatacgattgtgtcattcaaagtgaggattagagggaactgaatcacacccatctggaacaaaagatggatggttcagtttcttctaatatctcacattgaatggttacacgtacatactggtaaaaattcagagaggtgcagacattcagtcaaaattcagagagatgatgacattcggtcacccaacgtgaggattggagggaatcaaactagaaactctgtttatctagtttggtttcctccaatatcttagattggctgatgaatttgtttatcctgagttgcagactttacatgtagaactgaagagcacaactgaaggggcagggctgtgtgtttctacagtgtgtgctggtatcttccagcaggaggggtttcctcatttattgtttttcgggttttctcatttattgtttttcttttgacacttcttcacttgtttactatctatagcatgttctgggtttgtcccactgttttaagttatttgatttattttcatttatttctaattctaggctaggttacatatttggtgtataagccaacaacgtaaagcatcttccgttataaaattacttttcaagtagtagtaagataatcccttacaactaggtggcagtgcactaggtgaggaatagcagtgaaggctgaaccatgggatccgtgaataagaaacaagataagttgtttattattattctagtaatggtccctatgtatgtaaacaacgtgtttcaaccatttgagaaaaagttaagcatatgtttaacatgatatttttgggctcccataagggttagtactcatgctaacaacaaagcaacaggaattgagttgtggtccacgtgaatgaagaaataaagcaagttatttattattgtagaagtggtacatacgtattcaagagaagggttcaaccaatggaatgaaaacataggcttgagtgaatggtaatgtgacatttctcggctccaacaagaccttctactatccgtgctctgtcaacattctctatatatcatggaagaggaaaacattgtgtaccatagcttcccattttctcctagctgcttaggttttcgtttatgcccgttgcctctaacacctgtctcacccttgagtccatgaattcgctgtgaaaccaccacctagccaccaccctttggtccactatgggcatcccctctaagccaagggaacctcatgtccgtcctccttattagaaactcatcagagaagatggtgttgtggcttttgctcacgagcttgccaagacaactctggcagcccacacatctccgtgcgaatctaatggaaaaaagggatgtgcttgtgatagatcgagaaagtaggcgaatgtccaatagtaattcccaattctttattggtaaataccttatatgctactaaaatttttaccacgtctttttattaagccactaattaccttactgactcaggagtctaaacaccgcatatctgacattttgttctattaggaatgagcaatgtatcatagtctcaaccaatggttccaaccttcacgttggcaaaagttgttggaactaccatcaaaaccattgttcataaatcattgatacttggggggccactaccaaaaacactttccccacttttctcccccccctctctctctctctctctccatgaaaagatcgttcttccccaccccgtccttatctctctctctcgtagaaacccatctttgcgcccctagcccatcaccgccgtgcctctgcccacctcgtcctcgcctcccttctctctaaccccctcctcacttctcccccatccaaatcaacgaccaaattaaagacaacgatacctcgacgactcttctccagtcattgcttgctctttctctcccgctaatatcctctcattcctagtcggcaccgtcgaccacgtccaggccatggcttggggtgacgagctccatcgttgcatagatcgttggtggctagggttgatgagctttgtggcgacgcagggctgctcaagccgatggatgccatgtacttgctagatcaagccatggccaagtcctcctccgtggcggcaacaactgttcaccagatcaggccatggtcaagtccccctctgtggctgcaacaaccgctcgctggatctggttgactgcggtaacatttcctggttgacggtggtggcatcccttggttagtcagtccatcctcgcacatactcctttatctctctccatatttcttatttggaccacctccttttcatcggggctactcgtggcttgcagaaagcactctagccactcacaaacctcaagcatggtatctgagcctagctgaagcttgaacccacgacctgggtcactgcgttgggcatgcccttagtagtctcacgtctttgggagaaaaggaggttcaaccgctagaacagtaaaaggttacattcaagtgcctacataatgtggtcttttttacaccatttgaatgcctgcttatgttgataaccttctctttataaggacatggaaacaacaacaattttcatcaacaagaagttgtatatatcttcttctctacccatatatgaccatcttaataaaggcaagactcttccttactggttgaatatattggtggagaagaagatggtacaacttcttgttgacggggaaactattgcttcttccctcttcttataatgagaaggttgttaagagcactaggagaccaccactgatgtaagaaaagccaaagcttgtatacattagaatctaatctgtgtttctttcgtgttaggagaactttaaaaaaatctctgatcatgaagattctaaaaaaaataaaagtagcactgaaaactataatggataaatggataaaaggattttgttggaaaaataaaaaaaatatttccggacttggttcggggattttgaacccgacgtgaatcgaacacgcaaccttctgatctggagtcagacgcgctaccattgcgccacggatccggccttgttaagatgttcaatttaacattaattaagcaactaaaaccatcgaaatcagaaatacgccttgtacacgaatagtgagcaacggattttacgccttcagttcgttagacacgggttcttctacgccttcattcaacggaggcgtaatccgccgaagcctccagggtccaagccgagtagtgcaggtgcagccgccgcttaaaccctggtcccccttgtctcccaaaccctctctccttcccctcgcttccgcctccggccgccgccgccgccgccgcgaggccaccgcctgctgctgcagcggcctacccttgcgtcggtgcaagacggcgccctgcggcttcggttgcggggtgggtggtggcgttgcgggaggaggaggagggaggcgggcggggtccaagctgaggcggctcgtgaggtccatggcggtggcgccgccgctgccgccggcaccggcgcggcagctacggcggtggaaggggtcttcgccgcggccgccgccgtggctgtcctctcccttccgccgcacccgctacttgtcgcgcccggccttcgccgcgggaggaaggtagccgtactgtttatttgtgtgtattgcataagcctttttctttgctagtagttgttaagatgttccgtagtgcctaattcgtgatgaaaaataatacttcctccgtttcacaatgtaagtcattatagtatttcccacgttcatattgatgttaataaatctagataaatatatatgtctatattcattaacattaatatgaatgtgggaaatgctagaatgacttacattgtgaaacggagggagtaaatgatgttttggttaatggatgggtgtatgcatatttttcgcatgttctaatgtgatgatttatctagactgtgtaggacttcggatatgtctcctcatttgagctagtgtcgattagcattccttaatccttatatatatttttattttgttttaagagatctaagcattccttatgtagtcacattccacttcttatagccatacaattattactacagaagtacgaattgcccgataatagtaatctgccaaagagtaactaggttctactgtcactatcctgaatgccgcgcttttgccttattacttgatgatttcacattgcttgggatcttgggtgcttctgaactttgcaaatggttctcgttggcaggcaagattattctcctagttcaggcatgggggttagcaaaaccggtgctttcaggcttggattgtatggcaacttaaatgtacaaagtagtgtgcaagaatgggttgatgaaaccaagaggttatttttcctcaggaccacaaacagtgtcagaaacaacatcactaatggcactactcctctgcgggttggaaatctgcgtcatgatccctcagaagatatcaggagttcaaactatccttccttgtataatcaaagagaaagaggaccatctaattcaattgtaaatagacatgtcgatacagatttggctaagcatcgtgtgatgtatcagtcagcacatgctgtgcctgccccattcagtgttgttaataatgatatcaaaccactgaacatgcttgatggctccaaggaggaaattccttggcacgattccgttacgatggaatcttctctgcctaaagtttccaagtcagagaaaactttggtggttgataaagctatcccagacaaaaaggagcacaaacgcattacaaggaaggtgacgccaaatttcccggacaaagcttccttgtccactgagtcaaaaaatgcacggaagttgcttgctaccatctatgacaaagttttggttgtcgacaatgttgagtcagctaggagtgttgttaaattgcttactacaaagtacaaaggctttattcatgcatgtgacacggaggtatttcgccaaaccctgcttgagttctatcatcggtatatcagttttggctatgttatttaggttttccctcataattgtgagagtatcaataagaagtatatttctgataggtgatactatagtatcttgtttggtcatcaattattgctgacctcaagtgtttgttgttagattgtgcctttttttccctatgtatcttctctgaaaatgtaagttgcagagtttacaggagatgtcatgaagaatgtaaaatattaaatgctaatgctaattattggtttcttctagttacatggtttgacatgctcatagtctacttctgtggtagcaagctttgctcagaattatttacagttttattgcgtatcaagctccaaacatacattctaatttaggatagtacaatattatgcaggtggcaaatattgatgtcaaagaagagacgccagttggtcatggagaagtaatatgctttagcatctattcaggaaattctgatggggaggctgattttggaaatggcaaaacatgcatatgggtggatgtgctagatggtggaagggatgttctaatggagtttgctcctttctttgaggacccatctatcaaaaaggttcacttcgattcctcattttataagttatttatcttggagtaaatttattgtggttatcttctccctttatgtgttggatgaaatgtattagtgccatagttcctttttcctcttctattactactataattacattactccttttagattaggccttagttgcagcaaactgcactaaacaccatttcctatcactcgtaaacttatgctaaacattgaaaataactagatatagttcactattttataattatgcatttcacctgattgtcagcaccataaagttgtgggtttataaaaaaaaaatgaaaaacaaaatcctacctggctacctgctaaaccctacccaagagtgataatgtaaatggactaccttaagattgctgttttagacagacccttctgtgctctgacatactgtctttatatgttccatttttccctgcctagaaaaaattcctgtgcgttgcaacgagtgaaggcaacttgcaaataactgaacaaaattaactgtttaaactcggctgtagctaccggtccatcacctaatgaactatgaaatcatgtgggtatgatcgatgaatataattgtaacaaaaaaatgacatcatttctaacatggtgatggtgtttagttttgaagttatggagtgtatttctttcgtgcaatagcgcatgtgtgcttgcgtcgaccaacatgagtcaggtcataaaaaatcttggtatggtagtctatttgatttgtaggaggcttggagtaaatcttagttaatagtgaggacttggactacactaagggaagagccgaaagacacatggtagattgataccgtgtagaaggattgatgtgacatgtgactcattagtggtgtaccaggtccaaaaagtcatgaataaaatatttataaaaatgggaagagatggagaaaaaacatctatttttgaaaatcacaagggaacaactttcacctcagccactgttcacgcgggaactgttcatcaccagagaggtgaagagcttcatggctagcttgggacagtagacccatctgatctaagtaggccatgaattcacgatcggtcaatgcagccacagccggcccaggtagggtcagcaggaaaaagacctggctgggtggagctagaattccctcactcgtgtactgctgtactgaaaaagggcggacgtgcgctgtgtacaaagagtcaaagactaatgcggtaactgagtagaggatggacgaaaattttgagtacaaaatcatcttcaatttttataatataataggtaaagattgaatagattcacattttcgtacccgagccccatatttcctactacttcgcttagaaaaaagaaacatgttttagacattgacacagtccccaaaatacaactttgacaacttatttatgttatagtatatttgtagtatcaattgtatgaccctataaaattgtaatattatgatattctggtcacaaaaactatgttctattacaaaatgctaaaagaacccaatatagttctaatattgtggaagtattttttgagaaaaatctacaagtacaattttcatgtgtccaatctaattagttaaaagatattgataagaacatttttaaagtttgacttcaaacatgtccaaaacgagatgtttttttgtgactggagggggtagtaattttggtgacaaatatacacatatgagtttcatataccaagattaaatattttgaagatattgatggtcaaagttctgattgttcaacttaatgtatgtccaaaacggcatgttttcgtgactggagcccagagggagtatgaaattaatatgctaattagtagattcagtcttcaatcaatctttgaactgtgcagttcggaataaaactacagattggtcattacccatcaattattattatactacgtatttgtttcttcttggcttgtctgaagtgatctgttctttctcctcatcatgtaggtttggcataactatagttttgatatccatgtcattgagaactgtggaatcaaggttgctggatttcatgctgatacgatgcatcttgcacgcctgtgggattcttccaggagaactgatggtggatattcacttgaaggactaacaaatgattacagagtcatggatgctgttttaaaggacatacctaaaactgggaaggtgtcaatgaaaactatctttggccggaaaaaggttagaaaagatggatctgaagggaaaaccatatctatcgagccagtcgaaaagttacaaagggaggatagagagttgtggatttgctattcctcactagattcaatgagtacattgaagctttatgaaagcttgaaaaacaagcttgaagcaaaggaatggattttcgatgattgtcctagaggaacaatgtatgatttctacgaagagtattggcgtccctttggtgctcttcttgtaaagatggaaacagagggagtgcttgttgaccgtgcatacctttcggagattgagaaagctgctgttactgaacgagaattagcagcggataagtttcggaaatgggcatctaagcattgtcctgatgccaagtacatgaatgtgaatagtgataatcaaattcgccaacttttctttggtggcatcgaaaataggtattcctaccaccttgtataatctctttgatgtctgcttgatttgtatatactttatgccaggatatctttttgaatgcatgtcatttagaaaccactgtaaaaggatatcattaatatgtgttaaaaccaataattgcttgctgttcttatatgcattggtctatgcatggtttaaactgggtagcaattgttcttgtgtgtccaacactccaagacatgaataattcttcatatcaacaagtggtggaaaacgagggaatctatctttgcattctatttgtgctaggtatttcctttatgtaatttcaaagaaaaagtagtaactgtgagttattgcttgtgcgtatttcctgtaaaaatgattgttttctttacatttacctgcttatcattgcttatgtataattcttgtcagcttcacaatctttgtcgtagaaataagcctggtgaaacttggccacaaagtaaagcttttaaagtgccaaatgatgaaggcatagctacagagggcaagaagactccaaagtctcgcacaatcaaacttttcactattgtggaagatcttaaacttttcactacagagggcaagaagactacaaagactggctggcttaaagtccggggggaggttttatggagtttggctggtaaaatacccacagatcatatatataaaattgatgatgatggccaagagtttgatgaagatgggagcagtgtggaacttcctgagcaggatatagaagacacttccccatatggaactgcatatgaagcgtttggtggaggaaagaagggaagggaagcatgtcatgccattgctgctctatgtgaagtcttttctattgacaaattgatatccggcttcattgttccattgcaggtgagccaggatcttagtcatgctgattgaagttgccattcttaagacatcactcattgcatgtacttataaatgataatgcaaatcaatttgtgctggtgttatgtgtcctgagtcctgacagctccaatgttctttcacctcacgctcttgaaactttggggcttcagcatgcaccataaatgtggtgatttggtcagcatgcaatttttgtagggagagcatggaattcagttaaatgcattgtcagtccatcaagtttgaaatttggttctttcgattagtgctgtttgatatcttaatttgataatttaatactttgtttataccatgatcacttggtctgttttgattatatattttgaggcttaatggtgctactactgtagtcttggtgctgatccaacttgtgttgtttgtgtgagggacaactatggtgtatacttggtgcatgataccaatagtctcagctaactgcacttaacttctaagttgcacctactgtttgagtcttgactgctctttatccatgatagggagatcgtatatcatgcaaggaagggcgcattcactgttcattaaatatcaatactgaaacaggacgcttgtcagcaagaacaccaaacttacaggtatgcctcttcttttgcatttgttggaatcttgcatcagtacctcacagttcacatttgggttgtcaataagcacatgatgatggtacaccacactattgtcaagtaaaggatgaaaaatatacaaaaggtctgtatgttctttcaagacaaaagtatgttggtgtcggctccttctcactgacttttgcctggtttgagtgtgctctaccactgtgtatgtaagcagtataagactgctgttccacagagtcactatatgagtgtttttcagagtatatgcttgcattcttatttgcatcaacttgccaccgactgctacagaagggagacttggactgcttagcaactaagttgcatatgctatcaatttcgatttttcgtaaagcacaggaactaatgttaccttcaaacttcagcattcaccagttgcaatataaataaaatgctctgtagaagtatgatactccataatcattttattcattcatcaatggatatgagaatgaaaggcaaaacaaacatggcaaattggcaatataaagtaggaatgatgaaatggctcaccggcaaacttattttgtgtagccaacctcaggcatcaggacacacatttgaattattcatttagtcaataagctgtctgctatttcgggatatttgattattaccatgcttcatcatcaagggtatttggacccttgctaaatttgttattacttctgacaaatgcttcagtttttattgttagagtggtgctatatcgattatgtaaattttatttttttttaaccaagtatatcttccttgcagaatcaacctgctcttgaaaaggataggtacaagattcgccatgcttttgtcgcagctccagggaacactcttattgttgctgattatggccaagtatgcttagtggttctcaatagtaagtttttttacttcacttagcagttccacctgataaaaggtctttttttatgtagctggaactgaggatcttggcgcatcttactaattgtaaaagcatgctggaagctttcaaggctggtggtgacttccattctaggacagccatgaatatgtaccagcatgttcgtgatgctgttgaaaaaaagaaagttctgcttgaatggcatcctcaaccaggtcaagacaaacccccagtgccattattgaaggtacttgagtgtcactaacattttctgacagcagcttatctctcgaagttgtacttgatttcatttgaattacgtaagattttggtcctgtttgcttattgtgataagatggaatatgattaccttcatttgtagttcattcagtcaaattttaattattttagttattgagaaatatatctttgttgcatttttttttaaaaaaaaattgaacatgtgaattctgtgacagttgttcctagtggaaagccacataatttgtcggataacatgtctaaattacacaaaaaagtgtcggatttaatttaatcgaaagatacatggataattgataacctcacttgtcatacatttatatgttagggcctcgtgttttctttctgctttgaagaagttggcaagttgcatagagtgcttttatcaattgttattgggcatatatattccatatgtactgatttttttatatatatatctggacccctggtagaatggtataaggctatatactaataggcatggagttaaaaccaaacttgatgtttctatttctattttaggatgcttttggcgctgagaggaggaaggccaaaatgcttaatttctccattgcatatgggaagactgctgttggtctatcttgggattggaaggtatgggcttctatttgtacaggcttgtgcatgcatttatcatcttcccttgttcagtttttcttattgggtttcatcttgtttttgtacacaacatgatatcgcataggagtattattcagtaaaagttttgttacaatcagttccagagttgtagcttaattgtcctagcaggtttctgttagggaagcaagggatacactcaaactttggtatagggatagaaaggaagtttcagcttggcaaaagaagcagaaagcctttgcgcttgaaaagtgcgaagtctacactttgctcgggcgatcacgccaatttcctaatatgactcatgcgggtcctggtcaaaagggtcacgtcgagcgtgctgctataaatgcaccagtgcaggtaattcctattagttatatcacaatggttgttcttgttcagttttgggatgtctaaatcccttttgtgatacacagggcagtgcagcagatgttgctatgtgtgcaatgcttgagatagaaagaaacgctcgccttaaggagcttggttggagactcctattgcaggtttatgacaataacactcctacgtttacaaaagaaagtacttaggctggtatttgaaggcacagacgaaaggggccaccattgtttctttctttcaaagaatttggcgaagcaaagatttacatcatatttaagagctacgttttgtgttctttcagagtattttattttgatccccagaatgaatttgtacattgtcctcaaatgttatgtctgcatctgccaggtgcatgatgaagtgatcttggaagggcctacagaatctgccgaggaggccaaggccatcgttgtggagtgcatgtccaagcctttctatggaaccaacatcctcaaggttgacctagctgtcgacgccaagtacgcgaagagctggtatgctgccaagtagaatccacactcagttcttctgccctatacatagccagatgaacacatttgtctgccccaaagttaggcgacaccaaagttatgtgtcgccgatgcgatgaagactgcccatccatcctgacgaaatacagcggactgagccagcatagataagagatgcaaagccgctcaagcactcgaagtgccacccccatcacccacaggaacacaagatcacacgtccattttttcggtggcagaggcagagcatccaacgagggccgaataggctgaagactctttcactggcagtagctgaatgtacagaagtagcctgtctgatagttagatttggatttgactgtagggaccccagtagatactgacctgtatgagactttcagatacttgggcagtgtttagttcccttcaaactttaaaaaatttcgttacatcaaatgtttggacacatacatgaagcaataagggcttgttcgtttctctaacaaggaggagatgaaattttcgatactcgtgtacgtttttcaaactgttaaacggtatgttttgtgcgaaaactttctatatgaaagttgctctctaaaatgtcggattaatccatttttcaagtttgtagtaattaaaattcaattaatcatatgttattatcatcttgttttgcgtgaaacacttaatcttcatcttcaggagattcaaacactatctaaatatggatgaaaaaaaaccaattgcttagtttgcatataaattgcgagacgaatcttttgagcctaattacgtcatgatttaacaatatgatgctatagtaaacatttggtaatgacggattaattaggcttaataaattcgtctcgcagtttacaggcggaatctgtaatttgttttgtcattagtctacgtttaatacttcaaatgtaccggtttacagtttaaaaatcatgctaacagaaatcgaggagcagctaagttgaaatagttgccttagatctttcccgaaatccatgttcttctaagttctatttgggaattatggaatcaaaacgtacttggaaaaaagtttaatagtattgccaactattgggttcaatagtcaatttaatagccaattcatacaatagttacctataacatatagtacacaattaatacctggtcccacttatcatacacacgtgtatcttggaatctgtgttgtagctggctataaatctgtagcccgctgctcttctctcttcttttatctcattgacatgtgtttatagctggtttatagtctgctattataccagctcttagagcatcggtcggtgatgcaaacttctttaggaaaaaaaaactcaaaccacccatccaccgtacacgtgtccacatctacggcccagatccctccccgaagtggagcaggtgctacgtgtacaccggcagcgacgccgcctccacctcatcatcatctcccacctcccgccgtcgccgctgatgctgctactgctatttagatcgaatccccacgatgcagccttgctctcgagagccaatttcatccgggggggacatgctggacgccctcttcaagggagccggtggcggcggcggcgggttctgcggtgccaagtggtgggggtttctttggggggatcttgggtggattcgtttcttgctgaggtttttctttgggtgaataactaatttagtcccttaagtttcaccaaagactcagtttgatcctgtaagtttcattttatccatatagctgttctaagtatttagtatttgttttggcttaaaatcatcattggactcactaaatatgccatatggctatttctagtcaacaatttggttagaaaatgtcccttttgcccttaatttgtatccaactatacactagaaaaaagaaacccaaaatgaataaacaacattgcatatgtactttccgttatttcaatatgtgtatatgaaacttgagtctaatggctatcgtatacacttgcaagtatataatttattttcgttttacataaattgctatgcattatctataaaaagaattcgttgcattgcatatgtgtataagagaaaaaattgcatgcaatgaattctttttat

SEQ ID NO: 8218 - DNA, 469 bp, Oryza sativa
aattgatgacaggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgattctcttttccctattcaattacacggaagacataactgtaagtgtatctcataacattagcttataagctgtagataaattcatattttggagcctaattttaagctgggttgagccaattaagagcatctattaaagcatggctaaattatgttcccaaaatgcccatacgtctagctagccaaaagattatattttttaaatttttaaaattgaaacggactctccaaatccaactctacatatggtacagcaaagagcaatactttttccgttacacaatgtaagtca

SEQ ID NO: 8219 - DNA, 360 bp, Oryza sativa
cttggttgctcaatcattcttctttccaaacagctgcgccgcaataccagagcagatcttcagatcaacctcactctgtgctcttatcatcttagcaaggagctcagtcatctttgcacctctctccatttgctgcttgatggataacttgacaggctttggatggtcatctggattttggtcaggagggttgtcatcctcgtaggtgcttttgctttctaccaattcctttatcttctggtccaaaatagtagcaatcctgtcccggaagccatctgcatttgcagagtccgatttcagcctcacctttgcctcggaaaccaatgtttccatcctctcttctgaagaagttgcttcagg

SEQ ID NO: 8220 - DNA, 170 bp, Oryza sativa
gctcctatcaacacacattatttcataccgatgcacttgtgtgccttgagcaacaactctatgtctccgtgcctttttgattttatcttccatgtactttgtcactacgttgccaaacactatgttgttatcggccatggacggaccatttcttgtatcgatccctaaag

SEQ ID NO: 8221 - DNA, 332 bp, Oryza sativa
ggcccagcccaattacaccaccgggcccaccttgtcagcccacatcaaaccgttcgtctcgggaagccaccgcacgattggatgggattcgactcgactcaagaaaagaaaagcgggagagacccaaaggaaaaaaaaaggaggaacccctagctcgccggagcaccgccgccgtcaaggcctccggttccccggaatcccaaccgctggtcctgtgcggagttgcggggtggttcacggcgggttcgctatggccgcgtcgtcgccggcttccagcgggaaggcggccacaactcgtcggcacccgcggtcgcggtcgccaacggcaatgg

SEQ ID NO: 8222 - DNA, 429 bp, Oryza sativa
tatctctaaacttacttaaaatctaagtcacatatatgctcttatatataccggcctctaagattcaatacaacaagtcaataagtccaatattttcggtataactctctcgatctccctatattattcaacactctttatagtactcacggcgctgctaaaatcaaattgtgataggttgatctagggtttccttaataattaattaattaatctctcccacacctgcatcgcaacgcgtgaatcgatcgatctcacagcagcaagtgatctgattgcaatgcccatggagacgacgacgacgacggcgacggagtcgatgagcaagatggagacagtaagaggaacgcaccggtttacatttcacggctacagcttgtgcaagggcggcggcgccggccggtgcattcgctccggcaccttcaccgt

SEQ ID NO: 8223 - DNA, 487 bp, Oryza sativa
acgtgaagaaccagaaagtttgattgctaccagtggggagaaaaatgagaaatgcctgaatgaataccaagatctttctcgactgttcaatgatgctgctacaccccagtcgttgcttgagaaactcgaaaacggctggtgaaagaggacacactaaatatcagcatacagcaccaagttcagattcctagttttgttgaatgcttgccaaactctggtggctccacagatgctggtgagaatactaggccagaggaaaggctcttgtcaatggtgttagaaaaacatgggctgatatggtggaagaagatgaacgtcaattgggtgatgtcagctcaacgatcggtatggacactactaagcgaaatgtaagctgcaagcatgcaaatgaggagatgtatagaacaccctcattctctcaagaaagcagcgccttaaagatcaagcgtggatgatcacccacagagttcttcagcggattcatgga

SEQ ID NO: 8224 - DNA, 186 bp, Oryza sativa
tctctgaaaactatctcgtgtggccagaatcacaggaacaagatgttggatcacctataatgggcctatggccttgtaacttcatttgggaccccgggccaggtggggcccatgtggggtgcgccccaagctgctgagcatgaccctaggcacccctaggtcgtcctcccacccctatatatagct

SEQ ID NO: 8225 - DNA, 638 bp, Oryza sativa
tccctctctctcctctcccccgcggcccatcggctcctccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctcccgtttcccccgtttttccctctctctctccctcggattcgtccgatttcattcccgaaaccctcgccggcgcaatcaatggcggccgagatctccgcggccgattcctctctctccggccgctctctccccctcccggtgctatttaatccacccccgtgcctctctcctccgtttccaccgctcgccgctcgctctctccgtcggattcgtgctcgcgccgttgtcctctctctccgccgtcgccgccgagctccggttcgccgccgtcgtcgctccggacctcctcccgactcggcgccacctccgtcagcttcgccgcgtcatcgtcgacctcgtctacgcctccgtttcgcccgccgaccgtcggagcgccgtcgtcctcgtagtcccgaaccgcgccg

SEQ ID NO: 8226 - DNA, 56205 bp, Oryza sativa
ccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttatccaatcttgtggattttatgacatcagacctctagccgatgtatgctttaatcttcggatcagtgcttattctatcatatcatttctagccgactggtttctactggattatattgtttaattatattgattatcggccgattgtctttatatcattatatacattggacgtatagccgattactcgaaaccctatcgctatcggctggtatcggtatcggctagaactattccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctgtcaagcttagaggagaatccgtgctggtcactgtccaaaaaacactgagatatctctaccttgatttttttttttaccttcgaaatcgataagttttcattatctgtgtaggatgcttcagatgctgccagcagtgctatggttagtgtgttggtctagattcagaaacggtgcaacaattatgcgatgctgcaatgacgaagtagatgaaaaagaaagagttcaaatagctagcaaacttactgtgtcaagtgtttcatttgatgttttcggttccctatttggtaccattgtcatgttgtgttattttattgcagggaaattacgctgtttgtggtgatgtgaagggtattgaagaagttgaagtcccttaaggccagaacgatggttaagtgttcccatgcatctatatgtgttacctgactatcataacttgatgtgttgtattttggaaatgcagtaaggttaatctactgaatactagctcctttgctagaaagaatatttgctcccatccagcagctctcccggtaccgaatctcggcccttcatcctgcccgatcgaacggttggaaacatacggtacctccaggtacatatttttttatgagatggtaccacctgtattgagagtggtggaaaggtatttttgtcttttcgtgtagataagttttctctagctgaacaccctagtttaattccccttgtgtgtggtagcggcggcggctgcgaggtagcgagggcccgtggccgtgactttggtggcgggcgtggggtgccgactacggtgatgaggtggtggtgctgtggcggcggtggccggtgcgttagcgaccttgattgtgaggtggtggcgtcgagttgttgcggccgcggtatattaaggtggtcgtcggagtcggtaaatgacttagctgaggatttatcaataatttcacagcgcgcacagagattgttggtaatgttctttcatcattgcttgtatggcattgccaggtcaatgaaggaaaaggcttttcagataatccccatgagaaataaattagagggaattaaaagggattagttccaggtatatgaaatttcctttcgattttcttgtgaaaggaattgaccaaacaagatctaagagaaataataaattaataaaggtacttgaattgagaacattgatgcgtgagatctgtaagtatcctaatgtatcgaatgttagcaacaggggttttgtggcaaactgtcagtagcccatagttcagagtttctttttgtggtttcatgtttatttacaccctgtggttctttgactccaggggcggattcaacgtgggtgtagggggacccacaagacccatagatacccctcggaacacctcctttaattttttcaccatgactgataaactaaagatccctaaatgactggaggttaaaaaaactgtgtaattgaatccccaatattttgttcctggatcaacccctgtatgaccctccacgtgtgtgcatgtgcaacggggtacaaacaagacccataaatactgctatagtttacgcaaaaatccttaatgctgctcctacgctgagactgatataaattatatttgtattcagaaactattaagaagtggagtactccatattatcatttcacgaattatactcctggtcgcaaatactgttgttgtggataagatttaatcaaacttttgatgcttcgactgtcaatggtttatgaaatacttaatttgaaaaaaatatattttatgtatatttgttttaaaaatacagtaagtataacttatagtaccttataaacttaggctgctttcagaggtggagattcggagcttcatctccccgcacgtaaaacaaagtgattcattagcgcatgattaattaagtattagctaaataaacttgaaaacaaattaatatattttttaaaattaattttttatataattcttttaaaatctaccgtttagaatatggatagcgtatatgtgaaaaatgatggagtagaaattggtaagaggtgtgtatataaactaattcgaatataaaatttgtggtcaaaatcgcatctcaagctcagttaatgaaagtcaaacgtcgaagtctttggtgactgaatggatcactttaattggagaactattaaagaactgcattgtagcctgtaggtatcgaagcagttcgcagtttcagaaagaagcaccttttgttgcaatgtttagtattctcaatcggtttataaactggttaggtaagaagcatggatggctgaatcgtcggcgttagttagctcaatcgattggtcaagatagagaaagaacatcgacaatggatgtgctgacatttgaagaaacagcccggccaagaaaatggatacagatttacagtaacagataaagaaagtgttcgaaattttagcaaaaattgggttatctgaattgaacagctcagctgtctttctactaggagtatgcctcccaacaggctgaaggggcctcaacctttctcgctgtcttctttatagccaatacatgatcggattgaactgagtttattagaattatttgaggcccaaacaaatgaattacatattaaaaagattttttttaaaaaaatatcgtttaggagattgaaaaacatacacacgataatcaccaaatccataaagagagaaaaaaaagtaggcatctccatctccaatatttatggccttaataacattaaggtaggtctcactatttcttggttattgccacaatgcttaaaacaagagtgtatactaagatggacctcacaagtgtaaagtttattacctttatcaaccatcttagttttacatattactttattgcttgtggttgagccataagtttggagttatcctttgcatttagaggttgtttggttacctcctaaactttgccaaacattgttacacctcatgttaggcaagtttgatcaagttagctcattgtttggttcatgaccacacttgtgataagattctctttcatttctcatggtcccatatgtcatcaactcaaaagtgtatggcacacttttcttttgctagctaaagtgtggtttacattttgttggtcataacttagctaaagtgtggtacaaaagtattataaatttgtaccggttaaaaactacaggagaaacgatctttaataccggttgtagcaaccgatccagtaaatcgagactaaatatctcgatctcaagatgcatactaagacaaaaaaaaagtgagatgtggaattcgaactcaagagctctcacctcagccctgctttctttttaaactaaccctggaggcatctttagtatcggttggtaacaccaaccgagaataaagatgtttctaggtacttcgactttaactagtactaaaacatctttggtactagttcttaatctagtcgagatatttatgttttgggacttaggataaaaaatcgtttctcatatattaaagaatgaaaatgttaatatagcatccaaacaaccatttagtgtattgtggcttacctccataatgtatatggtcaccataaggtctttttataatcactttttggctgctcatatagtatatgtaaggttgtcagtccagtttttggttttcttctttcggggaaccactatatttctgtatggccattttagctgatcgtatgctttcttttatactagaattaactaggataaaaatagtttgataccctgattgggatttgacactagagtagtactactattttttatataaaataaaaatcaagggtgcatcatacattcaccaattcacgtcacagacgaaagaatgcactggccctctttaccagcaaaccaaactcatcagtgcctaccgatcgtagcaagtgaaaacaatgaaggcaactagtacaattatttcttttccaaacacttttttgccatcaacctctattgtcatatactacctccgtttttcaatagatgacgccgttgactttttatcacacgtttgaccattcgtcttattcaaaaattttacgtaattataatttattttgttatgagttgttttatcactcaaagtactttaagcatgatttatatctatacatttacataaaattttttaaataatacgaatggtcaaacatatgttcaaaagtcaacggcgtcatctattaaaaaatggagggagtatgtggaatatcaccgtatcatatcctctaacaaggtggggaaggggaggggaggggaggggagggggttcctaaaatccatatatacaattcgtgaaaaatagaaatgattccgtaccaccacaatttgaacttcataaatatcttaaattatgatctacatatgaaatgaatgtaatccccacataaagatctggatccctttcacacatttaggcagcgtgtcatctttaacccttgtacaccaaggatagaccaggtttttcacttttggtttttaccaaaattttagaattttggtgcaactgaaacttttggtaattttggaactttttgcccaaaattatttgaaaaattagcaaactttgactgaatttggataaatttttgaccaaattcacataattttggggaaaaagcaaaaattccgggcgagatatttgcttgctagaggggagcgtaattacaaaagtttcaaattttcaaaccaaaattggaatccctgggatagacatgtcaaaagcttgttagtgtagccacaaaaaccctcgagagaaagctgcaatcccgatcttggcccatcccaaaacctaaaatacatactcccgccgtcccaaaatataaacatttttttagtatagtgataaatcaattatttctaactttgaccattagtaacaaaaaaaataaaaaaaaagatcaataatgtaaaattgatgttactagatttatcattaaacaaattatcataatatgcaatactttttattttaaaacatcttactttacagatattgttggttaaagtagcatctcagaaaccgtgtcagggtctaaaaatgcttatattttgggacggagggagtagtattttgctagttttcataattgaatagttattattattattctaaaataaaaatgtataaatattggtatttaatttattttttggacttgtttaggctttggaataggtttttgggtgaaaatataggccaaagctagcctatcaggctccgtttggctaataggttatacccattgggaaatggatataatatcctggtaggatgtggtggtagtttagagcaagtataataacaaaatttcagtcagctataagcctgtacagctcagcttcgtctgacgtggtggagagaggcaagatgagagagaggggatcgggcgcttatgcaatcgccagccttggcacaggcgcctagaaaacttagccgattatcttcatcagccatttactctcatgcatgcattggatgatggtgggccctcctccatataataaaatgaatgattagtattggagtatgtgttatgcagctggttgatacaaagatctatctatttgattgcttttagatgacgtgtcattggcttatagctaactgatgactctcttattaaacttgctcttatatgaagggaaattttatcccatgtttggttggatggattggaaaaggaagtttctagaagaatgaccaaaatgccccttcaaactatgctaaatgagtaaacaaacagcacagctattatctataagttcaaatggtgagggtaattcagtaatttttcctagcagtcaatccaccctcaatcaagcaggattctatatcccactcccatccacacccaaacggtggaaatatgaaaaatggaaataacatccatttcccacactcctcatcccatttgccaaacagagcctcaaatgcaggctgcccataaacaggtctaggcaatggtatttctgtaaacattatatttagctaccgctctttacggcatgagctcatctctatctacatcaatcaatgcacttcctctataaaaatatctcttgaaataaatctagaaaaaaaatcagcatataatcttttacaactaaatttgtcccggcatttactaaacgccatatttacaccaaccaacacacaactcaagtgacacttgtaccactacctaagtgacgctggattccacccttgaatccacatatcaacagatcatattctcccatctaaatccctctttgatttaagtttactaggattctctttccttccacgagcgcaggggtggtgatggcaaacctcaacacaaaacacagcacaactattaagaacgtttacaacttaggtgatccgtagttgacaaggaggtagatgttcttgctaaaacgacatggggtaacttcgtcttgccgtgctgaagcccaggaggcatgaggagtcgaggaattgaaccaacggtgataaatcgttaaaaactagtgaaaggggaagtaaaagagaaattgaacttgtaggggtccttttacgaaagtgagttgtagggggaagggcagaaagactagtgaacttataacggttattttcccctatattgagccctgatccctagataaagacagggtttgtaactcttgcttgccattctgaatcttcatggagtccatatatatcattggaattttggcatgtccaatagcgcttgtaccaccatattagcgtagtcgatgtctttctctcttttgggtattaatctcccttgtcatagttatggaatgtcaccagatcatctcctctaaccggatccacatctgtacttgtgaataatagaaaagttttcgtaccaccacaatttgaacatcgtaaatatctcaaattatgatctacatatgaaataaatgtgatccccagttgaagatattgatccctttcgcacatttgggcagcatgccatcttcaaccacagtatgccaaggataggcatgtcgaataatgcgggttatcttgggccatgaaaagtgcgaggaaaaactacaaaactgagctagttttcatatctgaatagatattattattatttaaacaaaaaagtataaatattaatatttaatttttatttttgggcttgtttaagctatggaataggtttttgataaaaatagagacccaagctagcctatcaatgtgggttgccaataaataggtctagtcaatggtattttcgtaaatataatatttagctaccacccgttatgtcacgagctcatctacatctacatcaataaatacacttcctcctgtaaaaatatcttttgaaataaatctagaaaataattcgacatataatcttttgcatccaaatttgtcccaacatttactagacaccagatttatgccaaccaccatatacgtcgagtgacacttgtaccaccacctaagcgatgatgttttccacccttgaatccatgtattaatggaccatatcctcgcatctaaatctctcttgatttaagttttgtaggatgtcaaatcacatccctttgcacttgtggctcctggggaggggggttggggtgggcgcccaacttttggtgttaaatcaagtgttcgctttgtagtcggttctgatcctgttaggaagatttaccaaaatccatatcacacatttgtgaaaaatagaaatgattccatatcatcatttgagaatagtaaatatctcaaattatgatccatatatgaaattaatgtaatccccaccttttttttaaaaaaactaatggaatccccacttgaagttctctatcccttccacacatttgggcaatgtgtcatatttgcccatagtctgccaagggtagatatgccaaagtaggttaagccgggtcatgaaaagcccgagagaaaactacaagcccacactagttttcatatctaaatagttattatgtattatttaaacaaaaatgtataatattgatatttaatttatttttggggcttgtttaagatctagaataggttttttttggatgaaaatagagacccaagctggcctatcaatgtcggctacccataaacatatctagtcaatttagtcaatggtattctcgtaaacattatatttagttaccacccattacgtcatgagctcatccatatcacatcaatcagtgcacttccttctgtaaaaatatatcttgaaataaatattgaaaaaaatgaatatataatccttttgtgttaagatatgtctcagcatttactagatgccaaatttacaccaactagcacacaactcaagtgacacttataccaccacataagcgatgtttgtttccaccattaaatccacatatttatggaccatattctcgcatctaaatacgtcttgatttaagtttagcaagatatttaatgcacgtccctccacgcctgtggctcccggtgcccgactttggtgttaaatcagccgttcgatttgtagttggttccgatcctgtttgaaatatttcctaaaacccatagcacacatttgtgaaaaactgaaatgattccataccatcatttgagcatagtaaatatctcaaattgtgatctacatatgaaatgaatgtaatccccacttttttttttttgaaaactaatggaatccccacttgaagttctctatcccttccacagatttgggcaatgtgtcatctttgcccatagtctgccaagggtagacatgtcaaagcaggttatgctgggtcatgaaaaagctgagagaaaactacaagcccgagtttggcccagcctataacctaaaatacttatcagtttccatatttgaatggagtagttattattattgttactctaaaataaaaaaaagtatgagtattaatatttaatttacttttttggtttgttcaggctttggaataggtttttaggatgaaaatagaggcccaacctaggccggtcaaggcgggatgcccataaacagatctagtgaattgcattttcataaacattatatttagctaccaccagttatgacatgagtatcacacctatatctacatcaatcaatgcacttcctcctatataaaaaatatctctcgaaataaatctagaaaacaaatataacattataatattttgcaaccagatttgtttggtatttactagacgtcagatttacgtcaacaacaacctagctcaaatgacacttgtaccaccacctaaggtctggtgttggtttctaccattaaatccacatattaatcatcctcacatccaaatttgtaataatataactttagtaggatatcaatacgcgtccctccctccatgccgcggccgcctataaaaccaccccatagcccttcccccctcccccatcggccatccatctaccatcacattcacaaactcacaatttttcacatcaccatgttctttagttccttaggcttgagagcaaaccctacccagggtagcccaagctggatctgaactttgtgttcttcacataatcaatcacacacacatcccgaccgggtccgaatagaagtatagaacacaaagagggggctgacgctgaccggtggggcccaccggcccggcccgaccacaactcctagtgggggtcccccgtggtgcagcgcacgtgcgaggtcgttacccctctccgactccctcccccgtaaaaccaagccgcggacttctcttttttcttttcttttctctatggagatagcttccgcggccgcccaccaaatctcgcccatggtttcctcccgcgaccccggcgaggaggccagcgcgccgccgcccccgcccccgcgccgcggcgagaagcggcgaatgcgcggccgcaccccgtcgccggagccggcctccgcgccgcaggtacgtgcttacgaggccggatttgcatgtggtgttagtagggtagatcaggggggaacacgccgccttcttcgtcgtcgtacgtggtggtggattcctttttgtttgttatatatataatttttgttccgtctcgcccttcacgtttcgaggaactgttcatttggtaggcgactgttgcacgtaaggaatcgttgccgtgggtttggggttcgttcgttttgattggagaggatagaattctgtctgtatggatcgtgaatttagttctctggtatggagcatgtggggggagtttctatttgtgtgttgtttgggtgctatcaggtcggatgagtagcaatgagatgcgaatttctggatgcgatgcgtttgatttggggttcttagattaggtcgggagagcattgggtggatcgatgaataatgtgtcctagagagaaaaacttatggatcctgagaattgtaggtttaaaattgatatgcgattcggatgccgcaacagattggcatcttcccctaggtaactctgggttctgttgttcctgatttgagattaaaggaataatttcccccaacctatcatgtcgatctgtaaattggtgatgcaaatttgtgtgtgatttcagtggctgtaactaattcgatgttcttggcctattgggggaatttgggatttggcccggcgaaaaaacttggatttgcccttgtgctagtagattgacaaatccatgaattgattatatgatataaatatatgccaatctatgagaaaattctactaaatcaaatcaactttcctcaagtaatgatgttggaactaaagtccattgatcgaccaatcatgaactcaagcatatacatgcggatatgtaaacaaattttgatgaatggtatcgtgcaatattatttattttccattggtaaatgttaaattgttaacttgtaatagaaatttctctgtcctataagaacatccaatctgtggcactttcctgatgaatgaaatattcaaggtacaagctaattttgtaagactactccttttcaggatctctgcccatcaggagcttgcggggacaatgttgctggagctacaactgtaattccttgaaaagttttgattttattagctgaatgttgtcatttctattcctctacagctttattattattggctaattaatttttcatgctattttatcttacttttatgaacagacaaatggaaagtggcatccacatgaatcgtacagacctgaaattgatgatgcccctgttttcactccaacggaagaggtttgtgtacatttatcttacataactattccatgagatatgctgatagcatagtaatagttagctaatcgttctttcccttcaggagtttaaagatccaattagatatattacgagcattcgtccccaagcagaaaagtatggaatttgtcgtattgttccaccatcttcttggcgaccgccttgttctctgaaggagaagaacttctgggaatgtacagagttcaatacccgtgttcaacaagttgacaagcttcaaaaccgggaacccacaaagaaaaaatcacaacctcgagttcagaagaagaggaagaggagaaagagactgagatttgggatgactcacaggcgtcctagtgcaaatacatcagaagactgcgcagatgcagacgagaagtttggctttcaatctggctcagatttcacactagatgagtttcagaaatatgcagatgagtttaagcagcagtattttggaataaagggaagtgacgaaatccctctttctgaaattaaaaagaagaaaaaaaattggcaaccatcggtcgatgaaatagagggagaatattggcggatagttgtatgccccactgacgaagttgaggtatttagtttgctatctgtgcatcatcttcctatttaactattaatacatactgataagcatcggactctctttgactaggtggattatggtgctgatttggacacttcaatgttcagtagtggattctctaaattatcttcagattcaaatagacgagatccatatggtttatcttgttggaatttgaacaatcttccacgtattcctgggtctgtactgtcatttgaaactgaggatatatctggcgtcgtagtcccttggctttatgtagggatgtgcttctcatcattctgttgggtaagcttttattttctcattgacccatttttacaatgttatcattctgttggtaatagtataatagccgtttgcctaggtaaaagtaatctaattaacttccttgcttgttgaagaatgaacatattattgctctatgggattggaaaatgctactagcctagtgatattctaacctggcagtgctattcaatcttcttagtggattaacataagatgaatgtttacatagtaggaaaatatgtgatttttaattgattatgataattattcttggctgatatctctctcttgaactttgtagcacgtggaagatcatttcctttattctatgaattacatgcattttggtgaaccaaaagtatggtatggtgttcctggtgctgatgcagtgaagctggaagaagctatgagaaagaacttaccaagattgtttgaagaacagcctgatctcctacatgagctggtaaccatttgaaattgcatgtttgttatgtaatagaattgaccctgtgattctaacaacatgaattcactgattgcaaaataaactttttggatatattgcgaactggaaacaacttagcatccatgtactgaaattcaaaggaaaacattattttctgttccattttagtactctatttattatcattgcctagtgcctactaccagtcacaaattcttgctgacactacacagtggttcatctgagaataattatcttcctgtattgtacaaataaatatgctgcatcttcattcattttcatcctaaattttcatggtgcaggttacgcaattatctccttctgttcttaaatcagaaggagttcctgtttatcgtgttgttcagaatccaggcgagtttgttctaacgctaccgcgagcttaccattctgggttcaactgtggcttcaactgtgcggaggcagtaaatgtcgcacctgtggattggctgcctcacggacaatgtgctgttgagctctacagggagcagcggcgcaagacatccatatcacatgacaaattattactaaaaactgcaaatgaagctgtcagacagctttggatgaaccttagcgactgcaaaagtgaacaaggagtatacagatggcaggatacttgcggaaaggacggaatgctgacaagtgcaattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcttgttgcagctctagagggtgatccaactgcggtctaccagtggggacagaatgatttaggtttagtctgcccatctggttctactcagtacaagaagatggacttgggtgaaaacacggaatttccggattcagcaaccaacgtcaatcatggctgcagcttaggaagtcaagatcaatatcactatgaccccgcaaagccagcaggataccagcaagagaagggaatccagattgcttcagaaaaacatgataagaacaagatggttgtcaatcttgagtctccagcaacagctagtaatccaagcaggtcaaagtctgactgcagtggctcactgtccttgaatcattcatctgagttaccatcttcaagaattcaaacaggaaattctacgctagcttccattaccacagagaaactgtttggtgttgacattaaatccaatttagcacagtcttctgatggccaagttagtcaattggccaagccttcctcgagccaaactgatgaagtctctaagccagcaatagctaagtatacggttgagctgctagacagtggaacaatgatgattggtaaaaagtggtgcaatcagcaagctatattccccaaaggtatatacactgaacaatgcaatgattatttttgtcttctggtaatatgtacatcctccagaaatatcactaatagaaattcatctatgcaggatttaagagtcgagttacatttcatagtgtactagatccaacaaggacatgctgctacatctccgaagttcttgatgctgggcttcttggaccattgtttagggtacgcttttattataaacgcttcttgtttttctaaatttcaggatttgtctgctttccttcattgtgctcacataagctactgaattaataacaggtgactgtcgaaggtcttccagaagtttcgtttactcacacatcaccaatgcaatgttgggacagtgtaagagacagagtaaatgaagaaatagcaaaacaaataagttttggaaaatctggccttcctgattttctatcctgcaattctttgaatggacttgaaatgtttgggttcttatcctcccctataattaaggtagatttttacgatatccacagtatttatttttgtgaaacctggtcacttcaagtaactagttgaatattacacaaaaattctttgttgttcaacaggaaatcgaggctctagatccctgtcaccaatgcttggactattggttgtcaagggtttcttctgttggaactgaactcccctcggaatctgtgatggcagcaatggttaatgactccactaaccccccaataaagttgctcgggattgagattaaccggagggaatcagaacaatcaagtagcttcaataattcctgtgtgaggaggtcacacttggcaggttgctgaagaaggctagctaagctcccagaagaaccagagctaatggcgatgaaaagaagtattcagtagcagtctagtggatcagatagcagtggtatcatctggagtggcaattgccactctccaggatgagatgaacaataatgtagatacatagtgccatgaatagatcagaaatttcagataactcatcctagacagcttccctagggaaccattagaattgaaatagagccaccattggtttgcattcttctagaattgcatttcttgatattcatttcagcttgatcccaattcatttctaacttgatggcaacaagttattgtattctctaattgtttctggattagccagtttattgtgaccaatgtaacaagttgatgtttcctgtcgacataaagcttacatgtacaaaccttggcagctaccaattggaaatgaaaggaagaaaatgttttcggacttatggctatttcttctacttcaatttaaatgaattgtcttttcttaccatataaatgcgatgaatctgtcctcattcagggctaatgttgcaaggggttactttaattgattgttttgtccttaatagtgatgccaattaaatcatactcccaccgatttttaaatatgcgctgtttttggcttttagatataacacttaactaatttttatctaaaagtatttctcatggtgaatatcacataacataaatctcactatgtttaactatatctaaataagtgaaaggtgaaaccctgcatgcaaaactacagtgccacatcattaagtgattataaagcattcgattttcaattcagacattacaggccgttggatcctttaattggcaaaaatatcttcccagtccttttagaaatttattttacaaagagttcctcaaataatagtgttattcttcgccgcctgaacgacacctccccttctctcagacgcctcagtttcctcctccgcaccccatgcagtgacgcaactgtggggctatccttcctgcacctacgcagcatccgctccaccatggtccatgggcattcccaacctcctaggtttagacattgcctatagcagaatgcatatgtgctgttcaatagtccattgaaatatatgattcagccaataactaattaggaaagcaattttgtcctcaaagcatcatttgaatgaatgcagatgtgtagataaatttattcaggcacctcttgcggcaacctgataactcagttatcagtaacaatacccttcattattgcactccacataattggctttcagttgctcaccttgcttatgttggccatttaccttcattaggtttcaattaatgttatattgcgttcatatctggaaataaagaaaacaatataatgagaaagtaatcttagggcatgttcaaagctagagcccagtgcaggctctctacactccatgtcagcgaaaaaactcctatatacaaaggatggtctctttagctgactctccattaatacaggctaataaatggctaataaattcatcatgtatactagatcaaatgtaaattttagccttccataaattgtgcaaacaacaagctattatttaagcaaacagtaagctatcatataaaaaaagacaatgagcataccagcacacacatactattattttaagcaaacagtaagctaaattacattatttcgttatatagagtagttctacttttttccaagcgctgccatatatgtgcaactaaatctttcttgagttgcatatgagttggacgatcacgaatagatgaattccttcgtagtactgcagcaaagcatgggttggggttggaggagttgctcacttccggtggcagaacgattgatgctcctgggttctcattcaaatccaaaggaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaacatgccaggaaaaccacgcgacttagcaacctgtagcaatctttcaacctcatcattccttggagctcgtaagtactcttcactaaatatttcaatgactcctttagcaaatttgcccaaacactccaaagctatactaggaccaatctttaatacctcgtcaagttggtccaccggagttccatatgctagcatatgaatggcggctgtacacttctgaagtggtgaatgtcctgctctaccagtggcatccactctattagtaaaataaggagaccattcactaagggcctcctcatccgaaacctcctatggaacatctcatcggtgtagataggggactcggagaagtagttggccacaagatcctcattgccatcttcttggtttcttggtatatacggtcttgtaccactttgacgttgacaatgagatggctcagctgttatcttgtccttcatcctgataataatctgctcactatattcatctaaaaacaccaactcagcaagaaaatcatccatgttatatatatccataggatcaaagttgtcgaggttgatggcggcatcgtcgtcaaggtcgatggcagcatcatcgatgttgagttcggcgccgacgacgtcaaggtcgatgccggtatcgtcatcgagatcggtgtcatggtcgaggtcgacggcaccatcgttgtcgaggttggcgtcagagtcaatgttgatggcaccatcgtcgccgaggttggagctagcaccagtgtcgagatcagaatcgtcggcgagaccatcttctaactggttgatttcatcggaagacaccatgtgatctgacatacattcatagatacatatatctcagattgagattctgaagataaacatgcccatcaatcatatcttggaatcaatccccgcataaaaaaaaaagaacaggtagtatagtttcagtaaccttcaataaacagtcatccagaaacaaccattcagcatgcacttagtaataatatggaaatgagttgaaagtgtaaacttgcatatatggttattacatgaacgaaagaataatcttattcaccacacaccgccaagagcgtcgtcgttcacaaagcgtttcgatggcctctttctacgtttctcttccaatgccaacttacacggtaacaaagtcataaataaaaataaataaaatttataaaactacatgtactttgatgaaaactatcgcaaaagaatgcgcatcacaaaattatagattttgtgttaaatttatccgatttaaggtatcatataaaaatatagatgtagcataattttatcacaaaaccacaattgttataacttataataaataatagtgctagggatctaaactctacaatttgtagtacaaattttgtaatttagtgaaatttgtagttctttgataacttcactaaatctatagttttgtgataaatatatagttttgtgatgcaatgactaaatctgtagctttgtgattcatgtagtagttctgtgatagtttgatccacgtatatatagttttgtaaaatttactttttttaaaaaagatattttggtcaattgtgataaagtgttaagtggctcataaaacgacttgcaagtaaagtggtgctagttagatagccgttcagctccacgaagaagtgcaattttctcacaaatataaaacaagactgccatataaatggtaggagtaaattcagttaattttagaatctgccattgtaggacacaatactgcactactagcaaatagagataatagggagaccatctcttgcaacaatattctaagttatctcttattcagataaaaaacaaaatggataaaaaaggatgccagcactaatattagtcagagcacaacatcgattgtagtggggcattagatgcgtgacattttgatctgtgagggatcatttggagttgcactttcccattgctgcctttatttgcattgccattggcatcaccgacatgtggcactacctccacacctgtaaacacggcaattggttcattcccaaagtcactgttactgcggaagaacctagcgatgcagaacctgcctgagccaaggttgacaagttgtggatccttgcactccctccattcctctggcaggttgagttccttccaagggcccactagctgtggctgggagtccatggcagagaggtcagccgcagccaagcgccgggcctcagcagagaggccaaaccagaggttgaactcaggcacataatcaatcctgccatggaatggcagtgtccactttgccaacttggctccatgagtggcttgctgtctccaggcagtaggtgccgatgccattgacagataagcaaatgtgtgagccaccgccaagcacagcgtaggagctgatctctgggtctgggctgctgcagcagctgtgacagtgcttgggttcacagacaaaaggcggaggtggaagttaatggcagtgccaggcctttctgtaggaagataatgtagacttgcggtatacgaaggcctcaaactgatcgctgttgaagcccaactccggtttgggaatcctctccatgacaaagaggctgctgccatagccatcatgggaacgaactacgaagacagacaagggcatcgacttgggcttgtgaagactgggcatggttcctacctcgcacgtatctgcgttgacgaggaatgcgcggccagactgatccgtgcaaatcacctcgcggctagcaagcgggaaacagtccatcttcgattggttgttgacgttgagagctgaagctcggaagttgatgctggagaagggaagccccatactatccatcatcgtgccagctgcctgtttaaacttttgccagaattcgccaaccttctgtgtcggtggaggtgttgccggatagaataactgctggtgcatcatgtcgaagtaccatagcgatttgacatcagggttgcggttgcccacgatcagattaagaaaccgccgcgagaaatcaatcgtatcccttaaccagtggcttaacctgattcgtatccctcaccacgatactgcatatcttgaccccccccctcatttattaaaaccggtgcaatatgactccctcagcggttttggagggtggcttcgctgacatgtcatctacgcggcggtgttgacctagtctttatgccacacggtattgacgtgacgtttatatgacattagaattaaaaaaaatatgtgagactcatttgtcatttacaaaaaatgatttgtgggacccacatgtcatgatctctctttttccctctcacccctttctcttcacatgagcactgctctaaggcatgttatttatcttctctaccgaatgtcaaactacacatgcaatgcatgattatttcagctctctttgttggggggaaatagcaccaaaagtccaaaacagagatcaaatatggggaggcgaaatatcccgcaaaaaattgaccacgagacaagactaatttacctctagaacgcacgaaattgggggagaaaaactggaaacaaccgaacacgcacagcacaaaacaaccagacgctgctcgcaacaagacccaaaaaaaatgtggaaacacataggcgaatccatctacttcaccgcaaatcagcatcaaattacaaggggaatagtaaccaatcgaaaggcaaggcagaatgagcactcgcacgcgcgaacacacacatgcacacgaggacgagccaagcaatgcagtgcggcatacgagacagggggaggagaggatgaagagtgaggatgaattctaatctctcgggtggatgcccacccgtttcttgcatgtcaattaaataattatgaaaaaatttcaaaaaaattacaagatagattaatatgtaatatatcacttcacaaacatgcaagttcaaattcaaattttacaagttgtaacgaaaataacaaattaaacttttagtatacgtatatttacagtcaaatttgttatttttgttacaacttgtagaagttaaatttgaacttgcatgtttgtgaagtaatatattcatattatcctatcatgtcaattttttttaaaactttccataaccatttagatgacatgcaagaaacaggtggacattcacccgaatgcttaaaacagtttcccgatgaagagttcctcggaagcttcattcgccactccagcatttgcccgcccgccggccaccgtgcccatcgcccaccgccgccgtcgccgccactcaagccctcgcctgccgccatcggatgaaggtgaagagaaagagagaaataagggagagagaggggcatgacatgtgggcctcacaaaatattttgcataaatgccaaatgggtcacatataattttttaatctaatgtcacataagcgtcatgtcaacgccacgtggcataaagacctggtcaacattgtcacgtagacgccacgtcagcgaaaccgccctttcaaaccgctgaggaagtcaaattgcaccggttttaatagttagagggtcaaaatatctgatattgtggttgagggatatggatcagattaggacgctacttaacggagccaaagtgaacttattcccatcccgtgaaacctcctcaacccggccgttcccctagaatttgatcggcaattaagggtgtgtttggttggctgcaccgggggtggctcgcatcccgcatgcaaccagcaacgcgtttggttgcctgcatgggtgagcgagccaagatcatctgatgcaaaaacggccgctgagccaggctgcgaggaaacgcggaaatcggccgtaggtcctcagccaggcccagctcacgccgacgcggggatgagcggatgcaagtgtgggatggacgagaaaatgaacatttagccacgttcgaaacacagttttcctagaatgccatctcgaaaacgcgtttcactaaaattccaatataaagcgcgtgctcatcaccactttgccattttggcccttttgtgcattttcaaaatcatcttcgcttcttcagtggataatgagacgaaattgccctccatccttccccttccatggtggcagccttggcagcgccatcggatgagcccaccaccgctgccgacgacggcgggatggccaacagcgccgtcggatgagtccacgcccgctgccaacgagggtatctgggtgcgtggagcgacaaaaccaccggcagctgcccctgcctgccgcatccggacggcaccgacgaggcggaagcagaggtgaggtcgtcgaggaggcccccccttcgcctccgtcgccgacgaggccatggggccacctcgaaaccctagccgccatcgtcgaccacggcgaagcgacctccgggatgtcgtcgtcgaccgcggcgaggtagtcggcgtaggtggcaaggtcgagggaagagaatatgtcggaggactcgccggccacctcgttgtctgggctccccatatagcactgcttcagatgccatccatggaggaggaggaggaagacggtgagctgctcatggtggacatggagatggccgacgaggacgagctcctctccctcaatgatggcggcaaaggacatgaaaggcaattttatctcatcatccggtggaggagcgaaattgatttcgaaaatgtacaaaagggccaaaattttgcaaagtggcggtaagcacgcacttcatattagcattttagcaaaaacacgttttcggaatggcattagagtgaaaccgtgttttggaagtggctaaatgtccattttctcgggatggacaggtgcagcggcgcgcaggggtcgatgcatccagaagggagggctcgaggggcaccgtcggcggcagcggcactgccatcttctacctcctctcctcttctcctagtagttgtcggcgccgtctccatggggagcttgagctcaacgaaatccagaagaaagagagagggcaggaggagggacggagggagggctaggggcatcgtcgtcgctgccatcttcttcctcctcttctcctagtcgttgccgacatcgtctccctcatcggccaccgcttccctccttcacgagctgtgacgcaccagatccgacggccacaagcttcgacacgctagatccgggagtcttcagcttcgacggcaccggatccgcagccatgaactctgctggcggcggcaaacagcgggactcaaagggagagtggcgagcgtcatgtaggcgagcggcgacggcagttgcgagatggcgatgcatttctctcttccttttttttttcatttttttcttttctttttctatccggttgaccggataatcccgacgattaatttataatagtgtaatttaatgtttggcacaattttttgggacttcctagtttggcgaattttttcgtcattgaaatttgtgcatctccaagaagtcagtagcactgcatgtaatatgttgttatcctctccaatacgaagaaactatactcaatattccgaaaacttcatcttggacttagttaaaactcaatttaatacccatggaggtaaactcaccctccaatccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaaaaaaactagtgaacgtgcacgtgcaaagcacattgatatatacaattgaagaaaaatgcattcattgctaatgtacatctacatatactcacaaattaaagctcataatcattgataaaaataaaagtattgtaaacattgtcttggtaattcattgaataaaactaatttgttattgtattatatagcgtaacagatgtttttcagtgagaatcttattttcattactttatgccttggactacatgcaatagataatggttaagcctgtaagagttaaactattatgagaacaaacgacgatagataactcaagaaaaagtgagatagcagccatgtattatcaaaagctagtaaatgtacaaatgcagcttaaaatagatcagtgaatcagcaatggatgtttcccaattttcctctttcacggtctgctgagcattaaatagtttgatttggatatataaacatgtacatgagattttaatgagataattttccacacatttagcagggtaaactcaggccaaaataatgattgaaacaaaacttctctaaattattttctttgggcaaaaaacaaaattcggtttcaacatctcataaagctcacagaaaactgaactgcaaaatcagtactgcaaagtttaggcgcatatattgtgctgcatttgaagttactttattatgtatagatagacattattctttcatttgtaacaacatgattgggcatcattaaaatccccgtccaggaccggccggggtacacaaacgacaatgttgacattcagatccacgtcttacaaacatcataaaagtcttacataaatgcagcggaaaaacgaaagataacaggaactaagccttgacttgatctgcagcgggaacaccactccacagacatcctcgacggcacggacgaagcctactcctcggagaaaccaccatctgacacatacttgtactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaggcccaaccatccacctatagtatccaatttcattagactaaactagggtgagactaatcacggtgaatctggttgaccgcccataaccgcaggcacgactattcgaatagttttactctgatcagaggtgtacaactgtacccacaagacacagccccacgacacgtttccgtgcgccgacatgccaccacgacataccggaaagagaccgtaacaggacccttcgcataaccccctctaaccaagcacaccacacctcaggtttcactcccactcctcacaaggcagcgggcagtcccctctcgtgcctaggtgaatccggaagctgcataggccgtagcagggcccatccaaactccatcacgcccacccttgcctggatgcgtcggctaaagaaaagctacactacaagtccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacactgaagcggtgtcactaatccaacattaccattagaacctacagtctaaacattaataggatttttccccaatgtgtgctagttgaactaagcatggctaagcaattcctagtccaaagtctattcatgttataacgcaagctaacaaaggagcatggtatcaaaatagcatggctgtaacaataggtaaacatcccatagtaacattataaaacaatgcagtatttgaagaaaaacaatagaccatttgcaatataggatcaacatgttcaagtgacaggcataacttgccttgctctgcagttggaggaacctcggcgactatctcgaagtacaccggagcatcagaagaaccggaatctaagcgacatacaaagcaaacaatgcaaacaggctataagactactgaaacagagaacaaaaccatttttaatggattctacacatttttcttgatttactgagacttgaatgggcttaaacggagcacggatgaattagttatgaattttagaagattcactgtgtttattactataataaaaagtccttaaatcatttattgcgcaatatgtcccagggctgacgtcatcaaagggggggtggtgccgacaggcggggcccgcatgtcagcggctcaaggggagagaggggcgccggcaagtggggcccccgggtcagcggctcaaggctgccggtccaccggaccgacggcccagatcgcccccgaggccgatcggacgggcggcggcgacggcgtggtgcggcggcgagcctagcggcggctagcggcagccggagtagcggaagcggcggcggcgggtggaagcacggcgcgggagcgatgggaagcacgagggagttcggcgagatggggaaaaagagagagggagtggcggtggagcttaaataggggaggggaatcccggacatggccggtaggggcgggattccgccggccaacgcggggaggtggaggtggagagagaggtgggattcggaattcgaatcctggccatctcgggcgcgggcgcgagcgggaaaaagggggagtgggtgcgggaggcacggcgcatgcgcgggcgtggccgacatgacccggaggaggcggggacgttggcacagcggcggtttcggcggtggtggcgacgtggggcgggcagccggaggaaggggacgaccccgacaggtggggcccacctgtcggcgtcccggggagagagggaggggcggcttgggccggcccacaaggaggagggcgcgcgcggcggcggggtggactgggccgacggcccaagaagaggaaaaggagggaaaagaaaaagaaaaggaggaaaagattttccctgggatttaaaattgcatgtgctcaattttaattggttaaaattatttcgagagctctgaaaattccactaaaaatcttgttagcgtatttcgacatgtagaactcaagaaaaattccacatgccaattccgattattatttgcattaatttattaaggttttctcttgatttgcaccggcattttcttaggatgatttataaattcaattttaggcttaggaggagaactttagggtgtgacattgatgctcataggatgctgaggtgactaccacacaagatgaagaccatgtgtgtagttgttcttgatcacttaaagtcgtggtacgtggactgctacgtcactggtcgaagaccagttgtagttgtaccttgtcacgcccaaaaatttagcccaaatttccagactattttgtgcattaaatctctgtccaagaatcacccagggtaaacaaaacgacaagtaatatacggtttcaaacgtaaataaagcgtaaaatacttacagaagaggcacttagtcctcacacccgaaacgaaagcagcagcagcggaaaaaggcaatcctagcagggcttcagctccactccacaggcaaaactcaactggggtctgagccttggtcctctaactccgtctttagctcagaagcactacacttctgaaaagggggaataatagcaaggctgagtacaaccaccgtactcagcaagccacaccaatgatgcaggcgtgcaaggggatacaaggatggcttgaggctatttgcataaaggcaattgtaaaacatttattgagcaaaacagtaaaatagttgattaattaaggtaatattaaatctccactgatcaacgctacaccacgttgaataggcccaaccaacccacctgaactacagtgcattgagtcgatttaataagtgtgtgactaatcacgatgaatctggtcgatcgcccataaccgcgggcatggctattcgaatagttttactctggccagaggtgcacaactgtacccaaaagacacaatccaccggcatgtcaccgcgcctgtccggacacgtcaccatgtcgagtgattgtgacaagacccttcatataaccctctctgaccaagcacaccacacctcaggtttcacccccactcctcaacaggcagcgggcagtcccctctcgtgcctaggcaaatcaaaaaggcgcatagactgtcgcagggcccatccgaactccatcacgctcacccttgcctggatgcgtcagagaggaaagctatacttcaagtcagacagttacccattcccgcttgtggtaagcgcggtaagtcttccagtgcatcctgtgaaccggtccttaactgccatgggtgggactagcaaaaccatgcacccacaacccaccattaagtcgcattttagttggataattatgaccaataaaacatggtcggatgtctcgagcacgcagctcgtcatgatactaaaagttctacaagatcagccagtcgtccatcccatgatgaggacaagcggccatatattcctgaagtcgttcccacgcctcaggaatggactcatccctcgtctgctggaaacttgagatccttccagaagggcgttggttttgcccatcgggaagaattttgacaggaatgacgtagagcatttatcccaggtgttgatcgtggcacggttggcataaaaccattgtttcgctttcccaaggagggaaaacggaaacaattgcagcctgacggcgtcaggactgacacccttcattgtgaacgtgttgcagatctccaggaactgttgcagatgagcattggcatcctcattaggcttgccgcaaaacgggctagcctgcgccattgtgataaggctggacttcagatcgaaatccacgtctcccatgttgatttgcggcccagtggccacgttgttagcagagggagcagcaaattcgcggagggtcttgtcagccatagtcttgaaagttggtagcgctggtatggctggtttctatgtcggaagagtttactgcagagcgacgactcgtggcttacgctccgaaagaaagcctctggattttccttagagttttccggcaagttgaaaccagtcatgtactaccctgtttccacaataaaagtgaaaacaaccatggttagcctgcaaagtacaatgattatatagaggtaaatataaagtattagtaatggtaatctcttttataaatcttccctggcaatggtgccagaaatgcttgttggtatttcttaacgacattactagaaatttaattcccagtaatggcgcaaaaatacttctggtatattatggttacagagttcatccgcaagcgcatgaatataccattgtagcatttcacctgagagtattccaaaggtatcgtatttgtttaatcccgtgggaagattataatagagagaacagtactaataatttatatattactgtacgaataatttataaccaaagtctaagcaggggttaatataattcatagggtacaataacactaagtagaagcattcatcctcttactcgtgattatctaagctaagtggaaagaatatagaaagatcctattcctatacttctaatttacatacatattatatatacatcctagttatagtattacttagctaataccctccatccgatgccctgctggtgcttcgagaagccacccctgattgtcgagttccttacgacaatccgtcatgactatacaaccgggactaaatacggtggagtaccctccccaggaaagtatcttaggactatatacattcgtggaggaatacccatactgagctgtcaccatcagcggcccacctcgcttccacagcatataaccccaaataatgatatctagtaatctaaacactacgcttaaattaccaaatactatctaatatcatcgtcatgacatagagttatcataaatacgattattatacccacaccattgcatctcccagataagctagcatcataataaatataactcgaacatatagtaaagttggtattcatatactcggaaagtaatacaataccaaagtagtataaagaagagtattctaaataaagtacaagtcataaaaaaaagaaaaaaggaaaagctactagagccatacacgaattcttccgaagactctgaggactgaagattttattctatttctattccattatactctagaaactatgctaaacttgagagatgaaatgaacttcttgcttgaggtgtgtcttgaaatggaggatgagagggctttatatagcttgagaatgacggttatgacggttggaaaggtcagtaataccctccaaccgccataggggagcaatcctgaccgcccatccaaaccctgcatcgaacggagccacggtgggttcggctgaacccaatgattcggccaaaccatgggctgggccggcctggtccaaattcggcaggtggcctcctctctcgatcccttctgcagacttatgaattttggcccaattggtcgtgttatttctgagttcttggcccattcgttgataagtctgattctcaacatcgtccgattgattgatcacctgttttgatatcgattctcctccattttatgtcattctctacaagaggttagtaatcctagtgctagtggaatatttattattctaacacaaatatgcattgcaagtataactagttctcctttattttggtagtattgatggtcgaaactgatcgctaacgaccgtcaacattggtcctttgatccagtggtgtgaattgtgggcttgtttgctcgtggtaattccgtgttgtcagcccatctatccacaagtctgattctcgacagcatccaattgattgatcatttattttgctgtcgattctcctccatttatatgtgcttctcctggatacatgttagtagcatagtatatagtggaaggagatattttatttggaaattatgcattgtaagcatagttagtctttatatattgggtaatattaacggtcgaaactggtcaataatgaccgtcaacaataacatcgaaaaaaacgtgtaattagctataggacaccacaaagacgtgaattggctctatgacactctaaaaaaacatatgcttgaggacactgaagacattattttattcttttcaaacaaaacagagaaagagacaaaaagaaaagaccatattgccctttggctctctcggcttggctttctcctggcgccgccgccttcctcgatggtgttgtcgatggccggcagctcggcacggcacatccagagccacggtaccagtgcgtgcaggggagacgcaccacgggtgtccgctaccgcgatttcctccgtgcacaccgtcccagccacgcccaccgtcgcgcacaccaccggtggctttgacaccacagcttacctcccgccgcacgaagggggagggtcctcgacggggaaggactgctcgttgcagctgccctgtgcccgccaggccggagcagctccctcgcagtcggtgtggcccgtaaattatccgcaagagttagtatagaacaagaatatggggaaaaaatctcaatgcatgatagtgtacaacataacattatctcaatgcgagggttcgcatcaattacacaaattttatttcaaaatttccaatcacaaatctgtacactttgaatttgcaatgtgctgaaattctaaacaattgaacaatatgtaccactgtgtgatgccaagaccttccccttcctctccctctttttattcctttttagtttggcaaattttgctacagaacactactaatgtgtggttttagccctaggacactgcacaaactcacttttgggggaaaacactccataaacatgataatttgtcagtggaaaccacgccgattgaaataataattttcggttgaagaggagagagaaatcatgtgaaatgtcaaaaatgcccttgggcccacatgttagctctcttatctctcttctctctctatcacctccttccagcagctggcgagagcggccgtcgcctcttccccctctcccgccggtgcagccgtatcctcccccctctcccgccggcctcatctccccctatccggccggcctcctccccccttctcctgccgccgctccgctctactccgccagccacgacctgcccgctccgctccgccccgccccgcccgccgccgctccgctggtcatcgtgcgatcgcccgccgccaccagcgctccaccccgcctgccacgcgctcgctcgacgttgccgccactccgctcgcccgacgctgccgctccgccggccgcacgctcgtccaccgccgccgccgccccgctccactccgccagccaccgtgtgctcgcccgcctgcttcggcctctagctccgctccgccgcagccgacgctgtgctccactccgccgaccgccgtcctcgccatctcctccgccgcaacaagctcgagccccagcgaccgacgccgccccgttcccctctgggagagaagatagagagagatgagaagagagataggagatagagctgacatgtgggcccaaggacatttttgacatttcacgtgatttttctctcctttttaaccggaaattattattttaatcgtcacggtgtccactggcaaattactatattcatcgagtgttttcccctaaaagtgagtttaggtagtgtcctagggctaaaaccacacattaacaatgtcctttagcaaaatttgccttttagttttgcttccttgctccttggcttccttgcagacttgctgcttgctcttgccactgcggcctgtggtgctgcagtagcccgcagcttcgccaaattaacataaaacaaactcaatcgtgagagtgacccaggcgcccagcatgacttcgccgcgccgtcgccctcgggctcacttgaagaagagagaaagaatgagatagagagaaaagaacaaggataaggaaaaaaaaataaagggtaaaatcgtacttacacagctgtttctctctccaattccttcacatataataacataatctggcaggtgtccagcaactaattaccagttttttttgtccactagctaattatacgtttttttaattttctgtagcaaattttgtctttaatatatgcagcaggtatatgactcttggctgattttcttaaaatactcacatgtattactaccaatgtgatctaaaccacaaggcataaccgtgcgagtatttgttcactttaatatttgatactttttatcaacatattgtcagaaatttttatatatttatgttttaaccttgtcattttttttaggcttatgaacctacaacacgcatgcattaatattatattttttactgcactttatatatgatgcagggatatatattgcttcgattaaacatatgggtgcagtgaattcatgttacttttgaattattttaatttttactctgcctgtattatcaaacatatgggtgccgccggagtcgctgccgccagatcgagcaccggccgagcaccaccgccacccattggatctgggagaggggagggggttagaggaagccgctggaaccttcgaggcccggccgtcgtcgtcgtgtggcagccgctgctggatccaccgcgaccgccactttttgccgccgcccgcacccctccccgccatgggacccaccacgccgctccccgccgccagatccacctttccaccacaaccgcccttttctttcaccgcccaccgcctcctgcgactccccgggccgccagatccgccgcccatggcccgagtcgccgcagctcacgttgtcgccgcaccacgagcttcgtcgctgcacctcgttgccggatcagcttccgtgccgccgtcgccgttaccactgcaggcaccctttcaccgcctctgagaagactagagaggagaggagagggagacggccgtgtatgggaggagaggagagggaggcgactgggagaggagaccgccactgttagccgccgcccgcacccctccccaccacggctccaccgaccacgccgctccccgccgccagatccacctctccaccacgaccgcccctctccttcaccacccaccgccgcctgagactccccgggccgccagatccaccgcccgtggcctgagtcgccgcagctcgcgttgtcggcgcaccacgagcttcgtcgctgctccccatcgttggatccgcctccgcaccacgagcttcgcctatgctcctccccatcgccggatccacctccacgcgccgtcgttgttaccactgcaggctcccttcacctctgagaataccggagaggagagggagacggccgtgtatgggagaagaggagagggaggcgactgggagaggagagggatgcggtgggtggtgggttgtgggctgtgggggtttttaataacgcggttgatttttttttgcaagcgctgctctctatgagtatgtactttttgctgtcggaggtccttagtaaccgccagcgaaaatcacttaagaggtccgcttataaaaagtcccctatttttacaagcggtactcttaacccagccgccagcgaagatccattttcgctgacggtccttaacgcctcatccctcgttaaaatttcgctaacggtttccacttatggccgctagagaaaacaaaaagtcaacgccatgaaaaatcgattttgtagtagtgtatgcaaatttcatgtttgtatccgtgatttgtatccattcgtaggggaccgaacctgagagcgagaatctcgtctaggcttgtatccactaacgagaccaaatcagagggtatggtaggataacatgaaaaaaaacgtgcatagaagccactcctagacccatactcatctggccgaaccatagaaaaaagtgtgaaattatgttaaaagccatcaaataaaacgaactttcttgtctcatatgcattggttgagacgaaggacataacaaaagacgaaaaattcctttggcttgtactcatggtggtcaagcctaagaatatggcaagaagatgacttcctggttcgtactcattagccgaaccgaacaacatagcaaaagaatacatcaacgtgagcagaagaacgagaaccgagagattctttgactcgcacacaatgaacgagcctaataacgaaggaggagcatgattcccaccttaaacacctctgatcttccagcacagtggagcgaggaagcagaggctgacgagatggcataggagcaaagcggaacggcagcagtattgcctagcaacaagcagcgcttctgcaaagcctacgaacagcacctagcctctacgctaatctcccctggaacttcctttgccgctagggggttaaccagcttttcgtggtttagaacagagtcccgcgcgcatccgtgggcagatcgtgggaaatggactcaacagcatacacctttctttggcttacatgtgggtcccttcattttgactggatgaatgtggcaacgtgcgtgcaggtagtggggtgaacatgagcagaccggtcatgcccctggtcgttacatgctttcccatttattgttatcattctaatctttattactccagttagccttttaattgcctggttattgagtgagagagagcgcgtgtatcctctcactgacatctggccctctcttatttggcgcgtgcgtgtttatatatccgcatcattatagcggtctgcacgtgacatgcatttttatttcacgtcgcaaaaattaggagtataattttctcatttgttgtatgaacatatattttggttttctttttaatttattggatgaccgtagtctaaaactattttatatggtgcgtacacctttcctgaaaatatttaggacatgactattttgggtgagtgggaaaaatcctattccacggccatatgttttaggccaggtgtgtacttagcgaataatcgtagtctcaatatatttatacgatctcttttattatagcacgaatttcatatgtgcacacgaccagaaagctaagtatcagcgttcgtcggtccgatgaaaagcacgtaaaaaatatttgttcacgttttttaattttttgaacgtgtttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtgatctttttgaagagtacgttccacctcacagtgagttagagccatctctcttgatgtacccaaagagcttaatgctacatatggacattaggaagagtcttgaagttggtggagaagtttcgcttcaggattggtgtgatcattttcacaaccgcatggaggggttgccagattcctcgggcattgagtcctcacgcatttacatagccgcctttatagctttgtggctttgttgcttcgttgttgttgggttgggtccagtccttcgtcatgggggtattggtcatggcttcctggatggccctagggtggagaaattcgttggctccgcccgccctatgttctttgtactattctttgatattggctagtacaaatcttatcatcccctcccatgctgcaagtagaccatggcctatacactttttggttggatgggcatttatttgaagaagttgtatggcaacaaaaaacaacacccatatttcccttcctacagacacccttctgctgagaagccactcatggagcataccatgtttaggatcccctaattttatacactgttgacggacgttatagaccaatctcgaccgtcaatataactataataaaggagaactagctatgcttacaatgcatatttgttttagaataacatatctccacttgtacttatagtattatttgttacaggaatttagcaaataaaataaagagaaagtgaagaaacctcactcctaagcaagcttatggataaggagggtccacaaatcaggtgtaaccatcctggaaaccgcattaactgccacaaccaccaataggacccacctgtcacccaccctgccgaagctggagacctgctgggctagcccaggttcagccaaaccctggctacgtcggctcaggtcagccctccacgtggacgctccaaattgattcccaatgacggttccgggggaaaatggacaattcgcatagctacaaccatcataactgccctataacaggaggagttcattcactatctcaacacactcaagcaagctcaagatttctcttcatactttagtttagtatttttagtgctaagtggagtagaatagaatagttctcggagtcctcggagtcttcggaagagttccggtatggctctagcagcttttctactttcatctataagactttcgaaattaatgaaatattcttctttatatactttcagtactttgcttagtctgagtattgctcttgctttatgtttgcgtcggtataattgtgtgggtagcctaccagagaggtgcaatggcatgggtttagtgtccgatttatcggttgctctatatcatgtccagaggtgtagagtagtatttattaatgtaagcatggtgcttagattactaattatcactatctgggcatatatgctgcaggacagtagaggtggaccactgatgatgacagctcaatacaggtattcctccacgttagtatatattcctaagactaattcctagggagggtactctcatgtatttagccccggttggacggccatgacaggttgtcgtaaggaactcggtaacccaggatggtctctcgaaacaccaggagggcactgttagggggtattagccacatgattgtatacttctgggtgaaatgctacaatggtatatccgtgcgcttgcggattacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctgggggtgccttcttatcaaagacggtcaaaggggccgttgatctcatcgagaagatagtgtcgaacatgagctgcagtgaagaacatctccagacccatcagcatggcatgcatactgtcaaggagacaaaaatgctggccgcaaagctggacctcctgatgaagaagctagatgatcaggagaagaacaacccgtaggccgctgtcaaggcactagactcgcacatcacttgtgaggtctgcaggaacactggacactcggggaacgactgccccgacattcgtgaagaagccatgttcatggggaacaatggctatcatcccaaagaagaccaggggtggaaccagccctgcccgttctaccaaggaggcaacaacaacaacaataacggtaacttcaacaaccagccctccttaaaggtctatgtgggctccaccagaagactcatcgaggtagataagtcaaagtgtcacgtcaacgaaaccactctccaaacacagttgagagagtcaagttacaccggttttaataatttgggtttcaaagatatccggtattatggttcaaacgacatcaattgaggattggagctatatttgagggacacgaattggacttatttcctttttgttttccgtaagtggaccgagccttagaggctctgtagtaggccaggccgcgctaggagttctggcccaggcagaggagagagggtccagcgctagggttggcccccgctctcttcgccctttgcgccgcttctcctcttctcttctcttctcttctcttgggaacctccacttgtgctcgcctcctcgtcctcctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggtttccttggtacttgttgttagaacaatggaacccctagtggatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaagaatcctccgctggactgagagcattggctcttcttggagttggtgcttctggtcttttaagctttgctacaatagcttctgcagatgaagctgagcatggtttggcagcagctgaatatccctggccacatgctggcattcttagctcttatgaccatgcatcgtgagtcatcctttttcaacttccttacaaaatagagtttagctcattgcaatatttcagagtctttgcatacggtatttggttattattaattgatccatgctcttggttaccccaatccttcaaacctacttcaccaatttagtttcccagtaggatagcgaaaagaatcacaatattcttttgctcccaagaaaatccttttaaccactactaccctattcttgctgtttactcattgtcttatatttgaacacttctatgatcagtattcggcgtggacatcaagtttatacacaagtgtgtgcctcttgccattccatgtcattaatttcgtaccgagatttggttggtgtggcctacactgaagaagaaacaaaggctatggctgctgagattgaggtggttgatggtcctaatgatgagggtgaaatgttcacacgtcctggtaagttaagtgaccggttcccacaaccatatccaaatgagcaagcagcccgttttgcaaatggtggggcatacccaccagatctcagtcttatcacgaaggtaatgatattttatgccattggcgttgcattgtttaatcttccaccttcaagttgtaatttactgtttgactccgtatgttcaggcaaggcacaatggccagaactatgtgtttgctcttcttactggttaccgtgatccacctgccggtgttcaggtaaatctcattctctgtcagttataccttaggcatttgcagttgctacttgctatgtgtatcgcccttaattcctttacaaacaataaagatgctcttgcatgtggattgaatcacttgtgtcacagggatacatattttacagacacatgatattgacatcaaatttgacactgttgtaactctgtaattgcaatactggttgaacttggaggtgctcagcttcaagttgtgttgtcccattgttgtttgagtgttttctctgttaatttacaattattcagcctctcatttgttgtcagttattgtttggaattcactacataatcactatttttgttcataattatgatgttgaactctattttgaaaaaaacctaacctgtcccacgaagtgttatttttctagctgtaatttttcaagctggttgtgttctgttatttgctttctgcagtgtgcaacattagtaaactctctggttgatttgtattctagatccgtgagggtttgcattacaatccctacttccctggtggtgccatagctatgcccaagatgcttatagatggagctgttgaatatgaagatggtactcctgccactgaagcccaggtaagtttctaatgcgttgttgggctcttacagttgtgacatgttgggttagcattaagggcctaagcatgattgttgtcatcctctaccacagatgggcaaggatgtcgtttcgttcttgtcatgggcagctgaacctgagatggaagagaggaaactggtaatcagctcaacttttgtccatttatatattactttcaattcgcaatatttcctaataccaacctactctaatttgatgtagatgggagtgaaatggatcttcctactgtcacttgcacttctccaagccgcatactaccgtcgcatgaggtggtccgtcctgaagtcacgcaagctggtccttgatgttgtcaactgagggaccactgtttcttactttcattaaaatgttttgagcatttaagcggaagcatttcaaataatgagtatgatgtacattctgccactggggtttcccatgcctagaattttctgttttcttcctctgctgcaaaagcattttcttcatgggagcacttgcaatttttgtcaatgttacctgaatggtaccagcaagcttctaacagaactgctaaagttcataaatctttatgttttgaactgtgcacaattcatttgtttcgagcacgctgatgatttgggtttgcgtttttatgtgacggatgcctgttgaactgtcctgttttgtgtttttgtcaagttctgtgtcgaatctatgcgttcattcgcgctcaagctacatcggtattgtcatgcgcatatcatatgtcaagcggtaccaatttggtattttttttccggtagcttcatgtactatgctgtcagaattttgcgaacggtctaatgtaacagaagatacatctaaacgaaatttaacatttgtcacaactcacttttgcaatggctaggagtagagtttacatcgacctgaactcgtaggctctgtttggcaaatgggatgaggagtgtgggaaatggatgttatttccatttttcatatttctactgtttgggtgtggatgggagtgggatatagaatcctgcttgatttgagggtggattgactactaggaaaaattattgaattaccctcaccatttgaacttatagctaatagctgtgctgtttgtttactcatttagcatagtttgaaggggtattttagtcattcttctagaaacttccttttccaatccatccaaccaaatatgggataaaattttccttcgtataaactaccaccacatcctaccaggatattatatccatttcccaatgggtataacccattagccaaacggagccgtactcctaatgagtcactaggcatttagctcgtaagcttatatgccagctcgtgaattgtccgtttagctcaaacagttgtccgtttagctcaaacgagtcgaaccttaacgagccgatgacttgtagtttgtgcttgctttactttggaccatccaaaaacaacaatttgttttgcataaaagaaagcttaataatatcaatttatttttccaaaaaaagttaacatgaatcaatgatgtctcatctaaagttttttttttgtttgagttggagttcgtttaatttgttcttcgtgttggatttatttactagagcttgtagaaatttttttcatggatttatcttgagtttatggagatgttttttttgtcgaatttcttttaattccagtagttcactacatccacaaaatccataaacctaattcaaatacaagggtgtatcaggagtacaggttgctaactcattcatctcgcttagaagacgaggttgtttattagtgcataatccattaagtttttagctaaaatgacttgaaaaatagatcttatatatatatatatatatatatatatatatatatatatatatatatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaattgggccagaggaagtaccattttactgtaggtctttgtcgaatataatggtgcgtgtgtagtggagtggtgtttccatgtaatccggggaaaaaattccctaaaccctgtcaggccaaatctttccaacccattctattcatctggctgaacccactcttctctgtcttcctccactcatcttatgtatacttcgaggatgagcagagcacctaaaataaataaagaaatatttgccgctactaaactaaactagtatcgccaaaaatactgaaatacaaagtcacaatattaaagaaatatatggtgaggaaaaaaacactttatgcgtgaaacaaatcaaggccatatcttgccatatctggccttatccaatatgtggtttgagtatcagctcttgataaatagtctcaaatgaacatgcaaaggagctcaccgttcagcaagtaaatgtagctaggcaactcaaactaaatcaaagccattctaggtacatcaagatcttaaacacaaagggaagatgaatggcatgcgtcgtttacaggatgcacatctgattttgaatacaaggatctaacacacaggcaaagcatgcttcacacaatttagacaaaccacatgcttctgctatgttgagcttttcctagcttagcaaacaacagggaaaaaggaacggtaacttcattgcttcatgtttgcggtgggggtgtgctgtcacagcctgctggcttctttcctacagctttggcttggctgccttttgcacctctatcatcctcatcagcctcatcgtcaatcagcgatccggagcgcatcagctccttcaccttgaggaattcatcatagtgagcacgacgatgttccttgaaactcagtcttgacttttcagcttctggatctacatgaacaccaacatataactaactctccgatgataccaggaaacatcccacaggaactatcatactccataagatttcaggttccctatggtgaataacagattattgccaattcgtaatgatggtatgtatcccttgcttatgtcgtcaaaagaaagtactccgtatacaacatgattttaagatgaattgacgaaatttaccaacgaggaagcaagaactaaacatttgtctaattatataaaacagatatattaagaagagctgtgtcatctgtcatcagatgcatctaggtcaaaattgaatttgctttggaagttaatagataaattggagctagcttaacatgtggaaataaatgaatattgataatcacttctgttcttttctgaccatcaaactcaaaaaatgtgttttaatcatcatcattttgagctggtacaaagtataaccttcaagatttattttgaactggttctcagaatctctattaaatgcctcctctccagatatgtacgttgctttagtagagcaatgctaagggtttggtcggtgtatgtgctttactattacaaaatgttaacatactataacttccagtaagatttgcgctacttatccaatgacaagacttttcagacatattcatgtaatttcctgataatcaattaattaatttttccatcaaaaacaagatgtcttcaaatgcatttaactgaaacagggaaaatataagagcaaattactacatgcagggtagatatatgaaaatgggaacagggtaagaggcacaaccatcatcttgttccatggcatctgcatcatcatctgaggatgcccaaccatcatcctttggatcagttttgcttgaagaagccacaccatttaaagcagttaaaatagcttcagcattaacagtctcatccagacacttgtcaaaaggacgcgttggtgacaatgaccctataaagaaagcaatggcaagacatattcaacaacgacacagtaactaatatggtcaagtaaaggtataatgagatcagaacaggaaaacatgtaccatcatcatctaccatagggtgatatggtgtcttaggctcagttatcttctgcctaacaggtttatttgattcaatctcatacaggttgtcttcattccacttcacacgacgagagctaaagaaaaacagtaaaatcaaattaagtaaactctaaactcacgcttgtgcagtagttttttttcaactagctcttaacagtccagcatttccacaccaaaaaagaaaaaaagatggtgtatgaatctaaaactccataaagttctttaatctaaaaatcaaacagtttttcgaaacaaaattcatgtacaaatcagcagctatggtgtatctgtctaagcacttagggccttattgtaagttattccaccatggtaccatcatcaaaaggagccgtgtcacctttttcttaacacaaaactttgacaagctctgtttgccctttcatcccttcagttttaacgtatcaggttctgaaatccaagcagcataaatcaacaaactactatttctgggcctaaaagattgagacatcatacttcaacaatcatacagctctaaattctcaactttttagtatttatagtaatatttgattttactaaacaatcatacaatcatacagctctaaattctcaacattgagtcccatctaaacaatatttgaccctgaagtaatccggaatggaaccactgatttcatcatcattgaaactgctgaatctttacaccacctcatattaataactgcctggctggaaccttaacttttgtaaggtaaaaaggaaaaaaaaaggaaaaacaactgtaaacaaagaggtgctgcttaaattgattctttgtcaagggcccagggttcgtggcctttcttgactagctttgtctgtggtttcttcttagcttgaaaagatgagggggcggtctttcccccgccggccgagttttgtttttttaatttacatatcatagcaactggaaaataacaaataatcctcagaatttaccaaacatacttcttggtaacgtgttatgggcgtgggcctaaggtatgcaaaccagcagaaatatgtccaaaggtaggaagcaagaattgacctcatgattaagcttcaacacctcccagtgatggaaaataaatgaagtttgagaaatcctcactcacgaaagctgccaaagtcatataatgttaaatggcttcatcatgttttcatgcaggaaaattgatgatgcatgatgccagaaagaaaaataataacatatagttggagatatgcaaatacggtaaaaacattagaacattaaggcccaaatgtaatgtgagattttttctggtttgtgtaggaattgaactgatatctgtgaaattcctgtgttttaaattaaaacagagcccaactgtcagtggcataagtgtaagataggaaagcacgtgcaaattcccagttccaacatatcgacacgacttaatatcatctcaagttgatgatcccgaatgactcataatactaacaaagttaatcaaacaattttctgcacatgacaaatgagataatgaactggtagaatgtaacttttttagagagtgcatcatgtgcatggaggtgaatggtcttgcagtgactgaagatcaataaagatatttgagcaggacaatctataaatgcataactaacccagcttggagagagcaccacaatattttgaacatagtatgctgtcgagacaagctattggcttaaagaaaaaataaacatagtgatacatttagcagcagcgatggattaactggtgaaaatggttactgctcctaccagctcagagtgatggttccatagtagtcagaaggggtaggatacccctgccctccacacgcacaacacacacacacatcaaaattagcatgtgttaagacagacacacacaaattgtgacatgctgatgttgccacaacgttacatacactatagaaataaatattggcatcatccaacacaaattactcttctggatgtgtgtagatttcataatactgagaagaaaaaccaacaccatatatatatatatatatatatatatatatatatatatatatatatatatatatatatatatatagaccattttctggttttcatttgtctgttatgataagagaaaggttttgcagcccacaaacaatttggcctgcatcaatggatgtgggggcacactgggtaccatccccaattcttgttacaagggaaccattagtaataactatcttaggttaactgacttttcatggggtcttaatcaacaacacagctccactgctgaatcgtgtcagccatgacctagtgatcactgattttccttggtagcgatggccactagacacacttgcatcaatacgcatatattatacccaccagctacaaggatggtgcgcaatagtttgtgcgtgctcaggaatggagaatgagcaacggcgcaatgacgagcaacgaattcatttattatatagaaccacaagtagtgcgggatggcagtgtaatcaaattttctagtcaggattacgatcgcccatcgactatctctacagagagaattattgtcaactgtgttcagctttatcgcaaggcgaaaaaccacaagcggatcataaatcctttggtactcgatcataaatcccccaccctagaacgatgaatccaggtgcaggcagacctaaacctaacacgcgggggcatatggggtttaatcctccgttttccgtttctaacaaaagaaaaagctacaggctagggagagaaacgagatcaaaccaatcgaatccaatccacgccgggatgggggatctccagtccacaccgcccccgctgatgaagtggcgcggaaggaggagggatgggggagaggggggctacgagctgcgagagagaggaataggtaccttccggttcgactcgagcggcctcgccggccgcgcgcacgacggaggccttcggcgacggcggggggagggggggggggggggg

SEQ ID NO: 8227 - DNA, 2443 bp, Oryza sativa
aggtgggggtgaatgttgtttttgtcattgctaatttatccatttttttaaaaaaaattcatgacatgaaaaggtcaaacttgtaaagggtgatgaaaggcaaagacgattttgttcacctcctttaaaatacttctttttataaagaacaaacatgatcacaatacgcatccacttatttctatgaaatcatacacgcatacctcatctctattatcatataaaataactgggttggtaaattttcgtatcgaccaagttatcgtgtgtgtctcgttatcgacagatacattatctactactaaaaaaataattagccgtgaatacttgctcctttctcattagtcacaagagttgaggcgtacaatatagtctttgacattgaataaatattttgatcattaatttcttcctaatataggtacaaaacaagaagcattaacaattaaaagtatttttaaatattaatataatgatattatgtcatacatgaaaatagatagggttaattagatacatgccattaaaaatttgctggtttcgaaatatactattactatttacgtatttgtaacaatgctactgctatttgtaatctcaattgcgtatttgtaacgatgccactgctacttatttgtaatttcaattgcgtatttgtaacgatgccactgctacttatttataatctcagtggtgttaatacccacaaagatacgtattttgcatgtattagacgaaaatgcactcatcttttacctctctctcttccctcgtcttctacctctctcttcccgctgctttcttgctccaccgccgctccgttctctccgctctctccgccgccgtcctcgccgttgtgagccacaacttgctctatcgctgccgccatcgccctcgctgctcgagcccatccgattccagcagtcgctgccctagtcgcctcagccgccgccgtcgcaaccgcaacactgcactccgtgtgcccgtcgccgtcgcaggcgtcccccagtagcagcagcagcagcaggcggcggccgcggcgagggtgcggagccccgaggtggagatagcgctgcagtcgcaggcgtccccctaacggcagtgtgaggtggagggagatgcagatgtcgcgtgcaaaataacgctggagagggaggagacaatgactgcaacactcgtatgtttatcgctggttgtgcttgctgctgccgacactaagcatcactggtctctgagctgtggaagaaagaaggggagaaaaaggaagaaggaaacaagggcaatttggtccacattttttcgtaaatgcatctaagaggtaggtagtggcatatcttgaatatgtgtaaattatatggcatggattcaaatatgtaaatgctcgtggcatattttaaaaccggaatatttttaatggcacggatctaattaacccagcagagtaatcctagttgatcttgtaatacaagcaaacaaaaatgataatattttagctggcttgatcccatgtctgatgtttacaagcctattttcatctgtttatttctcttggcacagtgaattcattcgttaggagcaccgtctaccgccataggtaaagagaaataatattgcttttgagatctcacatgtctcactggacgttttgacgagccagtccgtggcagagttgatactacgtacaatccattaattcaagttattagggttttaacatattagatgagcttttaggagtccagaacatgaagatgatacacccggtggtcaatctttgttatttcagactgtcaactgcgaaaaatgactttggcttttttcttttctcgaaaaacacatgagacgttatattttattaagaaaaaaaataaaatatgattagctgtcaaacttcttttgcctgatcttcaacttcccatgatgaccctattaggtgaatggagcaattagcttagtactaccatgaaagagttgctgtctagaaacgttgcaatgttcgtgaaaggtattatggcatcttcatgaaaattacatatgaaacaaggtgaaaggtcgcgtgatttgctattaagtgcaaaatttcaatcagtttcaggcggtcacaagtgcttatcatgttacaaggtcctttgaaactcccagcctgaatgactgagacaggttatcaacaggaaatctacgagtatttgattcgaattcgagcatatcaaattcgcacaatgagaaaccaggtgatccattctccagtctaattgctaaattgacataccatgcagcgccggattcgctcagatctcactgatgtactctaaaagagattcgacctcttgcctcagggcagcaactttctgctgctgggcagcaatcctgttttccacatcttgccctcgcaacttcttttcaaagctgtcaaccacagtggaatgccttgtcatgagcttat

SEQ ID NO: 8228 - DNA, 11265 bp, Oryza sativa
ttggccatatctggtaagactgagaggatgactgcagggatgtcaacaatggcttcaactcttttgctaattccttaaactgtgcatcagctgtcttacgagccactttgcatgatttaacatctcctgacctagataactcgtgtaatgaggtctccagtttatcatgagctgctagacattggttgaagatagcctggatttgctggatgatgctctgtacctgtacaaaaagtatgaaatagattgtagaggttagtctgcagaaagtaagaggtctccacaagtttaaagcattcttcaattccagaaacactacaattaatgttgatccagcttaactgcttaaaccaatgatacgcaattattatcttcttaactttgaagtttggattgaagatttaggacttttcaagtaacatttttttccctgtcaattatgaagctcgcttttaacacagcatggactgctctttacctccagattcatttagagcttgttttgcagattctattccaccgtggttaagacccttcacttgtaacttgtccatttttggaccaaagctctcaaaagccaatctttaacagaaaggacagcgttctcacatgattctgatagtaaacttgtcacttatccaactaaaagttctcacatgattctgatagtaaacttgtcacttatccaactaaaattactagtaaacaagccctccccaaaatttaaggccaccattcaaccctgcacattttgagacctttcctagctatttgctcaggccctaatatgtttgtcatctgatatttactagttcaagtttttatcattgcattttttttctcccataaaaataacaccgctacatagtactccgtatgagctagcaaaccaattcgaattatgattcataagtttatttcactgtaattagtgctcatcctaaacatagcagcagtatagtaacaaactgtagttcactagaagaaaggttatggcaagatagatttaaacatttctcgtaaatcatcaaaatccaatcctcaaaggggagatttgactaaaacgaccatacctcatcccactgcacctttgccagataagaaggagaattcttagagattgacatgtcagtgcgcatgtaaacaatacaggccatgaagaggagaaagaagccagttatcaacatcatcggttctctgagtagagagatgttgttgaacctgtagtaaacctgcatattgtagggcattaacaccataagtttgctatggttcacataaaacaccatgagatagacaactcacagaaagtattcatggtgcagtaagccttttgcatagcagattttacatactcttcagtcaggttaataatttagcaacgctcaacttttcatggaggggtaaaattagttgcacaacaaattaagtctgaagacaaacctggaaatatagattatgctctggaataacatcaagcttctccaagacaaccactggccttccagaaatatcaaggtgtgaatacttcacctgcaccacaaatcattgtcattacaacaaaagaacaggatcagctagttgttcagaatatatgtgtgtgtgtgtgtgtgtgtatcatccaacaagaagtcacctcttgctcttgctttgttggaaatggaactgaaatatcaatatcctttgaaccttcaggcagaacaacctgttcaaaaagaaaggtttttatgcagggagggaaattaatatgtaacatcacgttcatggaaatatgtgcaaatgtatttcttattgattatctaaccatgacatgtcatctacatttttttagaaacataaaataaaaataactaagtgaaggacaatacaccagaagatagccaagacaacaaaagggtatgttagttgcaggttcccagcaataaatgaagatctaatttcaatatcaaagaaataggcaacacaaggaattatgtttggtgtctaaaattctatatcagtgcaattaagaacaaaacatggaacacaagggtaaaaaatgaaagattttaccgtgcgtgccagatgggtacaggagaacataccttcacaataagcttttctatgagaatctcctccactggagaaccaaatgtgatattgaggaatctctttccatcagaattgaaaacaaagtcttgaagaggtaaaccataaccaatggtaaaggtcgtttgccaaccaccaaacaaaggaaaccttggctcaacttcaagttgagtctgcaataggataaatattcagcatatgcactcacttttgcaattttgctgggaatattatagccttgaaactgagataataaaaagcaagtgtaccttcttggaatcactccataaatgtgatgttgaaatgttaccaatctcatctctgtagtatatagaatgtgcccttggaggcagtctagcaataagatgcctaaaagatgagacccctcttatgtacggtctagattggtaatcaatcctgcaaatttgaacacatcagttatctctggacaaattttttctatccagctaaaggtgagctatttaaagcacaagttagaagggagaagaacctggaaaattcacccttgagtttggcaccaccatgagcaatgttgtaatgttctgtaatctgtacattcccccagtgagatatctctatctcccttataacttcctttgcaactgcaaaagggttattgttctcatagtgcacaaccataggggagtaggaaaacggtggaagatcttcatatggtccatattttagttctgactctgcaagttttgtgtttgggtactttgtgtaggactcaactcttccaccaggcaatctgatactaagtgtctgtaccttaacagggtaaggtgacagatactgagcactgtcctgatagacaacaagctgcgattcagcttgtgtgatttcttcggggaatggctggacagagtgcgtaaatacggtcaggacatctaagtgaagagtcttccccttctccaaaggtttggataaagatgccgaaaagaatgtaagttctgggggcactccagaaggctgaacaacttcaatcggaaggaccatacttggacctttcaccttttcctcagtaccaaatgctcttatagctgctaagttctttgcttggacattgggaaacgccagtagaaattgagaaacagcctccggtccactattctcaacctaaaaaaaacagagattacaacaaaagcaaaacctcagcatatcacatgtgcatagacaaaaccccatatattactctatctactagtgaggactggcatcagacaaagtgtaattcaaaaagagttactcggagattttagaattggtggtggcactgacaaacacagaacccctattgccagttaaaccccaacttcaaatcaaccagaagagagcttgcaacccaaagaatctgcaggccaaatcatgcgagacatggaattgaacatcccaaattgagacgttaagaatttggagcactcgtgagcacacgtcgaggcgatgaacctatacaggacaccattaatgatgaaacgctaactccatccatgatccatccacacattacagcgctcttatcatattatcagcgatgaagagacaaacatctacccatccagaactatatcacgatgaaatgagaagctcccttaacagatcggacgaacgaaccggggaacggctgaatctccccccaactagacaaacaaaattcgagagaacacagcaacaacaaccgcgtgtaccttgagcgaagtgaggacacgaacgatgtgcgaagtcaggtcaacctgcaaaaaagaaaaggaagggcaaagaggcctcagatccgggggcagaaggcgcggcgtgctcgtcggaagatctggagggcgcgcagagagacaaagaagcgaggcgggagctcaccttccgatccgccctggtgacgacgagatcggcccgtccggtgggggtggaggcggcggctacgaggaggaggagaagggcggcgacgcggcggaacgccggtggcgtcgccatgttggggggcggagggcagatcggtgggtctctcgcggcgagatcgagtgaagaagcgctttaaacccttcctctcctcggctcctcgtctcatcgtggaggagaggagaccgggcggctagacctgctcgtgggccgcccgacccggcagcccaatcgggccgggcaggctcggtcctgcgttttgcagcgcggtaagtctacattgagtccctcaaattagctgcaataccagatatattgaccccccaactgtcgaaaccggagcaaaatgactctctcggtggttctgagggtggatttcgatgacatggatcattgacatagtctaatcagctgagccagcgtgtgggacctacatgtcctcctctctctctctctcctccttcacacacctctccggtgggtaggcgatggtgcgggcaccaacgatatcctgcgtagtcaaatatggcgggctcctcctccaccaccacatctccccatcgtagcagggccatgccgccgtggttgagctcctcctcttccctcgagaggaggcgcaagcaacgacgaggtgccgtagcatgtcgctgtccctgtccttcgcgcgggccgctgcgagccccgagcccacctccattcacaaggttagcccatgtcgtggtggcaatggccagggaaaagcatcaacgtcgctgggctgacggctgaacacatctatcgcgaggaagagcaacgaggcgagcagcaacaccagcgtgatgtcctctcacggtagaatgccggaagagcgagtagccacacagtgcttcggcttgcttggcagcaacgacattgggggaggagaagagagttatgtgtcggtggacgcgatccctgtcatgtgccgggctgcccacatgacgagaggaactgtgccgagggagatgtagggggagaaaggggagggaggagaaagagatatggatgcaggggggtgggtgggtcttcctcaccgtctgaccagtcaagggcgacgaggccactgccttcgtccatggccgttgggttagggcacaccaccgtcaagccgtagttccaccagttccaccaccacgacctcaccacgagccaccaacaccccatgccgacgtcactttgtccttgtcacatgagccgtgtgcttcgtcggctgccaagtagccgccgcctactcctccctggtcaatggtgacgggggtccaccggcaacctcaaggaacaattcgcacaggaggagataaaggtgtgggtgatgacgtcgccgcaacgaggcatcatgttagccgcgcagatggtcacgttgtccaacctctgcgatgaggacgaggatgagggcgagggcggtggtcgccgcaagctggctcctaccgcggtggtgttggggaggcgcctcacgctactggacgtcatccggcgtcgactagcctccgtggaggtcgaggacaaagatacagagcgaaggaagggagcaccacccacggtggcgtcggcgaggtgacatcgtgatgtgaccatggctaccacggatgcaaccattgctcacatcatggatgaacaaaaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccgggccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctatgtcgtgcacgagaggaggaaggtgaattaccatatctgattttggaagtagtcaagattgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcaaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaaatcaagaaaaaaagtgaaaaaaaaggcagaaaggtgcaaaaaaaaaagccgcacaaaaaaaaaacagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagctgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgcgctcaacatcgacatcttcgtcgagacatgaggagggatcaacatgaccattatgaggtaagtgatgatgttctaggtaagatcaaatctgcactgccttatttcgagggagactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgtttccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccaccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactatgggctatgttcagtttgatgatttttgtgagctcgataatttcaaggagaaattatttgctaagtctgatttgccatatccaaccaatgttctatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgccttgttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaagatgttgcatcacctataatgggcctatgggcttgtaacttcatttgggaccccggcccaggtggggcccatgtggggtgtgccccaagctggtggagcatgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatcgtctccggcaccgcgagatggccaccgcagaagctaaggctgaagacccggggcagaggaagggagtgcggcgcccacaactgcgtcaaatggataggtcggagaggaagtgggaagagagaaaagatatagtgaaagaaggacgctgactcgtgggtcccacatgatgacttagcaaggtggactaggtcaacatgccacgtcagcgaaaaccaccctcaaaaccaccgagggagtaattttgcactggttttactagtttagggttaagatatctggtattgcggttgagggatacgaatcggattgtagggtctatttggcacaactctagctccagctccacctctcgtggaattggagcatagccaaatagtttcagctccatctaaaatgggagtggagcttggtgagcgctctcacaaaataaagtagaaaggtggagttgagtttagactgttccacaactctactccagacccaaccctcggaattaaatttaggagttggagctctaccaaacgggtctgtacttatatttgagggagtcaaagtggcttattccttttgcagccccaaaaatgtgaaaaataatcattgaaagaaaactagcatggtccatggtagcccaaggtttggcatcatcatcagagaaggcaatctacatcacaatatttgcataattagtggatataccccacacgttgcaaccgggaatttagaaatattttaaagaaaacttgtatttttttaaatcgtgtactcgtaatacctaaatggacaatattttgagctctatatagtaattgatgtgaaattgcaattttataagtgtgagagtaatctaatgattattacttttctaggtgtcatggttcaatgtacattaagccttatggcaataaacgtagtggattttaaattcatatggcatatgaatggttgacatcaaagcataggatggatccaaaggctggtattttctatgtgatgttatggcatatgaatgattaagataaaagcataagatggatccaaaggacaatattttatagatgatgtggctcaatgattgttaagcttttggctccaactatgtagtgtaggatatataaattcacgattcctagttgacaaggaaattcaatttccacgtacataaccaattttgaatgaaaaaccacggttgggggacctcagaattgtcctcaggcagaggtgaaaacgatgttgggggaccttgaagttgcacaactagagcacgggaggggagggggggggg

SEQ ID NO: 8229 - DNA, 5788 bp, Oryza sativa
gactgctagcctagcaggcatgggggaggtgcggtcacatatgcagcgtgaaggagcttaggaggggttggagacagcatggcggcacttagtgcctgctagggagtgcgcgaatgatggcatgtataccagcctagcaggatgacaatgagtggctactctatggttttagggtctcaacttagtggcataggggacggaaggagggggatgagggtgggaaagttgcgcgagagaggggctcaatggtgagattgcatacttttttttgcacttaccctgttgttcatttcaatgccatctttgttgacctttgccaccgaatgatgctatgatatatgacaagatatgatctctaagtggcctttcgaatttaccacatgaaccctctctccatatctctaaaatgttgactcgttagggtgtagtggatgatctaaatcctcaaaactaataaatgctttagttataaaactggatgtatcaattagagaacaatttatcctaaagaattaactttcaatatcaaaatgtttttttctctattaaatgcttgtgtaatctcctagaactttctttggccaaaatcctgacccattttaacaaacaaggccttctgcatctaaaaacatccatagataaccaaggaagtttttatgtacccttatagaagaagctgcttcctccgtttcacaatgtaagtcattctagcatttcccacatttatatgatgttaatgaatttagatagatatatatgtctagattcattaacatcaatattaatatatgacatgctagaatgacttacattgtgaaacggatggagtatataaggaccatttgtactcagcaaactctgtggtccttgcctcatgagatgcacatctttaactctcctaaaaaggaatttcagtttcagactttttggagctttttttggattgtctttattaacctcttttcacttcctagtactccaagaccaaaatcattataaacaatatcttcactttcctaacctctctaccagaaccattgcctacctaagatagagaatgggggagaaagaggcaatgctagtggtgtgtgctaatgatgtagggttggtgtacgatatcaacacatgcgagaagattatgtacatacacgactgcgttgctcctccatgtggcctcgcttttgttgatggatttctcctcgctgcatctcggacagacaaggatcaaccaatctttggaagtgctatatatttctgggctccaagtaaggtaagatttcttttgtgccatgtgatgtcttttcttcgtctttgccctttcaggtaatggattttgtgtagatcataggttggattgtgtggatcatggcagcaaattagtctagagaatgaattaattgcagaagtctagggctagaactggtccttgtgttatgattggttccaaattaaattatatgtttcattaaaaaataagatggattattttatcaaaatactctaaattttgttagatttttcgctatcatgtttgtaggagtagatctaattcgatcagtattgacaaattcaggtttttcaattttagtcagaaatcatatgccagattatggtagaagggattcaagatgtaaaagtgtgattgtgattagggtgagtcataattcagatgaaaaatgtgatccaagttacaagctaaagtgataatacattaagtccatttttcctatttcatctaaaactcggcatgtattgctcatttctagatgtaatagttttttccctcaatcaaccgaggacatagaatcaactaactacaacttctcattacccttacacaacaagtacatacggtgtatgtttctatatggtaaatgactaaaactgattgattgtaaaatattataagtgttcaaatttaacatttagtgagaaaacaaaatggcattacttttaacatatgggcccaaaggattaatgctcaaacatgtgagtgtttatatctcaattgtgaataccctatagtcctattctagttccatttaaattattttccttttacagatcaaggaagtgcaaaaaagttatgtagctgaagccattgggcccattgcttgctcaaaagatggggtgtatttggttggtggtgctagttctggacatacttatatttgggaggtaaataaaaaaagcttcctctttctacaaaagaattaaactattcatacgtcgttctattctagctagattatgatcaacaagagactcttgatgcattgttcgatgtttgaattgggtatctttatattaaaggaaggtatggcttgtgtttatgtttgttttttaaatcattctacgaattatcctgtcatcactaatgcataattatatccaacaataccaagttcttttattttgatttatgaaagacatggggatttcctatttaaacatgtatgaatctaccgaacttcaactggtttgtccagcaatacaaaatgaagtttgaactaataaaagatcacatcaaaacttatgccccgccaattctttcatttataacctagtattcgttatgctccatctttatcgaaaggatgccactctgatcataaattggtttgctccatttgttaatgttagtttggatgatctaaataaggaggtccatgtaactgacaaacggaagaaagtttatgaccatggaagttaattatacttctagtcactatgttaacttccctaaaaataacattacgagttcatttagcgataaattggtagtgctgttccagcaaggatatataatgatttgtatttatatttgagaagcagttcagttgaatatcccttttgtatgtatgatttcgcttgaacaaaatcttaatgcctctcattctacttcacttgacatactaacattttttaacctactgcattgtttgatattctacttggatggttagtgtatgagtgtattttttaatccaaattcataaataaagattgcatcttctatgggaaatattcttgcaaatagtacaaatatctaaaaagagtaataatttaaattttgcatcacacacttagtgacaaatttctgtttaatatgaactctttttcacttgaaaatattgttcatttcagatagcaagtggagcattattgaaaagatggtgcggacataaaaatgctataagttgtttagccttctctcaagatagttcgtttctcatctctggatctatagaagggatggtttatacttggtcaatggtcaggtactctctacaagctagaagtcggtgaagcattttttttaggaaaaaaatacaaattactccctgaaatatcgtggtcgactgaattaccccctgaactcgaaaaccagatatcgctcaccttgaacttttaataccggacaaaacaccccctccccccgagcactgttgcaagcggtttaggattcaaatagcacacgtggcagtccagacatcagttttttttaaaaaaaaattgctagggcccactcgttggaatccccgcccacatctctcttctccatccccttctgaagtgggtggtggctagggagagggcgtgacgcggcgctcttctccctcctcttctgtagcgcgtggcatggggggagatgggcgacacaacatggcgacgcgaccggcagcggcaagtaggcggaagcgaaggcggcgcgtgccggcagcggcaagtaggcggaggcgagggcggtgcggaggacgcagtggcggtcagagtactgctaaaatctctcctttctctttcttccctctggtgcggcggtgagattgggtagggcgcgtcgcgacggggctagaggggtagagccgccaacgagggcgtcgggaaggagaggtgattggagcggaggcggcgatgacagagcggtggagcacgcggtggaggaggagcaaccgggcgctgggacgacggggatgggctgcaaactcgtcgccatagcctgccgtctccaatgtcctcgtcggcgcccaccgcccgcctcgccctccccaccgcacgtgtcgcgccttccccgatgaggactttgtcagggttatggatatcacatacccaatagtaatcgactaagctcggcagggcccaccacataccatgttttatatggaatcatacctcgtatatagaaggagttccggataaggaaggacaaaaagagttctatatgtaaactacaaggactactcggatcgtatctatgtttatctccctagttctacttggacaagggggcatctatgggtataaatacaagcccccctaggaggagaggagacagaagccaaacgccacaaaaccacaagaccaacatatacacacgctaacacacgccgccagatctcgacatcagagattagccagacataccccatccggtgcctacggaggccggtaagagggatctagcatcatctctgatctcaacgggttcatattcgaggaggaagactgccctgttgtcgactacgagttggttatctagccgccaagttgacgacaactagataggttatcccaaatattgtacttgtgtgattcagatgaataagagcaacactggcttcggtcaacaggatgtagggctattacctatcagatgaggggcccgaacctgtataaaaatccatgtctccatctcttttacctcaatctcgcatatacctggtaccaacgatccccataccatccaaataccctagtcgcgatcttaaacatcgacagactcatcgctcgccgcctgcctgagttgagagagagagagagaggcctcaccgccgtctccagggaagggagcagcaacagcgctggcgcttttgcctcagcgccggccaatgacgtcgacggcgatggcgacgatgaaccactcgtctactcttctccctactgctcacccgcgaccctgagctgcctcacccgtgaccccgagttgccttagcctcgccaccgaccgcgctgccctcgcctctatggtcgtcagcctttgcagccgccccgccgcgtcacccctctcccccgccatggctgccttctcgcgtaagtccggcgcgagccactactcccctaaccacaggaggacgaggcctggtgagcctgatgggccggccaccgccggcacgccacatcctcggcctctgcctcgaggagactcgcaaccgctggcgcgccgctagtcctcgatcacgctaccttcgtttccgcggtcgccggcctttgcagccaaccaactgcgtcgggccagccaccgtcggcgcatgcgctgctcgttctcagcggcgagtgagcgacatcagagagagatagagaggtgagaggggatagagaggagagagactatgatatgtgagccccaccattttttaaaggcaaattttgctacaggacactgcttatgtgtggttttaaccctaggacactgcccaaactcacttttgggggaaaacactctataaacatagtaatttgccagtggacaccgccccaattaaaataataatatctggtagaagaggagagaaaagtcacatgaaatatcaaaaatacccttcggcccacatgtcagcactcatatctctcttcttttaatctctccctatcttcctccttccagcgtcactctgataggcgagccggcgtgcaaaggaccggcataggcgcgacgaccttgcgggtggcacggcgaggcgaggcggcgagcgccagtggggtgcggcggctgtgcgggcggcgcggt

SEQ ID NO: 8230 - DNA, 14654 bp, Oryza sativa
gcacagccgccgcaccccgctggcgctcgccacctcgcctcaccgtgccacccgcaagcccgtcgcacccgtgccggtcctccgcacgccggcttgcctctcagagtgacgctggaaggaggaagatagggagaaattaaaagaagagagatatgagtgctgacatgtgggccgaagggtatttttgacattgacatttcatgtgatttctctctcctcttcaactggatattattattttaatcggcgcggtgtccactagcaaattaccatgtttatggagtgtttttccccaaatgtgagtttgagcagtgtcctagggctaaaaccacacataagtagtattctgtagcaaaatttgccttttttaaataaaaagttgctgactggactgccacgttggactgaaaccactctgatattgagtaggggggtgttttgtccggtattgaaagtttagggtgagcgatatctggttttcgagttcggggggggggggtaattcggtcgaccgtgatagttcagggggtaatttgtacttttttccttttttttaaggcccaacttttcctgttgggtttactagtattacacgcaggcttgccattcaagcataggaacaaagcaccactacattattcagcactaccagaaccaactagcaagaataggtagctaaagaactacttatgacaaagagaaaaatgtcccaaatagcttgcaaactatataagcgcaacagtctcatcaggcttgtagactatttgagacaatccttggattgcaattagagttgtttatttttttattggaaatagcgagggaggccctcacggcatctttttcttttattcaagcatgaaatttgctcccttggaaagtcgaatgaaggacctagaggtgctacttgagcactgtaaccactaggctacaacccctttagcaagttgtctcatattcagttgatccagcaaggtgtcaatgtcttcttgctcttcccactccattagtcactatcactacacaaactattttttacagtttgatttggaaaggagtcttacaggcaagtattaaaacatatagatcatttttaatgaatcgcattaaatgtcaatgcaatcacattagtccaataggatgatttcacctataagctacctctgatagaaccaacttgtttgtggactcattcaagcataagataaaacccatcatatataagccgtaaagggatgttgggtaaatatatttttatcaatgtttcccaaccaccatgagacaaatgaccacatttcctagaactgagccgttgtctcactatctccaccattgaaatcatctatgcaacaattttccagaattcaatgatatgtatgtaggtagttgaaaataagctatttttacaattcatcatgtcaacaattgtcctctgttcttctcactccactccagagacaaagtctcactcttctaactatatattatcataccaaacatctcataaaagcagtacaataaatatttgagaaatgctccacttcagaaaaagaacagtgttaccagtatattattgttggtatgtaaggctatttgatatcagatgaggcaccaaaccctccaatgggaataatcaactaagcatttaagttaacacatgctttcaataacttatttttcgctctgcatatgaactttgcagtttatttcaagcagaggaacctcgacccattgaaggtacagagatatatcccaacttttataatgtaaagaaaaatgagcacaaggcgtcaataactggcattttaacaatgctaaggggtcaatgtcccattctaataacgagctcactcgatggcaattgcaaggtttaatgcacctcagatgaaatatgttgtttccttttgcagtgatcaatattgcaactttatcagcatcctatatgaaacttgaaatctagttcctgtactaaatgtcatgtacactttcataatttagcaatgaattatgactactgatactccatacattcaaaatatattattcagtaaaatggttctatatgcttagttctttttaaacaatataacttacatatatgtttgttgtctatacaatttactattctgatgtttgcttcaatattataactagatctcatatcaacacaaaactcgatgtggtcaatttcttgtgcttgtgttattcattgcttaaaatatattcaataatagtaccaagaccaaaatgcaacagaacacttactcgtaagatttagcacactttttgaatgtagatttgagcatgatttccattggcgctgatgacaactttgagaatatgttatttttctaggttacggatctattgtctgggttactacttcacaccatttcactctccagttcagttactacaatcgcagttgatcctttggaacaatttctactttgtggggctggtgatacttgtatatatgtcactgtgttgaatggaattgggacaaaaaaatccagtttaacatgttttgaggataattgtcaaattctttcaggacacaagtaagttatagttgaattaagagcattgattggtaaattttgcaaatgttactcaagacatatcaataattgacaataagatgcaatgtactattttaaatttagaacaaatattattatcaagaatataaaacaattatagggatttccaaaatgagaacacatttctttatcacaattaaaacttcaaggaaacggtgaacataacctctaaactttgggtaaaattccgtgtagcaccctaaacataacccccagactttggaataccattcatattatttcctaaagtgattttggatagtggctttgtgcatttggaagcttaaatgagcctgttacacatcatcagtcattggtcatcaatatataagatatagttatgccatactagtattatatcgacattcatttgtaagttcaagaaaaaagtgggtaagaatgaaagatttaggtggagatattagcatatatgtccaatgtcatgcagtcatcgaacgtatatgcaaattacataaaaaccagtttgcaaaatgcactagtatttggtttatgtatgatattatatagttcggagggttgggtatttggtttaatagattagggtgccaaatggactttcaatcaaagtttcttttgggcggggtgtatttagacttttctaaacttatgtaatatgtatctatacgttagtttctattgtatccaatcttgagtattagtttctttctatgttagattatgattgttccgaagtattttttaacaaagttctataaagtcttgatatctaatctatacctaacattgataaaatatttgattttaagtgttgtgaatccataaaataattagcacaacataaaactaattggctgattccaacttgtcaacagcgctccaattactgcattagcattttgttctaaaggagtaaggttggtttctgcatcaaaggattgcactatccttgtttgggacacaagagcatggcaagttattaataaaatagaaaacaaaataggtaagtctacatgaagtccattttagttcacttttgttctttctgaaagggtcacttttgttctttctgaaagggtcacttttgttctttccgaaaggttcttattttaacattttttttgccttgtcatttcgtcactaggtgggcatataacaaatttgctagtctttccaaagcgagcgatctcaactgttcatcaagaaagaaatttccgtcccatcaagttccctaaattagagaagatatgcaaaccaacaaatgaaacaatggcatttttggtgccatctcaattctccaaagatgtcaattctagcatagtatctttcaatagttccaaccttctggctgagcaactcttggatttagaggtaagacttatatgtattattattatttctgaaaagaaaattatatattattatattaaaaattatgtaaagaaaactaattggaacactttctactatttactaggaaaagagaacccttgaagcagtagagatgattattggagtgaacattcaagaccgggtgaagaaccaaaccatggcaaaggaattgactaatatgaatatgctactgcagggacaagtatttgatgtgatggatgttggtgcagatgaggattaagtcattgatttgttgtttcatccagtatgtgcaatgaacataataaaatgattgaacatatatcacagtagaaagtgacataatccaagtatcagaaagtgcaatcttgaaaatcatatttatctgaaatgagaatgcctattttatttggtattgttgtcctgttaatttatctttgagataattcgttgtatgctgcctattattttattattctattacttatatacaacttctaagtttagctcgatatcatgtatgccaatatgtttggctcttcattccatgcatacctttttgttcctatatcattggttgttctagaatgaccatatcacccctcatttttttctccaatacgtaggagatctgtttatcatcatattaacaagaaaaaaagatgggctataaccctgagtacagaaccaaacacgcacataatgagttctaggaaccatacatgttgcaaaccaaaccacaacacaagaccacaaccacaaaccaaaccatgatgtgagactaaccacccggctcttgagtagtcaataatgatagcccctgaggccggcaaaaaccacagttgtgcttcctccttggcaagcaaaagagcatcggccaatttaggagcagtcccataaaaaacacaatggtttcgatgcatccaaagcgtccaagaaccaagaatgactatagaattcaggccatattgcaccctcaatgattatgctccaccacttattttgatcgtcattcaagggggaccaaagaatttaggacaaacctctacaggagggagtaccaaaactgtttcatgaagacacaatttgtgagaaagtgatcaatagtttcatcatcttggtcgcaatgagcgcaaaggtctggatgtggcagaccttgtcaggcaagacaatctggtgtctagcagtgattatgcacgacaagtcacatgaaaaaagtgacactttccagatgcccatgttttccaaatacgttcccatggcctgaaaatttagtggcaccttggaaggaggaatcataagcatccttagctgaatattgtcttaaattcatagtgcaaaaaactggactggtgagtgacctggatgaccccttggtgcacctgtccgacggtctgaccggtggactgccggttgaaccgtggttcaatagcaaatatatacggtgtgtatttgctctaaaatacaagggaacaagggtaggatggctagagccaagcgctctcaatgcacaaacccagtttcgagtccctataccacaagccttcctatgatttttgtaaaaaaaaacagccgcgtgggcctgaaggcaatggactgggccttaatttggcccatttatctccttttacccggttgtaccaaagtggtttagtgcccggtatagtctaaacctagtccgttcagttgttttttatccgggtcgaatgcatgtccggtctttaagctcaaccgaaccatggagatctaaacccggtcggttcagtcgtttctattcgggttgaatgcatgtccggtctttaggctcaaccgaaaattggagacctttggttctagttttttcctgttgaaccaccagcccggtccgtttttttccactatgcctaaagttgagaatctccatctatgaatatccttcatgccgagctataaaacaatcttagaaagcatatctcatagattgagaaaatccgctaggactccaccagaaatagcaccttgaatgtcctggatccaaccatgatctatcattattgcccctcactagaaacccaaagaaagaagacaccctacctagatcaaaaccacacctagtaactattttctaattttgaaaaaaagaatcaagaggatgaaattgccaaaaatacataaattttgtaattttggtattttctcactggattttaaatttaaaatcattttcttgtcccattaaccgctttggcattgacccaatgaattacaaacagatttgaagggaagcaccgaagcaatagtaatttgtaaaatgatttattatcaacaataaaaataaaagtgcccaaccaaaatagctagaagttaattttcttgactaaaaaaggggtcaaaacaggccttttcatacttattagatagatcaggcatctaagggaaaaaaaccagaactcagaggtatatagagaattgagcaaaactcgcaggtctagaagggattagtaaaaaactgcaatacgtaaaagtaatttctctttgccttttgtgatgtatttggtcttgcttatgatcttcacccaatttttatatacgagcataggcttgagaaaactatgccttaataacattttaaaagaataacatgtcgattagatgtaatttattctgcaaacaaataatgaagggataaataacatggatcatgttttacaataatataaaatatcacaaacaaagatgtgtagactccagttggcgaggctttggctactccaaattaatcttgacgattattatgaaaataataaatggtgtatataattatggaaataataaatgatgtgtactcaccaattttggagtagcaatgaaaattgtgaagagcttcaactcaatgggtgggaaagataacttggatggagtcccgtagagtttcttaaagggaagttctatgcaagttataatcgtattgtaacttgaattatcaactccaatgccacataataatatatcatcaattagttattgaaaacgcatgagaattgtgcttcatttcatgaagaagaaaagaaatatttccaagagagagaaccaaagtatccctcaagcgacaccaaaaaagaaaagggcgtcacaacatgacacaccactaaaacaacctctaaggccccgttcgttctctccgattagagggacatttccggtgcacatgaaatgagaaaactcattagcacataattaattaagtattaattattataaaattaaaaaatggatttattcgatttttttaaataacttttacgtagaaactttttgccaaaaacacaacatttaacagtttgaaaaacgtgctaacggaaaacgaggaagtcaaagtttgaagttgagaaaaagaactaggcctaagaggaattagccatcaagaggtagcgacctacaaaaagctcgtggagctttggccccagcaatactccaaagggtactttcctgcttgaacaaccaccaaaatattaggtgtaccccattaaaaacacggtcgttatgacccttccaaatttcccaagccactaggataaacaaggaattcaagcccttcttttccttcttagggactttttgaatggccttaaaccactagttagagaaacgagttgaagaggactgaggtgctgcagctgccattccaatcttctcaaggatcaaaaaccaaagttgtcgggagaaaacacatttgacgaagagatgttaaatggtttcttcttcctgatcacaaagtgtgcatgcctcccggtgttgcaacccgaacttggcaaggcggtcggaagttcaacctcggttatttactgccaaccaagtgaagaatttgcatggtaggggcccaacttttccatattctgctccaaggtgcaaatctgatggatcccacaaagtatcataagcatatttacttgtgtaagatcccgacccagagattttctaaacatactgctccaacacattgcaaaattaacccatccaccaagtcacataattgtaaatattcataaatgaccagcatagtgaggcttcctagtatatcatctacccatcttctatttataagagcttgcactattgttctctgctttcttttatctttttagggatcataagaaagaggttaggagcccattctacaatttttttccctttcagccagcagtcagtccaaaacttggtctcctcccattaccatctgtagtaaccaccacaacgttgaaaagtgcgtgaacactttgcggcacttgaatgggcagcccagcccatggccttgtgggatcggtcttttggagccatagccatcacattcttagagcccatcctagtttctcttagttatgaagtccaagaccaccatattggagtagtcggtaaacatgatcccaaagactaggcagctaccatcactagcagtctagcattttcctgtcctttccaaaggaaacaccttcgccttttactctttatcaatagctttgatcacccattttggaagatccattaccatcatgagataaatatgaaccgccgtgaggaccaccttgaccataatcagcctactagctatattcatgagggaggcttcccaccccgggagattatcagccactttatcaaccaaagtcaacccggggtttatcatcgattagttattgtaagtaatatcttgatggtgctgtcagtctgaacatagcccaattaagcttacatgattgtgtacattgttagaacaacaaatttcattgcagttggggcttagttggatgtggatgtataaatgttgaatgtaatttctgatttgaatgaaacaatacattttgttcaggaccatggatcctcaatatattgacagataaattgctgccatgtacatgtttaagtactaatagacaaatccattcaaattgcttgctgtgtatgttaactcatgctgtgagaggtcagtccaaatgtaacgtaggaaggaagaattaagtgcccaatatgggaggagattttgggggcctaaggtggccagcaatagacaaatgtgtggattgggctgacccagattgtggatgatgtttttgatagtgtccttatccagataatgtttctagtagtgtcctggcttggacgctatccactctagcatccttcttattttactaaatttctgccttcaattacttgttatttaattaaggatctgttgattattgcaaataaaagaaaccgatttatctagtgttgggagttttttttccattgttctttcaaacagattccactgaacagatataccttgctaggatgaaaatggtcatgaaaattcccaaccgaccgagcgtcatttccatataagtcatactatttctgattgtttccctttttagaaatatataaatgttgaatttttgttctcatttctttcagcgttgtattgatgttgacacggaacagttaaattgataaatatggtgaattactaactgaccgaacatcatttctgaaaagatgctaacgattttgaccttttcggaatattttcatcccatccatgaatagttgacaaaatttgcttcagtgctagtgctggataaagtgatgtgttcagcaattgttttcctgggcaacattcttggatctccttgatagagttccaaattagcagatgtgtgtctctgttccaaaatttttcttccactgctgatcgcttgcttcatctctgctcccccccccccccgcccctccctccgttaaatcccctgttgttgtatacacttgtaccttcttttggttattattttttttctggttatctgattattatacccatctagtggctgatctctagggtttatgctattgcaaagtttccttttgcaagtggcagattagtatattcaagtatgcatatgtataaattgttaatacttgctgccttgatctgctagctagttgttggttgctagttgttgttggaaccaaatccaatagctatgggagtgtacaagttgtgtgaactactagaagagtgagacttatgagattgatgagaatcctgccttcactaaggcgacatcgcacatttatatgcttagcatatgtacatgggaaattacatcattgatcatgtaggcctcctacaagtaggcccgggaacttcctactaacaagtgggctccacctaggagcacacccgtaactacaccagacaccgtcgtgggtggcccaagatgttgcatgggccgacatggatcctgtggatcctaggatctgatgtgtcatgatgggcccaagtcgcaaggatctcgattgcctcccgctgcacgacttgttggagcaaagcggctagtaggtgggcattaactgcctcctgccttgtctcgtctttaatggctcatgagctgaagcctcggagtagtcttgatcatgccccccaactggagcacggggttatgcgcgccagtggaaactggctagaggcctccgcttcttcgaaatggaggggtggggccccatctagcgcaaaagggagggatctttcctatggagacaggctccagaaatccttcagagtgacactggagcccatccctcaactgttgctcatcaatttgtatattttatcaaagtgcaatcttttatgcagcaaccacgataacaactattgctgctgcccctgaggctgggtatgatcctataactgatccaaaacggaggccaccatgcaaaggatccagcttggaagtgcggctatttgatagtaattagaaacacaaacttagtgacatgtaatctttgtggggaggtgacaaatggaggggctacaaggctgaagcagcatctagcaggtggctatggagatgttttagtttgtatcaaaattgataaagaactcatgaaacaaatgcaaaatcggttgcacaagaacaaaaaaaaaacggacaatattcttgggagatgaagaaagggggaaatgtggaggttctgctagatcaaaatgtaacaacatccttttctatgccagttgtaccttctagtgggataacagcaaaaagaagaagagcaacctacgatttcagagctccaatagtaaaaaaaaaaagccaagccaaaggagaccaagacaattattgctacggttagaaaaacagttgaaaagattgtagatggacgcgctttgattggttccaaagcaccatggagagtacaaagagaaaggaagataagcattatgtggatatgcaaggggtattgtggttctatgagtatggcataccattcaatgttgcaacctcaaggcagtttgagattgcttgtgaggccaccgcataatatggttcgggttacaagcctatgagtaagcacatgttaagggagaccttgatttaggactatgtccaagacacaagtaaaataaaggtaaaataaaggttgatcatgagctacagagctagcatggaagtagtatggctccacctttatgtcagatcgatggatagataggaggggcgccacctaattaacttgcatgctgtgggcttacttcttggagtcttttgatgcatcaagtgaaacactgtagacccccgattttggaaatcggaaatcttctgtgtttatccgtaccaatccctggatcagtagttggtacacacattcatagttggatcacaacatatcacgaatgaattcaggctaagagagttaatacttacattagggccaggtaggctaacaactatcagagagcaacagcggaagacaaaataatataagggcccggttaacatgccacaggcagtcgactggggaacgagacctagaacaagaccgcactccgatcatcttgttggatacgcaagcgtactaacaagggcttctcttcagcgctctcctaaaagatatataaatagcaagggtgagtaccaaccgtactcagcaaaccaccacaacagcaatgcatatgataaagggtattcaaggaatggcttcaggttcttttgcgtaaagctgcgttttgcaaatatttttacaagcctaagacctagcatagactgatcaaattttagttccagtgttcacattaaacaacgacggttctgtccaccatccattgtgatcccaatgatagcttcccgccattgaatcctcatggttttctgaggacgtccaccttccctcctctcaggaagtggctccaacagcataaaaatcatcatgcaatatcccatcccacacaagttaagaatttagagtctagccaagtgtaatacacgtcccggtgctcaataaccgcgagcacggctattcgaatagatttggtttactcacactgcagtggatgtacactttacccgcactctgcgactgcccaacacatgagcctcatcccaacacatgagacgcgtcacgacaaagcttttcgataacctcgcattggcagtatccgctccatgaactttacatcctcatgcactctaggcatacacggtttctagcagtgagaggagttctagcgcacccgggaagggaagactcacacatgcattaagttataattatgtttagattctcacatggcagtcctaccgatggcgacaccactgtagacacccgcctcgtggtcctaccaatggctgccccaccgtagagcccctgcctcacacatcaagaaaccactatgcatggatactgcctccgctcagctatctactccgctaggtctatacccatacgagaagtgcggttgtacggggttcgtttcatgcttaacttcatgactcggtccttaattgaccggggacggtactagccttttccagataccacccaaatcctccgtccgccccagtcaaaaacagttgtttagtttcatttctcctttcacaaatcatgtcatcaatatcatggcaatgtggtgctcatgtctccacatgccgtatctcaattatcttcccaaaggtaattgcccaagcatatagcatttgataaatatgagtatgcatgattctagaatagcatttctaagcaattgtcataattgactagggacttatacgtaatcatggttacaaggatcttaagggtaaacaataatcaaggcatggcataatcacaagtaggatgttcatcattgcatgcaattttatttgtaaacaaaacaatttcgcaattgggatcaacatgttcaaggaatagtgatgacttgcctgctcagaatagtccttattcttgatacaatcttgatcaaccttcacctcctggaagttgcagacgttgcctcacgactgaccgatacacaatttctataatacgcgagaaaaaccaatattcaagcaacaatcaaatatgcacaaacaaaatatatttgttgaggtcgaacctagggttgctcatattattcgcgcttgctaatggattctaatcaaggtaagagctaaagtttcttagtctttctgttgtcatggtggtttagtctagctaatggctatggaaggattatggttacacatgcatctatctaaataaaatggtcatatcctagagattatgttgtcagatggatttaggatcaatcaaataattacagtgaatcatttgtattattattttattgatggaagctttactttgattatcaacatattttacttgtcacaataaattagaaaaggttaataattatccgtgctttgtatgttagagttgtttaggttaatcatattatggttacaaattatcccatcacataattttacaatgaataatcctaatttacaattgaactataattatatgagatcaagatttataactagtatttatctaatattcctgtttatcatatagtccctctaatttaatatatgcaacaagcaaattaatactataccgtatagctataatgggatgtacagtataggtgtgtgcacaatatcttaatattgaatcatttatttgaatagttgctatttactacgagctacacagtacatgtgattttaagtggatttatgagtgagttaccgtctatacaacttaagggtcgatttccaacctaaacatatactactgtacaggaaatgccgttaattaatttcgtgcgggtgattttagtcacactagctctgttattatctctcataaacaagttaaagactcatctacgtgtgttcaacttttagtcacaaagtatgaggctaaacattatttatacaattcggacgtcatgagtataattatatattgacatatattaataattgacactagtatttcctatgctttaattaatttgaaacaatgctgctaattagtttacataggttttacagtgagaaagcatgttaaggacaattatttgacatctactttatagtacaatatcaattttatttattagcacatttttaagttgactattatgcatcatcgtggtattaattatttaataattataaatatattttattaaatagtgaactatataccattggaaagcttatgaatttagatgaatttaggttcaagattcactcaaatcggagctaaaatgaataagttatgctagtgtaaagattcaaatttgaattaacccgagaaattgtaaaaagctactgttcataaatgatttatttttaatccgaaatctaatccataaccctagtgaccgacaggtgggacccagggttc

SEQ ID NO: 8231 - DNA, 2741 bp, Oryza sativa
ggtgtgggtggagaaggggagggggccggggttttatagagcgcgggggaggggttggatgaccctaacggcgacgcgacgggcggcgcgtggggctcgaggcgcgacggcgatggcgcgcggcgtgacagcagtgacgagacgcgacggcgacggcacgcggcgcggcagcggcgacgcgacgggacggcacgcggcgcggcagcgggagtggcgacgcggcgcggcatcggcggcacggggctcgaagcggcgaggggacgggcgcgcggcaacgggacgggcgacgcgacggcgagacggggctcgaggcgacggcggcatgcgcggcgcggcagcgggatggcgacggcgacggcgcggcagcggcggcgcgcagctcagagcggcgacgcgacgggcgggcggcgcggcgcggggctcggcgcgatggtgacaggcgacgcgacggcgacgtggcgcggcagcggcgcgggcgcgaggtggcgatgggaccgcgcgtggcgatgggatgcgacggcgacggcgcgcgccgatgggacgcgatggcgacggtggcgcggcacgacagcggcgacggcgacggcgacgcggggcgcaagtcagcggcgcggcagggctaggcgcggcgcggcagggcaggggcagggctaggcgcgccagtggggaggaagagggctaaggtggctaggaactccatcaaacacctcatgtgcaatgaatagtgctatccctaattaaaccctattttagcctatctcctatacaattttaatcctacaaactctaattttacttagttaaatgttaactaaatttaagtactaaatcctcatgaaaatttatccaaattattaccacccatatttatttatttatcgcacaaatgaattctttttagattaatttgggttattgaccctaaggtgaacttatatatttttgaagactttggggtaatattgaatttaatataacgacttgtcatgattaatacattagcagattggtcgagtttagttgtatagcaatatattttgcacggatgggttcaatctatttattctataaatagtaaattgagactcggcacaatattaatctaattgtttaattaaaaactcacataattttataaagcttaatttaattatatgaccattattttatatgagtgactttatcaagtgttcaaatattaatgtatatatattcccatgaaattctcatttgttaataggatcattatagtagtaatcatcatttcatgtggatttataatacttcatgtgagattggatccaaatacattagatttaatcttacaatcccattagttaaacatgacatcgagctatcaacatggttcgaatatttaatatttgatctatgatttataatagaaattaatattttatttggcttgctttcttgcgcactaatgtatatatttattgttcaggtgtacgccattaatttgattctccattgttacaatttatatttggcaagcaatgacaaccataacacccagcatgatgcaaaagtttttaaaaagttcgaaattttagtgatttttattattaggaattttcagaatgttacaaacacataatgcaactatgttagctaatttgctagagaagagaattgagatcattggaaaggagaaggttgttcaagttgtcactgataatggtgctaatacatgcaacagataagcttctaatggagagaattctcacattgtataggactccttgtgctgcacattgtttggatcttatgttgaaggacatagggaaactgaaggaatttaaaaaccccattgcccgtgctaagcgtgtcaccactttcatttatagacatgggaggcttcttagtgcaatgagggagaagacaagtggaaagaatcttttaagaccagctgtcactcgatttgccacaacttatcttactttgaagagcaattatagccaaagagatgaattgagaagcctatttgtgagtgaacaatggactgggatcaaattagcaaaaacaaaggcaataatataagtgactggcattgttctctctaagaaattttggtcctctattgaagattgtatcagagcttcaaccccattacttattgtgctaagagttgttgatggcgatgagaagcccgctatgctagaggtttcaagactaatgacgcatgccaaagagaagatccaattgagcttttttatccagttgtgagctcaattggagaacatttggatttgcgagtcagtttatctgtagttttgctttaaatttctttactatatcagcaagttatttatccttttttttcttcccttgttatttgcatccctgcagatccatacaaagaaaatgaaccagttagtacacaagagattgaatgatgttgtttttgttgcctataactggaagatggaaactaggtttcagcttaggcgtgagaaagcaggaaaaggccagatccttaagtcattgaggagtttgattggaacaatgagtgggataattccttacatgaaccagttgaaggttttcgtggatgtgacattacataggatgatgttgatgaagttgttggtgcatcacgatctctttgagctcgctgttggtatttgatacggtcacagataaatccgcaagcgcacgaataccgctgtagcacttcacctcagagtattccaagggtatcgaatcacagaaaacatgtgcat

SEQ ID NO: 8232 - DNA, 1355 bp, Oryza sativa
tttggtgacttatccagcataccaatcagcatgcattcctgatttataatagataaaaataaatccaaataaattgagcttttttatccagcataccaatcagcatgcattccaattgagcttttttatccagttgtgagctcaattggagaacatttggatttgcgagtcagtttatctgtagttttgctttaaatttctttactatatcagcaagttatttatccttttttttcttcccttgttatttgcatccctgcagatccatacaaagaaaatgaaccagttagtacacaagagattgaatgatgttgtttttgttgcctataactggaagatggaaactaggtttcagcttaggcgtgagaaagcaggaaaaggccagatccttaagtcattgaggagtttgattggaacaatgagtgggataattccttacatgaaccagttgaaggttttcgtggatgtgacattacataggatgatgttgatgaagttgttggtgcatcacgatctctttgagctcgctgttggtatttgatacggtcacagataaatccgcaagcgcacgaataccgctgtagcacttcacctcagagtattccaagggtatcgaatcacagaaaacatgtgcatatatctaggaacataattctatccaaggacaacaactaatggtaggctaaggctaaagaggattcctatggattaatttactagacttgagttaaaggtaaaaccctatcgattgcttctggcactagccctccgctggtctgccaagctgaatccagcctacggctctatgatgtacctgaacatggagggatacaaaggatggacaaggctatcaccaccttccgcctacctcactttctatggagcacacaacaaaaaaaggtaaccgctaacctaaacaccacacctaagttattgattactactctagccccacgcaggaacttccttctttatctagaatcctagtactagagcacttaataattcaactaagcgacgaacccgcaacgatgggaatatatgtcattcaagcaactaaattaaataccataaggagatctcaaatacttacttaagaagcatccgttaagatacaaacgagagaagaaggccgataactccatcacttctccgaaactccagtggaagaagaactccgatatttggggcactccttccggagctttacctcactctttacctaattccacacactaaagagatgcctaaaatatgaaagtgagttgtactccacttgagatgtgtgtttcggaagtgagttgaactcctccttttatagccttcatatgacgcttgaaatggcggttgtggat

SEQ ID NO: 8233 - DNA, 14973 bp, Oryza sativa
ccgccatcaccaaccaatagggggtcgccacgtgcaaggaggtggctgggggcgccaaccttggatcagccgaaccaggcacaccgccattggccaccgacattctccggtgtatgacagtggacccctttggcagttgacggtggattagctcaaattcagttagttttgactgacatgtgggctctccgatccttgtgcttgcgtatggttggtcggaggtacatttagtctcatggcgagtgcattttctttcaaaaatcacctgcataccaatatttacaaagactagtggaaatggttagtaataaacccctaccactaagtttgatattatattttgtattcttttatgcaggagttgacggtgaaagtttgcacttatctaccgacaacaatcgcatgttctaaggagagttcacaaccttgttgttccaataacctttcaaaggcacccaaggaatacaacaatgtttgaagaagatgaggaagatatgcaatctgaccaagaagaagataaggaggaagatccacctaatgatgcaaatgtgagcaattgtgatgaagctcacgcaggtattgaagatggctaagagaatttggatgccaatggcaatttcgatgagtttgatgatgaatactaagagacaaggagttggacttatagtatatttgtttagagtgtggagtgtggagtgtggagttatggaccactattatctttatacgccattaggtatatgatagctcccactattttgctttgttattatgtttacttgcctgctaggttagcctgcttgatagtttattatgtttagagtaaattgcaccttgagccgctcttttttaccattgttgcaaattggactaaggacaaacaaactttttcactttagaccactttatctttaccagttgcttcagcttgggctagttcttcaacctctagcgctcctccctcttctccatatctcagagccatcaccgaactacaccaccccatcaagaaggtgatgaacctggtgaccgctagtaaatggtctgaccctctccatcacgaagatgaccagcaagccggtcctttacccaacaatgtggagatcaatgtggccgaggcgaataaatggatggttagtccgtcagtgcataccgattgtataatttggtttgtttgttgtgtggactgtgacatgtcagagacgtacttcatgccatgcgttggcaagtggaggcaagaggccgagcgccgctgaccacggtgagagccatcacgcaagttgttgtggcaaattggataacaccacccatgatgatgatgatttccctgtagtagccatgctttagcgaagcaacaacctatggtagcccctccacccctctccactagtagcacgtccactgttggcatccgctcgaagcagactacgcacttgaccatgacctcgagccctgtcagggcttacaccatgctcggcctcgagagtcattggtggctcagtgtcatgctcagccttgagcccagtcagcagccagctcagctctcggccttagccccaacagctccggcattgcacttaagttgagctcggccggcagctccatgctacagtcttgagcccacccggtggttcttttcttgcccacaaaggaagagagagagagagagagagcgagagagagagagagtacacaaagagaggagagagggagctacaggtacaagaacagccccaaactgaaacctttgtaaatttacccagtccaatagggaaatgtagatctaccaatagtccaagctgatagagttgtaaaatatagtggtccaatatgcaatttactcgtgctcaaatgcttactttgttgtctttgaatttatggctttatattatcatcttgctcatcaataatgtgccttgctgctttcaggtcatcaacaaggtatgctactcaagtaaatggaagcaatttattaactattgtttacaattatgcatctattattatcttcataacacaaaaaatggtgatgcttctaagggggtggatgctgccatgtaggtattggatgctacatgggcttaagagttgccaagaacaaggtatatatgtgtgtcgtactgctcttaaaatgcagctttgatgtgcctaagacgtcatctcgccttaagccttacctgtaaggtagtccggggtcaccttaccaccttaaaaaccatgatataaagtttgtctccaatcaccatacaaagccgtgtagtaaagtcaaattttggcctcaacaaaatagtctctagaccttctaacacgtatacagacatatgaatgatcttaaatataaaggttgtcaactatagattgtaaatattcttaagttctacaacaatacttatggatataaagtttatttttatctgactttatatgaaaaattatctaacttttttattaaaaaaactataattaccagttcaacactcaataggcaggatgatccagaccttgtgatgaggtggttttaacaaaagccatttgtgtagtattgcatattcgttaattccatgcacaaatccgtaggcctacaacacatgttgtttaaaataatattctctctcttcttggtctcatctccctcttcacctgcctagctcaaaagtaatgtatccttattgtcaattatatggcccataatatactccctccgtcccaaaatataagggattttggacggattggatatttcctagcctatccagattcgtaatactaggaaatattcatccattcaaaatcctttatattttgggacgaagggagtacgtactaggtaaacattactatcggtggtcccatgcccagaaaccccacattagaagttatgaaaaattctttaataaattacaatattgacagtatgcacctgcatttgcaagaaaaataacaagaaaaaacggaaatttgtaacatgtggcaaaatacacaatcagtgaaattctaccttttagcacataaccgtgagtactactgatacatgttattgggtgcacttttgcactagggtctgctactaccagatctaatttaggccttgtttagtttccaaattttttttctcaaaaacgttatatcgaatctttggacgcatgcatgaagtattaaatatagataaacaaaaaaatttacttgcacagtttgcatggaaatcgtgagacgaatcttttgagcctaattagtccatgattagccataagtgctacagtaacccacatgtactaatgatggattaattaggcttaataaattcatctcgtggtttccaggcgagttatgaaattagttttttcattcgtgtccgaaaactccttccgacatccggtcaaacgtccgatgtgacacaaaaatttttttttcgcgaactaaacaaggccttaaatgagatcctttgcttgtactgcatatgcagtatgtgttactgacatatggtcctagagcaagtgggatccatctatcaatgacaccttatgcatatgtcgggcatttttgaatcataggaatggaaaaaacgaaagaatagaaaaaacacagaattctaataggaatacaagtgcaaacaaacagaggattgtaaaacgtagaaaaaatataagaatgactgtttgattagaccgctggaaaaacgtagaaattggatgaaagagatataattggatgagagaggaattggaaattttccaataggattataatcctccaaaattcctatattttcctacaaattaaaggtgctcgtagtataacaaaaggatgtgtgtccgtctactttggttcttaaaagctcagtctgctagcacttttgtcaccataccttagaatgttatggttggcataacaatagattgatctatgacccacttgtgagcaaacacatagcctaaccttctataagtattaattcattttgatccactaataacaaaatttatcaccacatgttcaagatagaaacaagaagtgatagtaacagccgagtaaggccaaattgagccactttcctacactatcgttaaatacctagtctccctcaacccttactgattcacatcccctctcttccctgcccgccgccccctctctttctctccatccacactcgcccttgatctccctcccctaccctccgccccctctctttctctccacccacacttgcccttgaacaatcaaatctatctagccagagctccgggttgattgatttgattgttgcaatattacggctgctagatctaattgccagatctgggtgctctgagcgcaggtgatggtgatgatggcgattggcctaggaacaagcaacaaaacaaccatggtcttgggtgacaaggatgagtggcaaagcgagaggcattgtagtgtcagatttggttgctccaaacttgaggctactagatctagtcagttcttgtaagatatggggttgacaacgacaaatagggtccaatgaagacgggacccgcaagcacctcaaggggccaccgtgcgcacaaggtgtcgtgcaaggaactagaaggtaactcagagtatgaactggagctggcctaggtgctattttttttccttcaattttattaccgtaaaacatcactatttctttctcaccactggttccaaactagaagtgatgcccatttcgatccaccagtatgtaggtgtttactagtgaccccctagactctaaaggcattcttagggggtgatttagtacatcctatgggtgaagataataggagtttgtccatagatttttcttctttggccacactgtggaggtgtggtgcaggccgctacaaaactagcaactttttttgacttgacaaaagtatgatagaatctttggaccacatgttcatggaatcctagagagttaaaacaaacatagtttgtgtgcttcataaaaaaaaacacaaaaccaaaatgatggaagatgccttacctaatacagaagaaagttttggaccaaaatttattaagtctagactttctatctttcctcgtccaataggctatatctatccatactactactacctcaaatatggcagtggaattttctactaatcaaatacataaaccaatggtacttttctacagtagaatactatctgtagagaccatagtgaccaacaacaaattatcagaaccaaactataccaagctgacgctagacttcacgtaggttttgccccttactttttcctatgagtactcatgtaatcctaacccctagtccgcaatctggaaagggcaaatcactaaaccaatcaagaataattggagcataataatatccggaccatctggaaaatcatgtcaatttctccaattgtgacaaggcaaggaattgccattgtcacttgtttgtgaaagtcacccgtgctgcaagtgagctaacacagataacccagtaaagccctgaaggggggaaaaatcaaaggcatctaaagcactgaactgaatggatggatagtcattatcgacagtcacatgttacacacaacagtttaactttaaccacaccacggtaacgggggttgactgactatagcaaactcttgctatagtgcaacatttcagtataacgcgatcatactgaaacattttccgtcagtatcatctaggaaactgcaaaggtgttacaaaagttgccggctttgccatctggacaaaacttgttcaagcttctgattcaatttctgtgaatgatccaacaattcttggttcttctgtaattgcgcaaattttctgtagcaaaaaatggcccttctggcctcaacagaggttgccttatctcaactagcatagtccacccacctgccaaaaaagaacagaaatattatttcacagtttcaagtcctaacaaaatagtgataccacttcaacacaataacaagctcatggtacatttatcaattgttatgactggttaaaaaatgatcatattaataaccgcaactaaactcatgttaattagttgagtatccatgagggcatgtcctcacatggattctcatatctttgtaagaacatctagcaggctacaaattccgtaaaaagtagcaaaataccaaatcatagatcatagcatgtatcgcattccaaattatctactcaaaattaaatcaacaaaaatacaactatccgattgataacatgtaaaagtaagaagattgatgtaggcagtgtcacataaacaaaatgatatgggaactcctagcgtagtctagatgcaggacccatacaaaactaaactcaaaatggtaataataaactaaagaaatgaaaaggggtgtgctgaattaaaagggtaccttcagccaggtgaggaacctagagagtatgatcagtagactattgtgcagcttttctccccctgcgtttaggcctgtattaccagttaaaatcacatgtcagatcagtgacaaactgtgtcgacaaagacaatttctactattcatggagttgacaaaaacaaagtgaacttagttagcttgtgtgatctgatataagagtaaagagagaaagttattgaaagcaatattaggtattaaaacattgccaattgaggaaagcgataacaagttactgatatgctatttcagaagttggaagtagaatatgctaatacgttagttttaatcaatgagcaacaagtatcattgcattcatcacaaggacaagatgaaacttcagcatgtcaacatacatggcaatttttttgtaacctatataatcttgattcttgaaacatttgtatagcacctttagatcaacagtgaaaacatcagaactgatagtttggattctgttattaaaaagataactgattgcattattatgatagtaataaataaactaattccttaatagttaagccagtgatggtcatccaatcttggcagtaattctctgcatactcgtctaaacttctgatgtcaaattttgattatttttttaaaatatttcctgaaattacaacataaaactagtggggaacaaagatgttacatctcaatatctcacttcattatcaattatcatactaaaccctgtattatacaaaagtttcagtcaagtagaaaataaggaaccactagcttgatatgcaaaataaactcttaactaatgcggtgcatcacttcagctaggaaaatatgtggacaatgcaagctataattaattaatgtggtgcatcacttcagctaggaaaatgtgtggacagtgcaagttatagtagtgaggtacacaaaaacacagatatattcatccatatccagtaatatggccatggaacattgaaaatgcaagtatgatatataaaataaactttatttaatgcagtacatcacttcagttagtcagatgtctggacaaagtgcttcaccgaccattttatgctactaaagtttcttgatcataactaagcatattggaatgattcagttgagatatttgagctttgtggaatcacaatacactacattttcaggaaataatatccccagtgcatattacttaggatgctccttcaaaggatatacccatcaagtacatcacaatgtacaggtggttcaatcattggaaaattttattaaaaacacgaattttgtttgcagataaaatatcaaatagtgtttctaccaaaatattttggtgacttatccagcataccaatcagcatgcattcctgatttataatagataaaaataaatccaaataaattgatatggagaaatccttaccttgtggataaatagttttcaactattttcttttcatcttcattaagcataaaccacttgtctttgttccccattaaatcatcagcatcaacctctgatacagacagatgttaatcgtctccaattttataatgcagaactgaaattagtggaaggatgttgaataacgctttccaacaaaccttggagcatcattgttgtgttattacaatagtcatccagcttccaatagattacctttttgtctaccatgaaaggattagtcctaaggaaacctccatgcttcttttctgatgttgccatagttcatagttgagaacaaaattaataacaatgatcagcttattttccttcgcattacaggaaataaacagtgcaggagatcatgcaaaatgttctaaagtaatctgtttaaaaggctatgacgaagcatgtttagcaatataattcataccatttgtgtctgcattctttacttctttcacatccttttgttgagaaatgccattcttatcttcctcaatagcaacagctgctccttcagttttcaaaagcactgcttcatctgtgttctttatagtttcttcttttggctcctcctaacaaacaggagatattttgtcaattgttctagaaccatgtgacaaggtgggaaaggcaagccaagatcaaaaccttctcttttgcagaatgagctttttctctggaggggttttttgtttcagataatatgcagctcctcaacttcctgaacaatgttaagagtaatttaaaaaatcagaaataacaacatcacaatagcgaagggaagtattaacaaatgtgtaggcaatacttactcagtagaaagactttcatcacacaaaaagttcagaacactgagcttacaagaagggctcagatttttatatcccgataccccctgacttagggagtcaaggggaagtccctctgggacaaagattgactcgcttatgcattttccagtatcaacaatccatgcatcattatctcttgaatatgtgataggcctgagaagaaaacaacataattataattttatcaactgcatttagaaaaaaaaaaggctcggtttgggatctacttacttgattcctcggccttcttggatgatggataacaaagttatgtggaagtcagcgatgactgaggacaccactcgaagtccacgacctccagctatgtcccgaaggattctttctggttgacccttgcgtacttggaaaatctgtggggaaaaatcagtatgttattccatttgcaatacaaaatataatctcaatgtaccatgtgagcatgtagagcagattagtatattaactaaggaaacaagatattgttttaaaatatctgattcaattaaaaagcctgtaatgctagcagcaaactgtgactattttctcaaattgttaagtacaccagaaaataaatgcatgctttatatatgtaaaacaaaatagcagaaaaaagaatagttcaaaaccaacgcccacagcaatctcaataaattaattactgcgttatccttgtattattattattgaaacaaggagtttacatagaagcaaaaagagagcatatgcacgatatatgcacgagatcagaccgtaaaacgatacacttggggttgtaaattattgagtacatcctagatataagcatgacgcgcccatggttagtttgtgctcagatacaggtactcttacatgacagactgttcgctcaactctgctcgcattgcatcgcagcgatcacttgcggcaatgactaaatacttcagattataacgcaaagcgatcctaagcccgaattcaaaaggaaaactctaaaaaacactaagaagttactccctccgtttcataatgtaagactttctaggtttgtccacattcatatagatgttaatgaatctaaacacacatatatgtctagattcattaacatctatatgaatgtagacaatgctagaaagtcttacattatgaaacggaggaagtatgatgcaacaattgtaatggaacaggactcacggtagttgcaaaaattttacactaattgttccatgacacttgttagaaataaacataaaagattaagataactatcacatcgcctaataaaacaactgttacaatgttttgctggttaccaaaattatgccttaaggacttggatgtttggtctataacagaagaaataaattataaactcgcacagaaaagaataagcttcgctatcacttactccctcgttccaaaatataagcatttccgttcaggtaaatagtcagaaatgcttatattttggaacagatggaatagatagttgttttgctcagaagtttgaactttgctcaaactatgtgtaaaacaatggagctttatacataccttttgcaagagatattgtataggatgaaacataactttggtagtttccttaaaaaaaaaactttaaaacatagctttggtagttcagttgaacacgcagcctatcacaaataaaaaaattcgacagaacataataacatttaatttgggttatatgaaagctactacatggcttaaattacaaaccaagaaatataattggaaggtttcgaccagtttatcaatgttaacatgtatatcatatggacaagaagtgccatgcaataaaaaagaaacctcataattacaaataggaactcgaatattgtacacattaaagggcaattaacagatagcctgtatctaggtgttagcatgttgcacgcagagaaatcgcatccatttaatgcgtacaatgaactcaacaggtagtcatatatttccttttgcccatttgctgtcacccggtcaccccaccatctccctctgcaaattctaatccgaatacctattccctttatgatttgtatcccatcatggcattgcatgccttacctacataaacacatagatatgattccaaacttgtaggaagctctaatatcaacacttcggtgcttaccagtaaaagcattttttacattgtcatacttcataccaaaacataacatgcatcagacatgtaaatagaaaaaaaaaactcgatctattattctcttgcaaatgctagtaagatattactctgacaaggcatgtgcaatcatactattaaatatccttgatctttctttcgtaactacctcagcaaatgtgcggcagaattcgaagaactgaagtgcaagaccaacatcttcaggctcccactctgcaccggcaacactagtgactggagtgcccttgggcagaacaacttgttccttgggagcatcagggctttcatccttcgtcagagccacaccattacccaccttcctgcttctcttctgcttcttcactggagcagcattgaaatcaatgcatacattctcatccccttcagccaaaggttcatcagcagcagcatctggctgtatggccctctttgggctcttctgcttgttcataaaaaaaggatcagcaaaacatatcaaacatagtgaacaatcgtaccatgcaacagcgaattgtaatgtgacaaaggatcgtgccaatcctgaacaccacacaccttcacaggtgtagatctcactttctgggtgctcctctgcgcggcagccaccgcttctttcccctttttcagtaaatgatggaccgaagcacaacctgaagccttagcagcatgggcaagtattccggtgggcggcagccccttcttcttcctgccaaacaaatcaaagtccatccatcacttctgacaacaaaacgcgagccacagataatcagcatgaccggtagagcatcaggtttggtcagctcacatgcagaagctgcaattgcagatatccttgcacttggggcaagtccaggtgccgtcattggccaccttctcggcttcctggccgtacctgcgccacgaatcactcagaaatcacatggtcagccagccttgctctgcctcctgaagctaagaaagaagacgagaagaaattcccccctcacctgttaaagagacacttgcggcagtactggatcgtgcactgcttgttgttcttcttgatcttgtggcatgacgcggcgaagtccatcgtcttctgacggcactgcgagggagcaagaaacagagcaaccgctaaacccaagggtgagcaagaattccccgcaaaaacaagggggggcgagcaagaattcctcagatccaacccgacccaaccaccggggaggaagaacagggacgcacgactcctcataggacaccggctagacacggtgtcgaacagatggtaggcaggcaggtaggtgggaggaggaggaggggttacctggtggcaggtcttgccgttctccggatcatagatccggccgccgacgacgcggacccccttggattcgacggacttccccttcgccgccgccgccgccgccgcctgcttcgccgccacctcatgctgctgcggcaccaccaccacgacgtcgccttctcctcctccgttcacctccactccagctgcttccatggtcggcggacggcggcgggcgacggcgagcgcgctggaacgaggggaagaggaggagggatcgagagggggggagaggaggaggaaactgaatccggggacgcggaagaaaccgagaggattggtatgaatgatgatgaaatgggatttctgctcgttggcctcgtgaggaaggtgattaatgtgggcgagagagattgaaaaatttttgggcagcgaggcgaggggggggatcatgacggcatcgcgcccagcgggttggggaaaatttttttcaaaaacttccctccacgacgcgtctcctcaagtcctctctccccgcttcgatccaaattgggtttttttcggtttcagccgcgcggagcggaggtgaagcaatgcgcggcgccgcgcggcccgctaacgcgcgtggaaggaagaggagggggtgtcaattgtcaaagggggaggaggtgtgtgtctgtgtgagctgttgttgctgctgttatttcctactatttcctttgacagcttgcttggtttgacggtagagcggccaaaggtccagctaaagcggatgggtgggtgtgcggggtgcgagaggtatatgagtgggtcccaccgtttgctcttcctcgtcatgactcatgaggtgtgagggggtgtgcgtcagtgggcctaccaactatctacttatttaaagtaggtagatagaaatttatttttgacttatctttagtgaagaattattgtttttatatatcgggaccatttgaaaaaatatatatatataatatgtgaagatattgcatcaattatacagcaaagatattaatacaaagataaagtagatgagtatatctaattgttaaataacataggtttcaacgagaggggttggactacccccttattaatactctaggtccactcgattcaggggaaggtgtttactactacctccgtcacaaaataagtgcagccgtgaaaatccgtgtccaacgtttgaccatccgtcttatttgaaaaatttataaattttttttaaaaaattagtcacacataaagtactattcatgttttatcatctaataacaataaaaatagtaatcataagtttttttcaaataagacgaacggtcaaacgttggagatgaatagtacaaaactgcactttttttgggacggagggagtattgttatttcttaatttagaatatattaggcagccaaaggtttttctagactagataagtgggtatgctagttataataggcatatgatcaagacatgatatcctgctcatgacacgtcatggaatatttactatttcttttaatagcagaatgacaaaaattccggctaaaacatacggggcgggtgtgcagggtgtgagaagcatatgagtggaccccaccgttcgctctgattcatgaggtttgaggggtgcatcggtggtcctaccaatcgtccactttttcaccttcttaagtaggtggatagaaatgaattttggactaatctttagaaacaaattgctagtaacctttatatatttggatctttaaaaaattctgttagtgaatagttggtttactttagaattaactataaaaaaaattaacacaaagaataagatatatgaatataccataggtttgaataaaggaattgaactacttcttaccatggacttccttataccacataagtctcgggctactctattcggggaaagtgtttgttaacattgtttctttatttgagattgctaggcagccaaaggtttgtctagactacatgagtgggtaattagttgtcagaggcatatgactgggatcaaccgtccactcttcctcattgactcatgaggtgtgaagggctatattggtgggacaaccagccatccgctttcccaccttaaatgggtggatggaaattttgttttggattcatatgtagtgaaaaattattgttagactttatattttgatctattgaaaaattatattcaatataagaatcacgcgtttaattatattcaatataagaatcacgcgtttactttggaatacaacgactatagagaaaaatataaatacaacattaatgtggttgaatagatatagtatttaataacatgggttataataggggttgcactacttctccattttaatagtatagcggccaaaggtccagctaaaacagatgggtgggagtgcagggtgcgagaggcatacgagtgggccccatcgttcgctctttatcatcatgtctcatgaggtgtgaggggggcacatcgatgagcctaccaaccgtccacttgtccgccttcttaaataggtggatgggaatttgtttttgacttatcttcaacgacagattggtagtaacgtttatatatttggatctttcaaaaaaaaatcaatatttgaatcgctggtttacattgaaatgcgtcaactatacggcaaatatattaatacaaaggtaaaataggtgagtacatctaatagttaatagcatatgtttcttcctttctttaaaaaaaactaataacatagcaacttgtttggtaactcgagggaaggggattgggagtttacacgagggaattgatgatgagattaagatgggaatttgattt

SEQ ID NO: 8234 - DNA, 23795 bp, Oryza sativa
  unsure (1)..(23795): unsure at all n locations
aaagtaaaggaggaattccctcccaattacctgcccctacccaggtattgaaaaggagggagttccttcctcaattacccatctccatcccatcaaaattcacatgtcttccaaccaaacaaaacacttaatagcctcatccctctaaactcccaatccctcctaaaaactccctccaaccaaacgggccataggttcaatatagggattggactacctcctcatcatgggcttctttgtaccacctaaggctctggctactaggtccactcaattcaaggcaaggtgtttgttattgttgtttcttactttaagaatgcaataggcagccaaaggttcgtttagagtagatgagggggtatgctagttgtgagaatcatatgattgggacccaccatccgctcttcctcctcatgactcatgagctatgagggggcataaccaatcagccatccacttttcgccctttcttaaatgattagatgaaaaattattttggattcatatgtagtttcaaattactagtagagactttatatttgaatcaactaaaaaaatatattcaatatatgaatcactggtttactttaggatgcatcgactatagaacaaagatattactaagttagtcgaatagatattaacatgagtttaatagggagttgtactgcctctcccttttgctattgtcttcattgtaccacctaatcaataattaatgtaaatatgctaccttaggccctagccactaggtttcctcgattttgggaatgtgtttttggccctgtttagatcccacctcaaaatttttcaccctgtcacatcaaacgtttaaacacatgcatgaagtattaaatataggctaaaaaataactaattacatagattgcggctaatttgcgagatgaatcttttaagcctaattgctctatgatttgacaatgtggttctacagtaaacatttgctaatgacagattaattaggtttaataaattcttctcgcggtttactgacggattctgtaattattatttttttgttagtgcccaaacactccatgcaacacactatataatacctgatgtgacacgccaaaactttacacccctggatctaaacatcccttttgttgttgatgcatatttcttactttgacaaggtggtaggcagccaaagatcagtttagagcagatgggcatgtaggatgtgagaggcttattagtagatcccaccgtttgctcttcctcctcatgatacacgaggtgtgtgagggcctccaaaccgtccaattgtccaccttcttaagtagggtggatggaaatttgtattggacgcagctgtagtaccaaattactagtattttttagtaaagtacacgactagtccctaaacttgttcgtatatgtcatcgaagtccctgaattctcaaaatgcactttcagatcccataaattcttcttctatttagccggattgccataacatttacagatgtaggttggtgaacttctttgacatagatatagttatcattggttaaaaacaattcatgcttattgtggatatagctaaagaaagtagcattagattaaagctagctttcttgatgtggatagaaggccattgattgcaatgcagatcaagaaaaaagaagtggtattagatacccaccccaatgtattataaataatatataattctaatctattatataatagtattttctaaagataaggtcttaatttatatttggcacaggccccaaattgctagggacggccctgcaccgaacatccttacaatcatatgtacgccacaaaaaaaacatgtctctcctgtcccatttcaaccgatctttttttttcattggagtagaagggatcaaaattgaactctgaatgacatcatgaaaattatttttttatgcatcaacccttcaagtatgagttgtatactgtgcatcatcactggtcaaaaactagcccctgatccgctccatgagacaacgtgggcatatgccacatggatccctcatggacttgatctggatccaagacgaggatagggccacatgttagcctctttctcatctctccctcaccctcccaatcggtaatgtcgttagggagtgtggcgtttgtggtagactgggagttcgtgtgcatggagcggtgctcgtgttgttgagcctgagccagccgtgtgccagctcaagttcaccgttccacagtcacacccccttacccagtcaccttcctacaccgccgccaacccctccatcaaaccaagcccctgccaagatcgtccctacttatcgcagtagagcttaccccgcctgtaggctctagttgccaccacctgtaggttctccggatcatagattcggctgccgatgacgtggactcccttggattcgacggacgccgcctcctcctgctgcggcaacaccaccatggcatcgcctcctcctcctcctcctcctcctccagtccagctgcttccatggttggcgggcggcgggcgacggcgagcgcgctggagcgagggaaagaggaggagggatcgagacgggggaggaggaggaaacagaatccggggacgtggaagaaatcgagaggattgatatgaatgatgatgaaatgggatttttgctcgttagactcgtgaggaaggtgattaatgtgggtgagatattgaaatttttttggcagtgaggtaaggggggatcatgacggcatcgtgcccaacgggttggggaaattttttgttcaaaaacttccctccacgacacctctctcctctctctctctctctctctctctccctgcttcactccaaattgagtttttcggtttcaggtgtgcagaggtgaagcaatgcgcggtgcagcgcggcccactgacgcgcgtggaagaggaggaggaggaggtgtgtgagcttttacggctgtgagctgttgttgctgctgttatttcctactttgatagagggtagagcggccaaaggtccagctaaagtggatgggtgggtgtgcggggtgcgagaggcatatgagtgggtcccagcgtttgcatttcctcatcatgactcatgacgtgtgagggggcgtgcatcagtggacctatcaactgtctacttgtttatcttttaaaatagggacaattgcttattttatcccattttgaagtctaactaccaatttaaccctacttttttagtttgcttatttgaccatgtttttcaaaaacgaaccttccgcttgaccctgtttccactacaccgttaagatttgatttaaaaaaacaaagaaatataaataaaattcgtaatgccaaaatacccttgaggaaaccatatccatccctaaccctatccacatgtgtatctctctctctcctgccagcgagttgcggtggtggcactcggtgtctgaagggaggaagggggcggcgccggcgggaagcacgcggaggggatccgcggcggcgcccgctcgtggaggcaggggccgcggtgatgggaagcgcgtggaggggatcctcgctggcacacgcttgtgaagggaaggagcggcggtggtgggaaacggatggagggatctgcaccggcgtcggcttgcggaggaagggagcggctgcgccgagcctctgcgacggcggcgacagttcccctgcggtggtggcggcagcatgcagtggagctgcgcgcaccgtcgggtgaggcggcggcgcgtgcagcgaggagggaggcagaggccggcgcgcggcgaagggagggaggggagccgggcctggcggtggcggtgataggcgtgctgaaggagggaggaggccgcggcggcagcggcaggcgcacggaaggagggaggtagcagcggcggtcagcgcgcggagggaagaggaggcgccaccggcatgcactaagaaaggaaggtggcgaacccagcgatggagctgtgatggctggatccggcaagggaggggcaacgacggctcggcggtgacgaggagtggaggcggtgctccacagctgctggtcggcgctggctcgccctctcgctgctcgcggccttctccctgcgtgtggagctgtggaggagaggacaagagagaactgacgcgtgggtcccacatgtaatagggtcaaatgagtaagggcagaagggacattttgtgcttcagttaacatcgttagatgcccttaatagaatagggtcataccatatcttcaatttttaagaaaagggttaaataattaaagttgataaaagagggtcaaattgatagttagctttcaaaagagagtcaatgtgcaattaccccttttagttaggtagatagaaatttcttttgggacttatctttagtgacggattgttgtctttatatattgggaccttttgaaaaatatatatatacaatatgtgatgattgcatcaattatacagtaaagatattaatacaaaggtaaagtaggtgagtatatctaattgttaaataacataggtttcaacgagaggggttggactacctccttattaatacgctaggtcttcaagggaagttgtttactattgttacttatttcttaatttagaatgtaataggcagccaaaggtttttctagactagataagtgtgtatgctagttataataggcatatgattagtacatgccatcctgcttatgacacgtcgtggaagatttactctttcttttaatagcagaacagccaaaaagtccggctaaaacatatgggcgggtgtgcagggtatgagaagcatatgagtgggccccaccgttcactcttcctaatcataggccgtatttagttgcaaaatttttcttcaaacttccaacttttccatcacatcaaaactttcctacacacataaacttccaatttttctgtcacatcgtcccaatttcaatcaaacttccaattttggtgtgaactaaacacaaccataattcatgaggttcgaggggtgtgtcggtgggcctaccaaccgtccactttttcaacttcttaaataggtgattaattttggactaatctttagcaacaaattactagtatcctttatatatttggatctttcaaaaaaaatctgttagtgaatcgttggtttactttcatcaattataaaaaaattaacacaaagataagatacatgaatatacctaatagtgaataacataggtttgactagaggaattggtctacctctttcttaccatggacttccttataccacctaataagtatttggctactaggtccactctattcagggaatgtatttgttaacattgtttctttattttgatattgctaggcagccaaaggtttatctaaactacatgagtgggtatgttagttgtcggagtcatatgactgggatccaccatccactcttcctcattgactcatgaggtgtgaaggccatgttggtggggcaaccagccatccgcttttccaccttaaatgggtggatgaaaattttgttttggattcatatgtagtgacaaattattgttagactttatatttggatctattgaaaaattatattcaatttatgaatcactcgtttactttagaatacaacgactatagagaaaaatataaatacaacattaatgtggttgaatagacatagtatttaataacatgggttttaataggggttgcactacttctacattttaatagtgcagcggccaaaggtccggctaaaacagatgggttgtgttgtgtgtgcaaggtgtgagaagtgtatgagtaggctccatcgttcgctctttatccttgtgactcaggaggtgtgagggggcacgttggtgggcctaccaaccatccacttgtccaccttcttaaataggtggatgggaatttgtttttgacttatcttcaacgacagattggtagtaacgtttgtatatttggatctttcaaaaaaatcaatatttgaatcgctggtttacattgaaatgcgtcaactatacggcaaatatattaatacaaaggtaaaataggtgagtacatctaatagttaatagcatatgtttcttccttttttttaaaaaaaaactaataacataggtttcaatacagggattggactacctcctcctcatcatgggcttctttgtaccatctaagactctggctactaggtccactcgattcagggaaggtgtttgttattgttgtttcttactttaagaatgcaataggcagccaaaggttcgtttagagtagatgagggggtatgctagttgtgagaatcatatgattgggacccatcatccgctctttctcctcatgactcatgagctgtgagagggcatacccacctaatgtattataaataatatataattctaatctattatataatagtattttctaaaggtaaggccttattttatattaggcacgaggccccaaattactagggacaaccctgcactgaacatccttacaatcatatgtacgcaacaaaagaaacatcctcagccagttcattgtctgaccatgttgactagatagtggaaatgaactggctagactgtccggcagctctcgaattgtctgatgcctagttaatttggcaactagcggacagttcgacacgacgtcggttaatctggcatgttcattcgattgttactggtcattggtttttgaacattgcggattgtccgacaccgtgtggacaaaggggtcctgggcaatctaggagatgttggattgtcctatgctttatggcccaacaactacttgcccagttacaatcagaaaagtatgaagggcagaatagttcgggtcggtgccatactgtttgacgatttgcagttttggctgcttctttacgatggctgcaaaccgctagggagcttgattggggctttatacatcccttggcttgactccccggtgtcctttggaaccctattgagctgagcaattgatgggagagtctaagagcatcattgagctaattgtgataattttcttcactaatttagtgctagtttgagttgagagtatgcttttttctggtgcttgccaccctccctgtaaattatattttcctactgtttcacgtcaaaaaagagtggcttagtgtgcaccaacaagaatcctgttcttaacaggaggagtggctctcttcctgttaactattggcatcttggcatgcctagccagtctcgaaggcaacccggtgatctgtcaagaagattgtgggagagccggtgtggttgtggaggtttcggggttcacctttcagagcggagaagaaccaccatgatgagagcgccaatggacttcgtgactatcagagacagtgtactctttgtgtagagtgctccaacgagtattagtggagattgccgaatctcttatacctcagagaaaactcgccggatctatgtttgaatttcctatcgtttttctctctttacttttaattcgtattcctttcaatacttagcttacttccttatagcagtggacagcaatatattttgcattcaactgtactagcgaattactagtaacgaggaattatgatcaatatatgaatcatatattggttttatggaggaatgcatggactataagacagataataatcttttactcttggcttcatagatttggtggctgacaaacatgggcttcaatggatgggctgaaccacctccctcttctttttggccttctactgccacctatttcctccgttctaaagaaaactcaatctctaaggggatacgacccctcttagaataacgaatctagactacccgttgtctagattcgttgtattgatgacaagatatgctatatcttttttgttaaacaatgtgtgcactaattagaattgatgagtgttttgtgcaccgtgtaaatacgttcctagacttcctacatgatgcccgacacacagaggaggacggaagcgactggttttcatgggccacggacacggggtaatttgggctatagcaacaaaaaggctcacaagcaagtacttcctccgtcccaaaaaaaatagacaactagggcctgtttagttcgcgcaaagaaaatttttagatatcacatcgaatgtttgaccggatgtcggaaggagttttcggacaggaatgaaagtactaatttcataactcgcctgaaaactgcgagacgaatcttttgagcctaattaatccatcattagcacatgtgggttactgtagcacatgtaggttactgtagcacttatggctaatcatagactaattaggctcaaaagattcgtctcgcgatttcccctctaactgtgcaattagtttttttaaaataatctataattaatgttccatgcatgtgtcaaagattcgatgtaatgtttttgggaaaaaaattggggaactaaacgaggccctagtactataatgtgactagtacaatgaatctgaacactccctccattccaaaaaaaaaagacaaactctggtgtcgaaacatgaattatgcaataataaaagggggtagcgcacgagatctaaaagtggatggatgcggagacaaaggatttagacaggttcaggtcctctcaatgagaggtaataccctactcctgtttgaggatttgaatccgccgggtgtagtatagatatgacgatctagttgtgtctcatgccccctagagggcctcctgtccaccttatataggatggggggcaggattacaagatagaaaccttaaccaatacggtatcggtttcctaaatctactttacaatcttatcaaaccaggactttaggccgttccataatatacagggaaacgtaatacccaagtcatgatctgttacatatttcatagatataagttatcccctataaccagtcggataaccacgccgtgtgggtatggggtacccataatctccatagtagcccttgagaccttcatagtcgaaaagataatcttcgactagactgtggagggttggaaaataaagttaggtgcatcgactagatgcacctaataggtgtagcctccgactatgtggttagctgaacaaactaagcgtatagtcaaggaataaataatccaaccaaccgagtggttttgataattgtaatcaaccaaatgacttgatatatagcatatgcggtgtgaatccccgaataacatgatccaagtgatataccgattgctttgtaaaaattgatgagagcaacctaaagttgactacatcattgaaaatacacatagcaaaacagctataaaaaagcttgaatgttgtgaataaagaaatttccaaagtattgggcatacgccatgcgcacactgctttaacagatgtgcttaagtccctaaaagacacatggtttcaccacacccggaaatatacggcatatgtggtgtaaaatccgagtaaataaactcataaaggatttaccaaccgcctggaaaatgaccaagatatataatcagcctaagccataatattggtcaataaaaacgcacacttacgtggcaaaaagcaatgatattgtatccaatcgattgcttaaaaacccaaacaacaccttgacttatataaaaaagtcagcggaacagctatataaagctttactgtttgacaccttttaagatgcattgtaccaactcctaaaaagttgagtaactgcggtataaaaggattttaagatattgggcacttgatcacgcacactttggcctaagcaaaaagtgcctaagtccctaaaagaacgtgacaggccacacatgaaaatatgggctgcaaacatattaggcctaggccaaaaaaaaatgccttcgacaccctttaaaggatgacgcatataacatgctcccgagtaataaatcttccgggtaatatagaccaagtgtagctcatatgaatagcttctgatctgagtgattatcccttatgggatactccaaaatagatataaaaattgaatcccgactggcgcaagtattcggttgatagcccttacggagaataatgattggttcagtcttcgagcatagaaaataatctcagaacaaaatccaacttgaaggtatgatcctagtgtttgagttgataagcccctgagaatatatagcttgtccttctgtcatagtcaaaattgtccattggcaatagctgatgcagtcgacatggagacgaaatgactaacatgaagatgatatcacccatcaaagctgacgaagatgttggtggtggtaaagacaatgataccaatcaaaggtaatgaagtcgcatagccatggaggcgaagaaaccagtcggcggcagacagatcaactaacaattaagatgaaggcacccagcaatagcgacggagttttgtagccatggtgacgaaataattagtcggagacagacgagacagccggtgaagaagacaaagacgcccatcagtaaaggcataataagccagccgtgaaagcgaagacaccatgggcggcggcggaggcaagccggtggtgaaaacgtagacgctcatcaatggcaatggcgaaatccatcaatcatgaagatgaagaaaatagtcggcgacggcaaatgcaaccgacggtaatgacgattagcagcaacagacatgatcgactatgatgacgaagttgcccatcgatagtagtagagtaggctatgtcgaagaagcttgacaggatggtgatgaagatgacaagtcggtgatccagtcaatagcagtgtagcagctaatgataatgacgaagacgctcatcagcgtttgcgtagtaggtcaaccgtgaaggcgaaataacaagtcggcaatgacgtaagcaaccgaaggcgaagacgtagtcacccattagcaatggcgtagacgtcagggccgataaagtagaggcgttggtaatgaggtcagtgacaataatccatcaaactgttgagaagatatcgaagctcgagtaatttcgttgacgctagagtgcgcgtaatgtagattgatgcaacgcctcttgatttatgaagatgacagtagaacttggtgttgtagctgtagaagatgcttcacttgaagaaaaatagatgatgttgtccaactcgttgaatcgacgaaataactagagtcgctgaagtaaaatgtcggctctgaagcgaagaccaagataataactcccaaaatttacttgttgattcattgattgcttcattttgacaaaaaacatgtcaaattttgagccttgtatttgtgtagcccccgactctttggttagttggaaaacaactgaacatagagtcgagaactctagcttgtcgtcgagtagccattgcttgagtgaagatacgtgttgaagatgtccgagtagaaatattgatgattagaacaccacttgctatagtaaaataataaggcatcatatttggtgacgcatgtcgagatgtcgaagctcttgtagatgtcgtgattggtgaagtagcaaatcttgcgaacggtagcgaaggcgtgtagttgtgaagataaacacaccagtcagcggcgacataaccagtcggcgacggaagaagtagtatgatgatgaaaacgaagatgtccatgaacggtggcaaaataggccagctattaaagtgaaaacactatggacggcggcgaaggcaaaccggcgatgatgacgccagttaatgatgacgaagacgcgcagccatggaggcgaacaaaccagtcggcagtagtttagtggtgagaattccacgttgtggtcgtggagacctgggctcgaatcccagcagacgagacgaccggcggtgaagacgataaggccaatcaacagtatcagaatcatgcagccatgtaagtgaagagaccagtcagcagcagacgtagacagcttacgttgaagatgatgacgcctattagcggcggcgatatggccagccgtgaatacgatagctccagtcggtgtcatacgaggtggccggtcggtgaagatgtagacgcccagtaacgacggcataataggccagccatgcaggcgaggacactagtcggtggcaatgaaggcaagccgatggtgaagacatagacgcccagcaacggcggcataataggccagccgtgcaggcagagacactagtcggcggcggcgaaggcaagccggtcggtgaagatatagatgcccaacaacggcggcataataggccagccgtgcaggcagagacaccagtcggcggcggcgaaggcaagcaggcggtgaagacgtagacgcccaacaacggcggcataataggccagcggtgcaggcggagacaccagtcggcggcgacgaaggcaagctggtcggtgaagacgtagacgcccaacaacggtggcataataggccagccgtgcaggcggagacaccagtcgacatcggcgaaggcaagtcggcggtgaagacgatgacgtccaacaacggtgatgtgaccacccaaccgtataggcgaggacaccagtcggcgacgacgacagcaagccaatggtgatattctgactaatccattcctgaagcgtaggagataagcttaaagctataaatccctattatgcatatctggatctggatcctgcagaacaaacatatagaatgagtagtatctgatgcaagcacagtacttgagaaaaattcaagtattttaaaatatttataaatatgtatttctcctcttgtcaattttgatttccccgagcagatgactccgtacgtttaaacactctgcccgactagtcatagcccccaagcatcgggagttggtttaggcacttcccaaacatgcatatgagtgacatgagttcgtcattaatggaacaaagtttcacgaatcaaaatttactactcgggtacttttgcaattgtaagagcagaaaataaatttatcttatctctatgcttttgatttattccgaataatacttaggaccttgcgttactcggtccatccaacgagcccccgggtgctaggaatcggcccaaaggcaactatccatcgacaaaccaaatggaaagcataggaaaatagaactccataactcgataggaactttattgttactcggattatttcgcaagcaatcaagataaatattatgaaaaattgttaaaaaatatgatatgacatctatagtcccccgactcactagtcaacggcgaaccagttgatgtagtgaggcagaggaaaaggaaaatatcatataaagaaaattaatgatgacttagctttgtaatattccccttggtgatggcagaggtggccaatgtgggaacaaagtcgtccatcaataacagtaaagacaccagtcggcagcgacgaaggtggtcgatggtgaaagcgaagatgcccaccaaatgcagcataataggccagccgtgtaggcagagacaccagtcggcgacggcgaaggcacgccggtcggtgaagacgtggatgcccatgaacggtggtgtgaccaaccaactgtataggcaaggacaccagtcggcggcgacggaggtaggccggcggtgaagtcgtagacgcccaacaacggcggcataataggccggctgtgcaggcggaaacaccagtcagcggtggtgaaggccagccggtcggtgaaaacgtggacgcccatgaacggtggtgtgaccaaccaaccgtataggcgaggacaccagtcggcggcgacggaggcaggccggcggtgaagacgttgacgcccaacaacggcggcataataggccggccgtgcaggcggaaacaccagtcggcggcggcaaaggccagccggtcgatgaagacgtagacgtccatgaacggtggtgtgaccaaccaatcgtataggcgaggacaccagtcggcggcgacggaggcaggccggcggtgaagacgttgttgccattagcaacggcagtggtgaaggcaagccggtggagtagactcatggccaactaatcgcatagcgagacacctcgagtccatgaccaacgccaatcgcctcagtagtgccgtgtaattatatgcaaacaacaacaaaaatagcaagagattaatctgaaattagaaatcaatctaataatatagaataataagttggaagagataaaactcgatgagttgacggcgccagttgcgggcatgacgatatttgtcatatgatcaccatctggtaaattgtaggcagctgctccaatgtgtggccggtgatgaagacaacccacccagtaatagtagaaggattgctttaccggcttgttggatcagaacgatatctcagggccatggccatcgatccatggaagtacatgtaaatacgagtcaaatcagattagtaaacaaaagaagatgcatgcatacaactacatacactcctatatattaattgactcatatgtgtcgatagctgcttattgaataattggattcaagcctgtgcatgttggtagcagcctataaacgcaggactcctgattggttggcctattggccagcatgtatacttgcatatatggcggtgatcagtagatgcatgcgatcaacgcagctgttccggtgcccctgattacgtcgccgcgaggagaagcgtgctagactgttactttggcaatcaaagcagtcggccgggccaaaacattcgcaaccaaccggcaaccgcacactacgcctgttctgaggacaggggttgcagcatgccgtgtatactcccaggtggctccatatgctatcgacgatctcgtcgacagtagtactacaataataatagtacaccaggaaatcaatctgtcatagacattgttaaaaaacactagatagattgaaacgacaaacccggttgaagagttgagccatcgacgtcggtgagattgatctcgccgtttcttctgcagttgattccattgcacttttcgatgggtaattcgacgcacccctacctgccgcgccaactgtcgaaacatgaattaggcaataataaaaggggtagcgcacgagacctaaaagtggatggatgcggagacaaaggatttagacaggtttaggccctctcaatgagaggtaataccctactcctgtttggggatttgaatccgccgggtgtagtatagatctgacgatctagttgtatctcatgctccctagagggcctcctacccaccttatataggatgggggcaggattacaagatagaaaccttaatcaatacggtatcggtttcctaaatctactttacaatcttatcaaaccaggactttaggccattccataatatacgggaaaacgtaatacccaagtcatgatctgttacatatttcatagatataagttatcccctataaccagtcggataaccatgccgtgtgggtatgtggtacccataatctccacacctgggattccgtatccaacgtttgaccgtccgtattatttgaaaaaaattatgaaaaaaattaaaaagacaagtcacgcataaagtattaatcatgttttatcatctaacaacaatgaaaatactaattataaaaaaatttcatataagacggatagtcaaacgttggatacgaaaacccagtatttgccttttttttcgatggagggagtatatgatatgtcacatcgtactacgagtttgattttttttacggagagagtgctagcaagaaaaactcacgcacaagggtaggatcgcagttgcgttgcgcgattcttttttttcttgaaaagacgcgtacgggagaactgcatcagtttctattttttggatgtgcgctcgttagcactcacgcgatagtacaacgcacgacgtacgcaaaccacgaagaatccgatgaaatcgatcggctgcggcagattcttgagaattttgcatttgacacacgagccgacatctaagtcgtggagtttagctggacgcaacggcacgcacacgcctgatcgaactggaaattggctgttgcattgttgtactactatatactccctccataaaaaaaaaaaaataaacgctgagtctccgtatccaatgtttgactctctctcttatatgaattttttttataattagtatttttattattgttagatgataaaatatgattgatattttatgtgtgacttgtttttttaatttttttcataattttttcaaataagacggacggtcaaacgttggacacgaaaacacatggtttggtttgtttttttgggacggagggagtaccacattgactgatagatatatgcttaaattcttatctctactttcccaactcactttcctcgattttcacgcatatgtttttcaaaccgttaaatagtgtattttttataaaaatctatattaaagttgttttaaaaaacatattaatcatttttaaaaattattttagttaatacttaattaattatgcgctaaatgcggctttgtttagagtgctactccctaacacagccatagttgacgtgaataacgtcttgccataaataaatgttatattttctcatgaaaaataaataagatcgatcaatatatatgctctccacccagagcagtgcgcacagtcacagcccggtccatcgtatgaatgagcactcatattagtctaatcgaagctttaaaaatagtacatatctataatgaaatataacgaaataccgaatactaggtcttcctcaaaaataaaaaaaggagccaccgaacagcccgtccctggtcacgtgtgtattaatttaagctaattcgttccgatatatttagaatctcttggttttgttttttaaaatttaattctttttctccactaagtcagctagaaggagctacttcttttatctactatggtaagtattcgatggcagtcatgaatatatataaaaaaactatatctcgtgataatgtaaacataccttctaggtaataaggactccattttcatatgtagtactgaaaactgtatatattgttgcaacattttttcttctatttagccaaatagccataacatttagtcatttacatatactagtaatatgcccatgctaaacactactgtgcattctattatctttaataacttttaaaatttcatgttagcaaaaagtattttatatgatctgtgcaattgagttttaattaattttatgtcgtatatcaaatatatttcacgcaaattataataatatgatattgtgtgggtagaataaatcttggcaagaattagtaacatataatcacttcaatatacaatatacgagggcgatatacgtttgaaaatatgttaaagttctaaaaaaatgttaaaagtatagagttattccattaaatagttatgggtataaacaagtacaaaaataaagcatttgatacatatatagaatataccccgtagataaataactaccctaatgtttatcatttaggatacacttaagaaattctcattgtcgacaagtgatgctcgtggaccggataagttgagtattggggtatgtttgaaagagggtctacgtagtacgacatcaagcaaatagaagacaaggattatactggatcaggccccctaacacgtaatagccttagtctagtttatatgagattgatgacgatgataacagagtacaaagagagtagatggaacagacgataccgacgagatcgtagttgatggattcgacgagatctcccggcgacttggctccgaatactctggcttcgtaagctatggtgggtgtgttggcgatgatattagatgtccttcacctccccctaggggtccacttttataccgtggattatcttgacccgcaagtaaggcctggaggtatgtaatatgatacaatataacagagattctatcccctccgagtaggactttggtagtttctttaactcgtagggatattttccgtaatttaagacaaattcctaacgacgtatagggaaacaatccatgtacgtgaaggtatgccttattggtatattccataagtcgtaggatagaaggtatgccttatcggtaaccctgacagtagcccccgacttcaacttaaatgaattcatgttgtcgcccacgacttctcctaatagcgtctcgtcgtgctcgctaggtcgatctcggttactgaccgtagagacatggagctatcgacaacgctagagggagtccaacggtgcaaaatttgaatttaaattgaagtctgaacaactacctccaacgggccttagaaattttcggcggcaatctctctcctttcctcaaaatacgaaccgttaggtggtgcgcctatttaatggaattctgggatccatttcaagtctgtttgccaaaaaaccctcactgttcctcggcttcctcggactttccatttccctaaaatccctaatcttccacgtctcccactggcgatcttgttccgacgatcttcttccgatggcggacctcgaccaatctttctccgatgcggcgcgctgaagaagctgtacaccgagggggccgtccctctgaagcagaccatggcttgggaagcaagaggtattgatccttcccccatcctaggtcgcatggtagctctagaggatttcgtccgctgtggttttttgcctcctccttctaaattccttttattgatcttgaacttttacggcctttctctcttgcatctaaaccccaactccactgcctttttgagcatatttgctcacctttgcgaggcctacatcgaggtagtgcctttcttagatcttttttgctttttctatgaactccggtggatggaagccaatcgggtttcaagatgttgatggtttcgccttcgtgatggcatgaaggcaagatacatctctttccaatgccacacatcccggagccaatggaggtcgagatggttctatctagagctcaaagaacttgaaccggttcttgtcatacccgaggttcagccggagcattccgagaactggacttctaaacctccgttgacaccctctctccaagcctttgtcaacgctgtgagcgaccttcgagagcaaggattgaccggctatgaagtcattaaggactttgtcagcggtcggatccaaccgctacaagcccgtgctcaccccgtgttcgactacacgggagcagaggatataactcgaatctcttcgcggggtatttgtccttatgttgtaatcttcttcctgctttcgacgatgatttcgaggccaaagcctaactcatcctctcatatcttcatttatttcagatctccccgccaacatcgtggcgcagcgggtcaaggaagtcttgatcagtccttcctctacggtcgatgaaacaccggctccgcgttgcggcaagtcggcagtctacaaggcggctgctatcaatgtaaatgagaaccagacctcctcatgtttctattccctgaaggcgcaaagtgacttcaactcctgtaggttctgccgttgacggacgttatcggcccccttgtcaaccaccaggcctccgcctcgttgaaggacaaggatgccgacgaagtcgccaacatcccctccgttccagccatcgcaggaggcagcgggacccagaggaagccttgggcgaggtcgagcgctcccgccggttctcgacagaaatctagtggctccgaggtaaggcgtatcattgtcgtcctttagcttctttcttgaagtgttagaatgaggtcataatttgccatcttactcaggatacgagcagtctcgctcctcctccgaagagaagggtgctaaagctgctcgccggcaagtaagtgaaactcttgactcctttcgtcgtcacatctgtaagttttactaatgatgtcccctgacattggcaggaaagcctcggcgatctccgcgcaaagcggggactaggcggtgaccagtgggtttcctgccgttgtcattccttgcgtggaggtcgctcctgttgtcactgagtccgccgggcctgccgtcgcgcctgtggccgcgtcgtcgcccgaactaacaacttggtccgatatgatggccgagtgccgccgcctcctcgagaacacttctcgggaggtggcggcccagatggatcgcgcggtggcccgtgcaacagcgtcggacggaaaggtggcccggctggagattgaactcgaagtcgccaacgacgaccttcaaaagatgaaggagatcgtggccagtaacaagatgcagcaccagggcttggagaagaagatgaacgacctgcaggaccacctcttctccctccgcgactccctccgcaagagcttcataggccttcaccagctagccttggcgtgtggtgtgatgtcttctatcccgacgcacctcgacgagacgtccttgacgttggcgttgtcggagctggcgggcgagatggaggtcatcccgtcgcggcatactgccaaggtctcgaaggaaatctccaacgggattcacacagggcgtgtcacgtcctcgcgtgcgtgaagctggctctccctgtcaccgatctcaaggagatcttgtcgaagggggcagcagatgccacgcgcgaggacatgtctctagtgtgatggatctcggggagtgcgtcctccccctttatgaggagtaaacttttttttaccttgtattgtagtttttgtacaagtacttctgttaatctcctaggcggagtgacttccttctcttcacgtcacttgttaatctgtagcgtcttttattcttcatagctgtgtggattccgaggatgtccagcaatgcggatgtcccgatgtcgcgatgatcgacttgccctctttgggcgatatgcctgctcccgatgtcgttacggatgcggttgtgctcggaggcgtgggcgcggcctctggcccgtttagtccgggcatagtcgggctccctcgcgagaactcaggtgtgatgtcatagagaaattgtccctttgagcttattatcttattaaggaggcaacatctcctacatccttgtccttcgcagatctcgaaggtgtcatcgccgaacgagacaaacgcatcgcttcttggaggacaaagtttgaggtcaccgaacttgggctatcgctcgtggtcgtgaaaaaagacaaggccgtggaggctctccgaggtcgcgaggtctggatgaactcgtacctcaagagctgttgtaatgccatggccgacatctaccaccagctgagggtcgatcgcgcggaccccgaggagaacacgacgggctacttgttctagctgaggggggcgtgtgtgttggtatttcttaacgacattactagaaatataattcccagcaatggcgcagaaatacttctggtatattatggttacagagttcatccgcaagcgcatggatataccattgtagcatttcgcctgagagtattccaagggtatcgtattcattttatcccgtgggaagatcacgtagagagaactcaactaataatttatataatacttgtgataatcatattctaagtaggggttaagataatccaagggtagagtgacacacatgcattactactcataataaataatctaagctaggcgaaaagaaaagagaaagagaatctatttctatacttttaatatacatagtatacatacattctagttaactgatatactagctaataccttctatccgatgccctcctggtacttcgagaagccacccctgactgcctagttccttacgacagctcgtcatgaccatccaactggggctaaatatggaggagtaccctccccaggaaattaacttaggattatatataggcgtggaggaatacccgtactgagctgtcaccatcagaggcccacctctcatccgcaatatataaccccaaataatgatatcctgtaatctagacaccacgtctaaactaccagatactactctaatatcatcgtcatgacatagagtaattgcataagcaaacactatacccgcaccaaagcatgcatctcccagacaagctagcaatatattcagtataacaagaacataatgtaaagttggtactcatatactcggaaagtatttcaataccagaaatgtatttagaagagtattctaataaaagtacaaagcttacaaaagaggaaaggaaagctactagagccatacccgaactcttccgaaggcttccggactcctgattcctattctaattctattccaccagctatatactactaaactaaacttgagaggaacgagagagctcttgcttgaggtgtgtgagtgaagtgagaaggtgaggggtttatatagcctcccaatgacggttgtgacggttggaatggtcggaaataccctccaaccgtcattgggagctaatccacactgtccagaagaaaccctgcatccagcggcgaagaggggggttcggccgaaccaccaggttcggccgaaccaccaggttcggccgatcctggggccggcccaataagcccaaggtttggctggcagcctcctctgttgttcttctccgcagacttgtgaattttggcccagtttgtcgtgtcaattctgagttcttggcccattcatacacaagtttggttctcgacatcgtccgattgatttatcattggagttgatctcgattctccttcactttattgttattctctgcaaaaggttagtaaacctaatactagtggaatattattattctaacaagcatatgcattgcaaccatcactagttctcctctattttggtaatattgacggtcgaaactgattgataacgactatcaacagtgtgctcagcttgaaggcattggacagtggatcgacatcagcctaaaagaggagtgtcgccgcgccagccgttacgccggaggtcacgtcctcgcctgcatccaagatcgccgctcgcaaatgtacctcagattcttgcgcgggggttttcgccgttctcggttatcggcggatgagatcgaccagttggcgtgatcccttgctcctttagccgaggacgttttcgcttccatgaactggcagtggccgtcgtggtaggcttcattccctatagaaaaatatctaaaagggggtttataatacattgttatctctattaagaacttgtaatcaaagtagaaatctatctagtaaatgcttaaacaggttgtgttgtgagcgagtactactctttttacaggctgcctttggcccgttgtcgagtgaggtactctccctagccctaagccttgtcctcggggaaacctgttctcggaggggaaggctcgatgacccgtaacctgcctagctgaaaatgcaatttacctagcccctagccgtgaagttggaaaaatcaatttccgattacacggcttagttaatacaccttttgagaactcttacatgactaggtcttacatggtcgttcggctcttagaatctgacaagaccttatctgctctgggcgtccccagtcgaaattctcgtaggtttctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8235 - DNA, 673 bp, Oryza sativa
gaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggatta

SEQ ID NO: 8236 - DNA, 634 bp, Oryza sativa
tacccacatctgcgcatccagggacacatcgtgacccgagccagctgcgaaatcttccagaccctgctggcgccgcacagtgcagaatcctcgaccaagagcaccggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgca

SEQ ID NO: 8237 - DNA, 1326 bp, Oryza sativa
ttatatatatatatatatataaactatatatatatataaaccatgcagcaacagggccatgcaaaaaaaaaaatggtcagctcgatctttagtcccggattggtactcccggtttggaaaccgggactaaaggggggttacgaaccgggactacaaagggtttctccaccagtgtgatataaatactttcatatttgcacgaaaattttaaataaaacgaatggtcaaacgttggtcgaaaagtcaacggcgtcatacattaaaatacggagggagtattttgcaatactttggtcttggtcttttgaactggtgtatgctatccggctaatctcatagactgtttatatacttagatggaaccgtaagtctcatggcgttactaaatattgttactgttgttttttattgttaaattgacgtccaaagattcaatgatcggacgttttaatatactgaacaatgattgcaaaaatatattcatttgttgactatttcttatgccttaaccattatcaaatataagatatgatctctaacgtactatatatatgcgcaagtatgttttgtggttctaaaatgacaaaatgacctgctatgcaacgcgcggggcaatgaactagttttacagaagttcatccccagagaggatcccagttctagaagggtttacatgagtcacaaaatgggtgcaattgttctctgaaaagaaagctaaaagaggcaattatgttcaaattaaatttagggaatgagtggtatgacaaaatccgtttataaatcctgtttctcaactatactacattaatcagcaccaagaatggaggatagtgggttttagagttaagaaggaatctaaattaaagtgaccagagagatttagttgagtcgacagataagctgaggaatgtcttattaatagatgaaccagatcagctaatttgtccacattagaagaaggggcttataaaacaaacactataaatgtacaaatcgctaaagtttcgatgggtgagagacgggcgtgatggaggtctagaagagtaaaattcctccaaaaataaacactttatatacatggctgggagagagaggctggccaagtgatgttcagctagtaaaaagaaaatgaaaaagaattttgtaaaatgtgttaggaaaaagagtctactaatcatgttctcctcaaatgtcccattgctacatttgtgtggtgtatcatcagagatgctttagaactatcatgtttatctgaacgttttgaatattttaaatttcatttgcaatagtttttttttttttttgggggggggggggggcttgtgt

SEQ ID NO: 8238 - DNA, 4458 bp, Oryza sativa
atgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtgtcgtgacttagcagatgtttcttgtatcaacagatggctgaccgcgatgaggaacagatattgtacgatacaatcgcggagggaagcatccattactggaatgaataagaggggaacgaggatccaaaccagtgcttgaacgaggaacggaacgtggtgagggatgccgggggaaccagaagtgccgtggaaagggatgtggaggggaaccaggaggaggaggctagtggtagtcaaccctccgttggacagaagagggcactctggcaacgaggtgcagcgaaaaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggattagggatacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgttcgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcatt

SEQ ID NO: 8239 - DNA, 1733 bp, Oryza sativa
  unsure (1)..(1733): unsure at all n locations
aaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatacaatagtcaattataattagcatatgaatgctagtaaattaaatgttaaaaactctaattaacgtacatatgaaattgccacctgtgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttactccttgcaagaagtccgtatccctaatcctcgctccgatcatctctctaccggtggcgctcatctccatgtacagctgatggaacttgtacatttgtgtgggtagggactgcagcagctcaagcttgacaagccgtttacccaggtcgtacatgtatttcactttccgncttttcgattggtgcgactctagcaattgatccgtagttagaccggggtcagaaataaaatggtctatcgtcatttctttaccggtaaccaacggctcgatctccttgtttggttgctctccaagctgagggactgggttggacttttcagaggatgctttcttcaacgttcgctcatagtccgatagcttgatggccttcttgacagatgcagacatacccctgaagaagttcttgacactggggg

SEQ ID NO: 8240 - DNA, 965 bp, Oryza sativa
atatgttggcttccaggcccctttcggaacactactttaagatctttaccatagcaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttttgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaactttcagtcctaacgggcagacta

SEQ ID NO: 8241 - DNA, 3200 bp, Oryza sativa
actttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttatttagcaaatgaactaaatttctatatattctttcttccccacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttaacatctttagtcccggttggtgttatcaaccgggactaaagataccgggagggcctgacagaccctgacagcattcgaaccgggactaaagatcatctttagtcccggttggtaacacaacccgggactaaagatcaaatatgcccgttacccttttgaaccgggactaaagaacatctttagccccggtttttattgcatccgggactactgtggaaatcggccgaccgacgaaagatggtttctccaccagtgtcatgcttaaagaacatttgatgatgaatcgagtcacaataaaataaatgttaattgtataaattttttgaataagacgaatggtcaaacgttggataaaaagtcaaccgcgtcatacattaaaatatggaggtagtagcatgtacattacataggtgaactgatgagccataaatattaatttcagcaattccagacaattgcaaaaataaaagccaattctaggcaacttcacaaataaaaacatatagcttggttacttacatctaatcctatatatgcaggtggaaaaataaagtgagcacaaaccttagcatattccatgtgtgattttgtaataaatgcttgcatgaaactataccaactctatggaatgaatccaggaagcaaaaagtgcagagaagcgtagttggaagttcatgaaacatttttgtctgatatatatatggaggcaattgcaggttgttggttaaaaagaaaaagaaatcgaataacacaccaaagaaatcttgcaaagttattttacgttagtatagtgaattatttggattgatcagagatggtaaagaaagaagcacttggggacttggagagatatatatgtatagagagactgggaaaagaggctagatatattgccgcgctgttcttaaatcacatggcagctcggtaggtgaggctctattcggtgccaagggtggatttagagtgtaacaagtgagggccttggcccccacttaaatttgcagtgagtggggacaaatatcccttgacactttttacttccttaattagtctacctgagcggtagatccttggcccctactcatgctactttctgactccgcccctgttcggtgcctgcttgcatggatcgaccttgtcagatgtagatggagacagtggtcgcatcgttcactacctgtgattatggatgagatgatcttcacaaaatatgggaaaattcctaatggagtattgacgaagatcgatgccgctcacctgcaagcgaggcaaataatttctgccgccggtgccttttgtgctcgttggaacggacgcaaatggacgctacggcctaggagaaaggtgagagtagaaattacggagtacgtcgataggtgatggctgggcttctattctatatatgagagctgcactgttcttgggcttgatctgtcagtgttcagaacttcagatagcttagaaaaccagatcgctgttggatggaggtgtcaattaatcgaattttgtttgatgacgcggcttcacctggaactgtgcacaaggtatgcacgtcgccgtcctcgtacgttgccccctccggtggataagaaacaacagcaaaccgcagacacagtacacggatatagcgtgaaaggcaccgaagaaagaagaaggctgcaaagatcagtacagaacccactacgatacccataatgcaaacgaacacaatccatgcaggccgctgaagaagtccgaatggtaaaagcgactcatatcctgcaacaatgatttttaaagtatatattaaattttattttgcacaactgttgagcagaaacgaagtagaactgatgataataataaatgagtaaattttgaaataataataaattagtgaattttagaaaactcatatattttgcggccagtgtaacacgtaaccacagctccttacttattttatcacataactgctgtttttttcttctggtcgaacagggcatggcggcggttcatcggcgccggtggcggagcaggccatggaatggagagagaggccagttccggcagcacagtggcgtgcggcgactccggtagtaatcttgcgtggcggcgggctcgggcaagggatgcgcgaggcagcgctgccaaaccagggatgcggcggcggtgggggggg

SEQ ID NO: 8242 - DNA, 8583 bp, Oryza sativa
catctcccttcaattatttataagaaaaagaaacacctagctctcacaaattctacctctaggtgatttacccataatagaagaagagatgaacaactcaaagagggtccaaatacagagccaagtgataagcatgcatttaatttgcataagattagtttttttccgtattgtggcctaagaaccatttttggagggaatgaggaaatttatcactggattcggtaaaacaatgtgaagggaatggatttattgcacccataagtgaccaaaaaaaatcaagcataccttgaaataagatttgatattctcatttgaagtccaatgtgacaatcttacagcaagaacaagagctgatagtaataagactattgaatatcctgccatcacataccattctggaactatcaagcaatgactcacagtcacaagtcacaaccccttcccttccaaatgtagcaatgatgatacttccaaaggctcttttcggtgtaaagatgtttccaaattgatggattatttcagagggattgcaaggtgctcaattggacatggtattaccaaattctaaatgggaggatgtctggttggatggacccccaatctattttcagttcctaagactcttcgatcatttgctgttgatggaaatgtttctgtgaaaagctttatactatctaatcttgaagacaattttcaactgtctctatcacaacaacctcatgcagatttcttaaatttgagggaattgataaatgaggtgaatgtgggacatgattgtgatcaatggaactacatatggggcaatactagatatacttctaaaaatttctatgcactaaacttcagagcaatacaacctcaccacttttgttgtactccctcagtttcaggttacaagacgttttgactttggtcaaagtcaaactactttaaatttgactaagtttatagacaaatataataatatttataataataaattagttttattaaatcaataattgaatatattttcataataaatttgtcttgggatgaaaatgttattattttttctacaaacttagttaaacttaaagcagttgactttaactaaagtcaaaacgtcttatagcctgaaacgggggtagtaattattttctattattcttatcaataagtttccctaccgtgcggaccttccctgatgtgttctattacagaaaaatatagccatgatgtgcccatgcgcccctaaaggcctgtacatccacagcactgggagtctgtattgtgcatgcaacactaaaccctaaactccttctgaagcaaggaacattttcataaagaacaataataaagaagtgcagtatttgagattttaaatccataagaatattccactgaagtccaaaagaacatatacaattaaatccctgtggaacagcttgtttcgtatgaatttttacaaaaaagcaaacgtaaggtaagacctcatgctttctccttctgtcttgattttcgatatttttcctatcatccaaataattcaaaatattcccaaaatttttatttgcttggtgcctatctgccaaagttaccaaacacaccttgttctcgactacattgaggagtgcctcggatgaaatgcctgagctgcagaataagtaatgatcattatctgttagacacaatgcacacaatgtttgggtgtaattatccaggtaacataccgatatttagatggcacttaccctacatcgaagatgggtatccaaaacgtgtcgcatgtctgtgtgaacaagtcaaaggaaccaaagtcgtccagtccagaagcagaatagttggagaggctggcttggtgacccaggaaagcggcagagcagaggctcaaccccaagcatatcatatttcataatccatatgcagcaagaagcctgtgttcttagtattcagcaccaactgtgtggtgatggcccccttgagtgcaggggtctctccagcctctgggaaatatggcagtaacttcctcagtttaagctgtgaaccatttttggagtgaatgaggaaatttatcacttagatttgataaaacaatgcaaaggaaatggatttgacacccataagtgccataaaaatcaaacataccttgaaagcagatttgatattcttttgacatccaatgtgacaatctgacagcaacagctgttagtaacaagaatatcatcacaccattctggaactatcaagtaatgcctttccttccaaatgtagcaatgaggaaaccgggcacccctgaacatcctcagcacacaatccgttaagatgcaaatgactggaagtctgcattgtgcatggagtggacaaacaatttgttactatacttctctgcttgtcaataagtctgcaatttgcattacctctacgtctctgatagtatcgttataatattttgtgcaggtataatttctcgttacaatgcacagatcctcttcatccagatatgtatcttccatatcataaaccttatgtcagttccatatacaggtgctccaggatagtataaatctcatcaaatttgggatggtagaagtctcctgctaagaactcatgaacaacactatccacttcaacccagctgcaccctgctgttttgtcaataacctttctcctcatcgatagctgcacatcctcaacagcatcccattgctggcctcgagctagggtgtttctgaggagaacatagttgccaggattcttgggttcaatcctgatgagttccttcgctgcaatctcaccgacatcaacatggcaatgcttcctgcaggcattgagcaatgctccccacacacctgcatgtggtttcactggcattgtcttcacgaaacagtgcgcttcttcaatgagcccagctcgaccatatagatcaaccacacaagcgtagtggtctggggattgctgaactgcatatgtggttttcatcaattcaaagtagttctttccgtattccactagcccggcatgagcaaaagctgatagtacgccaagaaatgtgacggcatcaggttgcaacccagagtcaaccatcgattgaaaagatccaatgcatctctggcatggccatgtgcgcaaaaagcaatgatcatcacattataagacactgtattctttggatatgtctcagtaacaagaattgagcctggctgatgcaaccgcacttggcatacatgtcaatcaacgaattctggacatggcaattcatctcaacacaactcttctgtaaaagtccatgcacttgccctgcaattgtcaaagaaccaagctgtgcgcacgcagacataaaacagccatcgtcgcagcatcaggctcgaaccctgtcgcacgcatcctattgaaaactttgactgtatcagccaacgatccttcctccgaacatgcggcaatcatcgtgttccagctattcacattcctcactgtcatctcatcaaacaattccctcacagtggcagtatcccccaaatgcagataaccggacatgagtgtattccacgagattgggtccctctctgccatcccatcaaacacctcttcgcgcggctcccatatcaccggcccttacattgcacgccaccatagtgttcccgaccaccacgttcttcacgggcatttcgtcgaacaccctccttgcatctcccaccaggccaatattcccgtacagatcgagcaacgcagcgcccacgtgcacggaggagcagcccagcccggccttcgccaagaacgcgtgcacctggagaccctcatggacggctcgcaccttcgagcagcacttgatcacggaggtcacggtgaaggcgttcggccgcgggcccgaccagagcatgagcgcgaacagcgcgaccgcctctcccgcgacctcgagggcgtgcgaggaggacgacgaggcgtgcctcgcgtaggcggagatggtggccgtccataggtacacgttggccgaggcggcgggtacgctgtcgaagacggcgcgggcgtggcgcggcgaggacgacgacgcgacgagcgcgacggcggcgcgggcgggcagcgggaggccgcggatgaggaggtgcgcgtgcagctgcctcgccgccgccgccgccggggacgtcgcgccgcggcgggcgaggccggtcaggagcgcagggagcgggggcggcgccggcatcgagaacggagttcgcgcccgcgtctcgccgccgccgccgccaaatggctttgcggcatgaaggtggagcgcgtgtgcgcgcgaggggattttgctcttctacactgtaaaatttgatacggtctcaaaaataatctttggcttatgatttctcaaaggtttatagcaaaaaaaaatattaatttcaaatatcaattcaatgataatatcttcagcaaataaaattttaatttatattgtactaattatgggtcaaatattttagtcaaatcttataatgcgtgcacgtcttatattatggattggaggaagtataaatatttaaatatatttaaatatcaattttcctcgagcaaaaacaataaggcatattgttattgaatacatccagtaggtggattattcaatctgttggatatgatgacaaatgttaaaattgtgtaaaatagtatgaaaaataaaatatggctttctttttctgaaattgacacttcaaaaagttattgtgtatttgtgtatctccaaaaaaaaaaagaatcttatttcgtaatggtttcatgaaggcttaaataaaattatgattctcatagatctcgtttaacatgtcaaggagaaatgagtattacaacagcacacattagattccaagattacaaacatcagcaagcccttttttttttgtgcatgcttgataatttatccagcactcatagacccaaaaaaaaaaaattgcacccttgtttattattactcacgtcagattgatgtctatacaagttagggagtactcccaaattattttcgatctataaatggcattatggcactacaaccttggcagtatggcactcttcctttgtcatctcagtcatctgttcaagttttcttatgcttttccatgcaagaacatgtgaactggagactggagactggagagactggcaaattataacgttgatcacaaatccattgttcagctgtttgtcccttcatctattgccctcagagtgtggcgaatggcggttgtttgcaccagaaccagggtaatcattgagctcaaaccccatacttccactacgggtgaattccgattcttcaaaatcgatagcctgaacgttttcaaaagatcatcaattcagcagtgttgtcagattcagataaacagactgaacaaaaaccagggcggtttttccatgtatatatagctgatcagatagtctccaagatcttatacattatatatagcatcacataaaaggttttcgaatctacttcaaactgctgtataaactataaattatctcagaaatcaaataaataggacccatgaatcaaaattgaaacatgagggagaatagcatctatatatagactggtttacacaacttaaaagctgcagcgagaacaagcagctagcatctctttgaataaactgagcaaaaacgaggatagatagcacatctaatgcatgatctgagttctgaaaacaaaaaacctgtattacctcagtcgttgcatcagaggttggagttgctttgctttcctgtagcactcttagacctatgaatggcaaaacaaaccaccagaattaagaagagattaagatccatattcactatgacatgggatagagtttgagaatattgccatggggaggttcactacttgatacatgaatgaaacaacacgaaaccaaaagcaccatgactatatatggcaaagataaattcctcatcctcctacgatgtcctgtgcatatatagttgcttctctaatttctgtgatgtttgcataggacagtgaattcattggtcttatatagcagcttatcatggattaaaattctttgctcaaaagttgtccacgatgatgtgtagcccatcaatcaaagtccaactattccctttactttttccatgatccactttcttgcaagtgaagtgaaggaaacatttttcaactgagactaagaattgtgtgcacacatgacatgcctctggcagttcaaagggagctctctttcgtagcaaaatagcaggtatgctttctcttaataaattaaatatagagaataaagacaccgaatcttggtgattaaaattcttatatgccttgagtatgagtacatgtgccacagtgttacagccccactacagcgcctcagtgcaacagtataccacaaaatcactggtttatgacatggtgactactgtggtggaacttcttttgttattgactattctactacaacactttggttgatcagacaaaccatttccattatttgtacctttgagggaaaaaaaagggtatttcttatcctgaagctgctgcatcatgcatgtaaagttagtactagtcattttcagtacctaccaacttattttcttcattgaatatgctagtggtgggttcagcaccaagcattcagaaaatgaatgtcttatggaaaaagtaaaactgcacctaaatcaaaatctccacaacaatagggcattgacaatgcaaaaggcctaccggcatattagtaatagctaaacatctttctcacttcttaaatcaaagaaaaattaacttctagatgtaacctgaaaatattctcaaggacctaaaaggcaccaaataatattgtgttgatattaggggaaaagatagatgaactgtatcactgatgtaggtaaatctgatttctcttgctccaaaaaagataccgaaaggtaaatgaccaaaattgtactgtcaagattttttctctgtgtgctgtcatcttttgccagatccgagtcatattccaccgaagcatatgcaattaggtaagacaatttctaactgcgctcccatagtgtgcgatgtatcggtattgcactatggttaattggtaattttgttaattacttccgtatagaggtacagaaatttagatatactgtgcataactcagttggatacaacggaagaagatgaatgaaaaagcagctcttgcaaacaatgatgaactagtatacacaaatttgtataaagttcacattaaccttaaacaagaagctaattcacataaaaaaacagtcaaatttactattaagtgtaaaactaaccaagcatacgcaagagaacattgtggaatactctgtaggaaatgtaatgcacaaacccttgcagtggaattggttcacaaataactactgttagctctatattattgacagattgagataatcctttcataaggtgccagctctcataagcatgtcatttattttttgtctccagttaaagcaacatgatagagacatagattaaattgcagctcttcagaaaggtttgggtggggggagggagcgggtgggggatgttttgcaaacccatgtttaagagaaccagcttcatgtcttttcagcacaactgcaattttgttctcacacaacatctcaattgaacatgtcacttccacaataccccttaatcaagagcaaaccaattcaaaattggtccaaattggtttcatccaggccagccaggcgagaactaatgaagtgatttcatcaccattttcatattattgacatcctcctccgtactctcatacttcaccggcttaaacagcttccacagcccaacaggatgccgccaccgcctcacctccttccccttctccctaacaattcccccgaaaatcctctcgcactccggatacggcttcacaaacatattgtagaacctctggcgactgaacctcacataatgcttcatctcaattgggtcaccgagcccgccgattgaccgcaggtgctccaccacattgtgccgcgggacgatccgccgctcgaggttcacccccaagaactccgggaactccaccagccacccaatctcgaaccccatcctgctcaccaagaaatccaccttcctctccacatcctccaggccgtacaggatcgcccgcggctcggcggcgaggacgcgcagcgcgtcgcgccgtgtcagcccgcgcgcgtgcaggagctccacccgccgccgcgccgccacggcggcggcgagcgcgccgcccgcgaggacccggtccctgacggcggcccggcaccggagctcgtcgcggacgagccccacgaggcgggtcggctccccgggggacatggagaggaggaggccctccgcgtcggacgcgagggcggccctgatctcgcgctccccgaggcgcaggccgcggagctcgtcgcggagttggcggtggcggtggtggtggtggtggtgcggcagcttcgagctggtggggaggccgcggcggaggagggaggcggactccgcggcggtggggccggcggtctcgtggaggctggaggtggcggcgggtcgtgggccttcttggcgttgcgggggtggggtggaggaggaggtggggg

SEQ ID NO: 8243 - DNA, 16753 bp, Oryza sativa
ataaaccaccgtttaagatttctccgttctgatggtaatggaggggttttcgtgttctcaaaggccactctctcggatgacttcgctattttgccattagagagagaagatttcttgctcgtgtgctatttttgagcccgcaaggcgccaagtcacccaatctaaggataaaatgaccatcttgcccttcttcttcatttctcctcccgtctctttcatccccttcctttcccaaggcgccgaggttattgggctccggtgagctccttgccttgcactcttccctccttcgctccgctctttcttttgtggcatcatcggtgtcttgctccatcgtcatcgtcgttgcctgcctcctcctctcggctcttctccactctcccacgacgtcaagtcgttcgccacctagcgctaggaggttggtccggcggcggtggtggcggtgtcaccagctcacacgtagggaggaaggttggaggagagagaccccgagctagaggaagaagaagggcaaaacggtcattttaccctcggattaggtgacattacgctttgcgggctcaaaaatggcacacgagcaagaaatcttctctctccgatggcaaaatagcgaagttatctgggagagtggcaaatagtcctaaaaacccggtgatggatgcctgaaacggtgtgggtatgaactggccccactggtcagtgactcatctatgaggcaaaactcatcttggctataattaagggtggtaatgagcccaacatcttgacaaacaaaatgtgagggttgggtaaaaatggttgagctgaaatttaaaactccctccgttccaaaatatagcaattttatactggatgggacacatactaatacaataaatctggataggggtactatgatgtgtcctatcccgtacaatgttatcatattttaggacggagggagtactattttttttctataaatattaaagagttgaggtgagttgtgaaaggatccatgagccttgacccattaccacccctagtgggccgtagcaatgtggacctcacatctaaagcaagcaagcaccatgtgagccatgcaatcaaaacgagttactccctcaggaaaaggtcatttggttcacgttttttaaccataaaaccatatatgaagactttcctaactattaaaaccggcccaattgacctccctatccttgtgttacgtggcagctacgtggtgcatgcttacgtggtattccgatggtcgggacgacgtcgcgaggagcgtcaccgaggggatggggggtggtgggtacgtgcagatggtggctccctcaggcctcaggcttggtgaccgaaagggcaacaacggtgttgggacagtggccattgatggtagtgccgagctgatccctacatccatgcacacgctcgatgagtggaagtgattcgatctagttggagagatcggagggagagagagaggaccagctatacagatatagagaggagggatatggagcaggtggttaccattacctctctgcaccggtcactgggttccatccaccacggccatctagaccacctcagccaccagtccattggccccattaggtgtgagcccgtgtgacaagctcaagctcctagtgcccgccttgtcaagcttgagtattgcggcgacgaagcaatactcaacgcaaaaacctcaccggcacctacagcgatgaagcaaccttcttctcccggctcgtcaccaaccacgtgtcaacagtccactccatcgatccatagcattgacgttagttaggatcgatccatgccttcgtagagcccgatgccaccatgaaggagtagagttcgaccctaccagtggggatagcaagctccggcgtggagcaggcaaagatgaaaaagaggagacatgtgatgggggaaagaggagaaaaagtcccattgacatgtggggccaacaactctttttttattattgtaataacatatcgcttgaggtaaaatgaaccccacatacgacaaaatcatcgtcgaaaccgcttgaggaggaaaaataaactggttttaatacctaaggaagcttctatatgtggtgatgaatcgaactgcggctatagttgaggaagttaaaatggactttttcctactccctctcgtgaaatcgtgtttttgcgataatacttttgaagccagatttataaatataacttccacgtgagcaacaacttttgtgtattcatctcaagaaaagaaaacgagtacgtgttgatacgaactttgcattatccagacagagtcacagaaatcgctgaaaacaaacatccacgaaacaaactaccacatgaaacaaagtgattttgacagtttgtgggaggccagcttgacagttgacaccatgaaggaacaccatacagcagtcctaaaatcggaaagaaagtaaataaacaggtagtaaaaaaggaagctgcaagacatcagtagcttctcatcaatacctggtagtaaaaaagaagtcgaaaatgaaatctccatggatgtgcaaagcaaatcacatacccaacctaatcataaatgtagaccgcatcagattaactttctgtaaatccacatagaaattgtgctaaaataaatctgactttcataatgaacttatgaacacaagcagttccactgggtcatgtgaaatcagttgagacttccacagtgaacactgaacagttgaccagatttagggggtaataattttctagtaataaacaatgcatatttttccttgtagatgatttgttggcaagcaaatcaaacttcatcattttatgaatcgttatagaggaatatatgcatgaccaagtagagtgtattctttttttgtcattcggagagtgaaaataagcattattctcatgcttttcaggggaaattatcaaagggtgagagctcaaattgtcatgaaagagatgccaatatggtagaggaagagcttcatcttttctatgaattttagtccggaatgtttcggttcttgatatgctgtaacttgctagaattttaaataatggaattcatcctggccttgacttcagactcagagaagctacggccaacaaggaacttgctagaccacaaggtgataataataaatccttcaatccttcttgaaaaaggttgtttctgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactacatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaagagatcaatactcatggcctcgtcgtccagtatggctgccacaaatccgttccaaggccacccaatctcagagaagcttgggaaggcaaatcatgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacctagcccatgaagactgggaagccaccgaccagcaagttctggggtaccttctctcgtcgctgacaagagaggtgctgatgtaggtcgctacatgcgacaccgcggctgaagtgtggagcgccatcgagcagatgtactccacccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcggcggccatggtcgccgcaacggaggaggtgtccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaagagtttcaagtcatggtagaacgtcaatttgatagaaaaattctagccatgcaaactgattggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttttcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgaaccacatagagatggtgcagtacatcccgctgatgcagaagattcgccggcgacgcctcctctggatgccagttctggtccagaaccagaccgtgtcgtccaccactcccctgcggccatgtcatcaggccatcatccgggtcccacacctggttctgtgccacggggggcagcatcatcgctagcagaggacacagcagaagactcagtgtcgcaggcggtgcaggagcaggagtcgcaggtggtgcaggagcaggagcagtcctcaccagcgtaggaacatgcacaggctgtcacagatgagactaatacattacagcatgcagatgtgactgacacaggttcagaggcaccggcaggaccgcgcaccaggttgcaaagtggagttcgcaaagaaaaggtatatagtgatggtactattaaatataagcattcttggtttactgcttcaggtgaacctacaaatgatttagaagccttaaaggataaaaattggaaactagcaatggattcagagtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagaagtttatatgctacagccaccaggttttgaggatcctactaagccacatcatgtgtgtaaacttgataaagctctgtatgggttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccagctcttcagagagggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgatagattgtaaacctgctaatacacctctttcagtaagtgagaaactctcccttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagtcagtggcttctctgatgcagactgggcaggctgtttagatgacagaagatcaacaggaggatttgcaatatttctgggttcaaatctggtctcctggaatgctagaaaacaagccactgtgtctagatctagcatagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacagtttcaccttggaattgaaccttgagcaccgacaatctatcatctgatacccaaatccatttgccgaaagagaacagtatcagatgcgttgcaggatagcattggatacatgccatcaggggaggcctgggaatacaggttctgcttgaatacctacagcgttcggtagtagtagttcccaaccctctccctcgttttccgcgcgcacgctttttaaactgctaaatggtgtgttttttacaaaaagtttttatacgaaagttgctttaaaaaatcatattaatccattttttaaaaaaaatttagcaaatactcaattaatcatgcaataatagagacttcgttttgtgtgtcggggaggaggggttaggaaccatgctgaacaagactcatttttgttggagatgggatgcatcgggcccttactcttccagatcagcctacaagcgattcttcattggtcgtgccaagtttgagggagacagacaaatgtggaaaacttttgcgccgcttcgctgcaagtacaatacccttcacaagaaagagcggaacagcagagtgttcaaccgggagatcaaaaactaggtgcagctgatagcaactattgtggatgaggtgcatttgtcgatagcagcagaaggaaagctgcctcagctggtggtctgcttgggactcctgttaggatcataggatcatagatttgttttctatgagacggagagtgtatgtaaaagcgtggctaactatgtcttctcttcttaatacaaatatagcaagccttttgcgtgtcctaaaaaaagttgtttcgccatggcattatgtaatatttgggcacaaaggaacaaatctgtatttgaaaatgcccctcctaacaaggtggaaaatgccgctacttgttgatttggaatgattgaaagacggaatcccgcattgatgattagatttctaacaagatggattggtttgtaacgaacagaaagtgaatacaccttgtataagcctcacctgttcatgaactatttattttgatgtactgttggcatctcttcttgtatcgacttactatttgtctctagatcccgtagaaccattgtagatatctttgtatcatttaattttgcatgacaaattcactgcatattatgtcatagaatttttgaaacatgttattcatttatcactttggacagagaatctctccaacaaaacatgggaataggaaaagaagtgcaagaatggaatgccctgttatctggatgtgaaacaagggtaatgcatgagaacttcataagaactatttgtatctcccttaattctgtggtggatataacccataaattccataagcacaatgctatttaattcatcatttttaagtatttaaatcatttaaccatttaacacagatgatgaaagccataatataatttttagggggttatctagctttcgagtgactaaaatctttgaaaactgtagtaacctttttcatcccttgaatgaaaatctaaccattttcagcatgtcccttgtttctatttaaacgcaatcccttcattataggctaaaggctgaactatgaattgttcttacttagacataaaataaactttaaattgataaacttagatagagtcaaagataaggtaaatcatatgcatacacaaaattgcagaaaaatgtaactaaatttatacattacaatttacatagcactgccagttttagggttagaaatctgtaattttaggtgatgaaaaattagcaactttttacatgacttaaagttagcaaaccccaatctttagtataacacacggtaattcgatgaaaggaatcagttaagacaagtaccatttactagtcggaatcccccacaagaaggtaacatcacctctggagaaaggctgctttagttctttcagcattgggcacttgtcaataagcacattgtttatttcttcaattgcttctggtacaccagtaaaacgaagctcttggaaattacagatctccaagtaatctagcaatggaagattattcctccagatactcccaggaataaacattgtccctgaaagcccaaccaactgcaggcggacaagggaggataggttcagtagacagtcaggtatccacttagaaatatccccacacctcaccaacgaaaggcttgtgagagtgggcggcaatgccagcccattttcccaactgattcttggacaatcacggatcaccaaagcttctaagaaacgaaaacctccaaatctttcagctgatatcaacgataactcctggcatccctttatgcttatcattttgatagccggtatatgacatggttgcagaaattgttcgatgcttgataaatttgtgcattcgatgatgtacaggttaatcaaatactggaatcctgtgcatggtaatctatgcaatgatatcttcttagcattatggcactcctcaaatataagcgatatcatgtttggtaagttgtcaggcaggaaccagctaggacaaaaattctctccttggtaaccagtgacctccaaatgttgaagatccggatgaggatgtaggttttcacagacttccaattgttcctgttcatatctagcatcctctgcaaattgagatatatggagagagtagagattattctcctttttcaacacagtaaggccaatattctttttacttttgagaccaggcaaattgacaagcaaacttccctgtacctgatttacatatttcaacactttgattctctctcctcttagaaactgcatgcgtgaatcctctcctgggagataactgaaatttttcgctctaaatttccttaggctgatcaggtttccaaagtcacaaggcaggcttctgaaaacacatgttgaagcatctagagtttcaggttatatagacaacaaaatgacgaaggaaggatgctgaaagtacgttggcttgagaagtaaatgtagccgacaagctttaagttgctgatgccctcaggtatatcttctatcatgggaagagaacaactcaacacacggatgtgttgaagctccttaaaccagctgccaagtacagaagcaaactcacctttgataaaagctttactgcacaaaagggtgcgcagtttcttatacctgcatagtcccattaaatcatggcatccaatatatctttttgtgaaaattgatagatggcgaacattggaagggattgttcgaaggtcatttgcattccttatgatgaagcattcatcttgcgaaactagctgtgccatatcatgcatcaagtcatgtatcacatatttgccgtgcgtcactttctgaaagaaggatcggcttagaagctcttcaaaatattgctgcacaacagttacagttggaaagctacttgcatgttcaacgaaaccttctgccagccatatgtcgactagggtatccttttcaaacctgtagtctttggggtacacagcacaaaatgagaaacacctctttagatggggtggtaaatacatataactcaaacgcagggcaggtagaatatctgtcctgtcctgctccaacttccatagttcactctgcaatatgttatttcagtgtgaagcatgcaaattagtcctcaaaagacgcccaatagttttggcagccaacggagaacccttcaatttcagaattatgcttctaccaatgtcctccagatctgggtatttggataaactctcagttccaaatgcttgtacaatgaaaaattcccagaaaacatcttcagttagaccttctaatggaaaacaatccattgtccgcaccttatcagcaactttctgtgaccgggtggtgatcaaaatcatgcttccttgaagagcatttgacaacggtgcacaaaacctttgccaatcttgcccaccatctgccatgacatcatcccaaatgtcatctagtacaagtaaaaacctttttaactcaacagtatcttttaaaatagactgaagagaatccaaattgtcaaatgatgtttctttcttggaagattggattacctctttagttaacctctttgcgttaaagtcatctgatacacatgcccaaaggatcatatcaaagtgagctttcaccatttgattcttgcaaatttgttgggccaaagtagtctttcctacacctcccagtccaacaattggcaagacctccactctactgcttcgcttgcgtttgtagccagcattagcttgtaattgtactcctaacaactccaacaccattttctcttcttcttgccgtccaaaaatctgactgttaagaaaagaacttgtttctggcctaacaattttgtcaaatctttgtgctgcacaatgcaagcccaagtccatagactgacgatgtagatggtctagcttctcttggatttctttcactctgttaaagcttcctcgaatgacactcatatagaattcctggcatccagacgatgttaggcattcctctattctcccctctatctttgccttgagctcatagtaattaaattcatcaatgatgtcttcagcatctagcaatgcatccttgatatgtgggaggagttctgcagctggttttttatagatttgccactcaagtatctcaacaaggttgcgcatttttggcagagttgtctgtagctgccataaatcgctttgcagatgctggatttcttcctttacaaaatcgttctgtggtttctgatgaatgttgatccaagagcatgcagatgaaatggctgagctcagacaattgaagaattcagcccatgtattgacgcttgtaacaaaccctgtggctgtctggatccctcgggcagcagctccccagctcattttagtgaatctcatttgcatagactggtgtgaagaacagggataaaactgggaatgtggaatggtagaagttataaaaaaaattccttaaaatgttgggtgcaccctcactgaaagcttaactcacacatattcctgcaagagcaagaaaattttttattatgtcttcacaaaagcaaaaggaagagaaaaatgtcacggagacatatggagtgcaaaccacagagactaccagccccatcgattcacttattcggggaataagcgaaacggcgtatttgtaaacgaaaaataattggtgaataaaaattttatatatgtgttctaagtaataacataatgctcttgaaagttttgctgaattacatttcaatgaaacacattccacgcaattcaatattcaaactcagccagatccagaaaaaaacaggaacaacttgtagttgcatagagtctcaatcgcaacatcagcaaattgtttcaagaaaacacttttagagggcgaaagacagtacataatacagatcaccaatagggatagatggcagcttataattaacctgaacccatagatgctgacagaattgtagccatttgatgttagaagcaaacatttgttcagtaaaacatatggtaacacacaataacagccccccgcaaaaaaaaaaacaaaaacaaaaacaaaaacaaacaaacacaataacagtgttggttttacggattacaggctcaactggtaaaatgatgaatataacctccaattacctgagaaacactccaagaaaaagcaaagcacttgcgctttgccttcaatctgccgctcccaattcttacaggtgaataaggagcaaggaagagagaaaaaaaacagcaataaaggctccttctgaaaataaacaacaaacacacacacacacaaaaacaacacatagataccattgtaaatcattgtaccaccaataactacacgatggccaaagaataaaatactgtggagtcatattccatctcaatcatggctgatgtaccttctgatattgcagtctaaaactgtgggttcataccagctcattgttttgagccaattggatcgaacaacagaataatattgataccattgtactaacaccacgacaaaattgatccaataggtcaaccatgaagcctccaaataaattagtaacatcaagaagcaacatatgatgtaccatcacattcagaaaaatataaagagctctttaatcttgcaaagtaatactgctaacatggatggattctaataagatgataattagaacaagatcccgtagaagataaatctaatatccaacaaatcggagtaaccaaggaccaatttaccaagatcagcattatctgaacatacaataagtccaccaagagataatacctcaccaagggatgaaagaatctcttacgatctctgttcttgattggctacaatgggttcaattttctttggatgctttctttttctcctgcgttagtcatcttgtaaatatttccattatatcccacttccacagtccactattcaatatattgctccaatgcgtagtgtctagattccttctcatcaaatgcccaatagttttggcagcaaaaggagaacccttcagtttgtgaacaaagttttacctctttcctccatttctaggttgttgttagaactcctagaaccaaacgcttgaagtttgaagaattcccaactgaccttatccatcagagaatgcagatgaaacaactaaagtaacacaggtaaagttttcactccatgcattggctccagtcacaagctccatgacagcagcaccccagctcatgcttaatgtatttcttgctgacttgagttaagatcatagggaaaattgagcaatataagatcttggaacagaagataatttgggaccatgacaaggttgtaagttttttatatacagaatgttcattattgcaccattagcataagcttacctagtatacatactactagagtgaaactccaatggtcaaattgcagagaacagcagctagttctacgcactttgtgtactcacctgatctatgcatggaaatagttagaagagaatccgtcatatattgacataacaaatcaaacgggaacatatcaagaggaagcacctatttgtgaagtgtgaagcacacttgttcaggcttcaaaatacacatgaaaaatgccaggaagttgcagataaaagaacataaatatccatattctatttttctccttgttgttcttgttcttctagatttgagcgagaaatcccatactgtcaaaagaggatttgtatgaatcgtttgttccccccttcccctgaataagtaatattgtgcccaattcataaatgcctccgcaaccccgagaggcaaaggagccaagcaactcactgtctgtccatgtaaagcataaccatttttaagaaaaaacaaaaagcaagaaaggtggtacaatcgctgattgcatacatacacaatgctttgcaagacaattagtactacaatattgcagccctagaaaggatgaaaaaccatattcgaagtagtgttgtctgatctaccaaccacctgaacacgcaagcagaagcagtaatcaacactgcatatgcatctgtgtcttgtgtgcaatttctcggatgcacatccggagtcccatgctcatgctcgtgctcccatatggcactgaaacgcaggaatccggcacaaaatccgcactccagtggtgatgtcatttggtcgattcacatatgaaatcaactaaattacacacacagcaccccatccccaatcggatgggaaactgtatcgcgacctacagtgagaaggtgattgggggcggtccgtgagtggtatgctccccaaatttttcgattcaagctagggagagcgaagatcacctgcacggtggccggccgccgtgcccgcgctacggcctttggtgtgcctgccggcgacggcgagaactgtggcagcggtgagaactgtgaacaccaggggggaggtgcgacggatgggacgagccaggcaccacccgcggtgaggaagcccgtacgcgcgtgctcttggggcgcctccgcgccattgccggccaacagcaagcggcggcgacaccgacgagctgacgccgccggcgaggccacggcgtcgcgtcgcgtcgcgtcttgggccgttgggcgctcgacgtgttctcatcaattaaatcggcccatgataagtgggccggagcagttaggcccaccgaatcttcaatttgtgggcccagatcttcccttgcgcagagtactaatcggcacggactggcccggtggtggtttgaaccaattctcgctaaaaattgaatacaagctggcccaactgttgagataaaaaatccttggaataagttcccctggactcccttaactagtggccgaatctcattcatacatccttgaaccataataccaaatatcttgccccctcccccccccccaaattttaaaaccggtgtaatttgactctctcgacggtttgggaggacggtttcgctgatgtcgcggacttaacctacttttcattctacatggtgttgaggtgacgcttactcggcattatagaattaaaaaatatgtggggccaatttgtcatt

SEQ ID NO: 8244 - DNA, 17631 bp, Oryza sativa
ccctaggcccacatcatcatctctccttcccttctttccccctccctctctctccccatttctcttcacctaggccggcgtggtagtggcggcaccaagcggcgacagcggcatgcgggcaagggacagagcagcggcgagccggcgactggcaggaggcgggggatccaggtggcgttgttgttggtgttagtgatatgccctagaagcaatcatagagatgattgtatcacatactatgtttacatatttatccgatattgttccttgaaatagataactccttattgtttaatgaatatgtgattctttcatgagactctttatgttgtttgttactatttctaaaggatccctgatcaaatatcatatgtggaacaaatatgtttgtttatattatcagcacatgtactaattgatgatcatgtctcatggatcatggtatagagataccaaattaataatgtggacacatgttggtgaacatgttgttggatagacccaacatgagacactacaagagccatattattaaggacatgtgtcatcagtgatctcatttagtgttggtgttgaatccttagacctgagattatcatggttctcaacatgtgtagtagcttacttaaggactattaaacgctactccgtaaatgggtagctataaaagtagttttcagatatgctatgaaacatgtagtgtgatataaataatcaagatgggatttacccctcctatggagagatatctctaggcccctcgatgttgtagattatggaagtgcatggccatgccaaaggtgattgaggagtcaatcacaagttatataatctatcaacaggttcagtgaatgattgagctattagaagatggcacatatctagccttaagcttaattgatatcgtgaggcaaaggggttcatacaagtatacactagaggttcagccgatatgatctttatgtatgcccggtgggtcaatacattctgctagggactgctgttgacgcgtggaccgaaaaggagttttcgggttacagccgagtatatatgaacctacagggtcgcacgcttaatgggccggaataaaggggattggatggagatccaatatgagcttaattcggatagagatctgaataggagtcctacgggccttggaggcccgagtgatggatcctatatattcatgaggggtgtgaccggcggaggcattgcatcacgtgagaaaccctagccgtcacttccctccccgagcaaaaccctagtcgcacgcgggtgctagcacatctgcgtgtggcgttccgtccctgtacgtgtggataccggtagaggcgccactggtttgcgatgctgattggcgtgggagtacgacgaggagaacgcacgaggaagagaaggtcgagccggtgcgatctactacttcccctacatcgacgcgcgctgcttcacgagagttccttcgcttctcagcgtcttcttccgctgcacagcgcgtcgagtggtaacgatctatgatctaatacttgcatggttcctggtttacatgatagaaaattttgatttatgctatcgtagcctacgcgtatcccaacagctggaaccctacctcgaacggcgtcgttgattccgcgcccacccctacccaatgctgccacgcacgactcctctcctcttcctctcgcacgcaacgccacccgtcgcataaccctaagcgtcgtcgttccgctccttccctttcccgtcatagctgcaccttccctctcatgccaacctcagcgtgcgccgccatcgaaactgacgccccaccttcgcgcgcaacgccgccggcgcccctctcggccaacctactccagatagactctgctgacgcccctccccaccaaccgccaccaaccatgtcgcgagacacctccgacacacctcctcgtcaaccgcgttgcgaaacaccttcgacgcccctccccctctcgagcgatgaccggacctagggaggacaccggtggtgagccagaccgggggagggtggtggtggcgagccggactagggaagggagggtggaggtggtgtgaagacgaggaagaggaatagcagccatggccggcgatggcagcggcgtgggaggcggctgttggagggccggccagcaatgttgctagtgggtttggaataggggtacgggtgggcggcatgtcagcttccgtgaaccgcgcgcaccagagcacgtccaccgtggtgagcggcctgtttggctggcaggcgagcagcccgcttagcacgtcgaaccccacggtgacggtggactggcacggtggcagaccacggactcagcaggcggcagacaagtaaagcttggccacaacttcatgtcgcatgcctaccgtgtttgaacaccctgtttagcttgtccatctccgacctccgggtaagagcaggccgccggtaaggaacacgcagatgggagaaggtggtggcggtggcagccgccgcctccatggcagaggtgtggtcgcgggccccagggggggtcgtggacgagagagcgtgagcgggcgcgcgagggacggacagcgatgctcttggcgtgcgggagcagaggaagcaaaggaaatgggacagatgaatgggaactttacatgtagatcccacgttaatgccacgtgaaatgaatgccaggtagagatggcaacgggtgcatacccatcgggttcccttgccccataacaacacccgcgatgactaaatattcctacttaaatacccacacccgtcgcgggtacaaaatcatccccatacaaacacctgtgcgggtaacgggtacccatacccatacaattgacttgtagcatttcttttgtattctaattagccatattaaaactgtaaccatcaatattttatctagcaacaatgctattaacattagtgtttaaagacgagtaaaaaattatacaaccacattacataattacatcataaaaaaatcaaataataatttcatataactagactagaacaacgcttaagatgtgaaaaggagttttatactatgatttagtagtcgtcaggacttatatttctcatagttttaggctcaatctatgggtttttttcacccacggattgatgggtacgggtgggtaaagaacggatccatacccacgtacctaatgggtaaaagttttcgcccgtcagcagacccatgggtataagaattataacatgattagctcctaatatagtaaaaacccgtcgggtgtcaggtcgtgggtccccattgtcatctctaatgctaggtcaacaccaccacatatgccgtcagtgaaactaccctccaaagccaccgagagagtcaaattgcaccggttttaataattggggtgtcgaaatatcaagtattgagggatacgaaacagattcgaccactagttaagggggtcaaagtgaacttattccaaatcctttatggggacactaaggtggtgtttagatccagggactaaactttagttcctgacacatcagatgtttggacattaatttagagtataaaatatagactatttacaaaactaattatataaataagagctaattcgtgtgacatatttttaagcctaattaatccataataagcacatatttgttgtagcatcacataggctaatcatgaattaattgtgctcaatagattcgtctcgcgaattagtctacacttaatatttctaattagtgttcaaatatccgatgtgacaagaactaaaaatttttaatcccctccaaacagcccctaaatctaaggctttaatcacaaatttgaattgcaaagtactccaccatcaatattaaaggttttggcttatttgaattttatataggtggaatccaattaatttttataccatggaacggccaagatcgacctagctttatatcgtcactacttaaaaaattggtaatttttctcatcgttactccatttttttcccttgcggcatctgcacgacgcgatagccatgactccgcttcctatgttcctttcgttcctgacacacgtatgtggcgtttggcgcgcctcatccgactggatataggtagggctaggttacgcgtggattatagagactttatacgagtacaaacattacatgatcattacatatgtatgatatagattatagatatgaaacaacaggacgcttcctagattttaggaggaacaatcaatcgaccgtgtgatgcgttatgcgtgggttgtgagaggagttagggaagggtgttgtgcagtacccacatgtcgatgtcaactctctttcaagagcatcggtggccatcaaatccaaaggacgatgggcttaaaagagagctgatatcgacaagttggtactatggagaagctgggcatcaagacggtgtattaaaaatattattatatatttatatatacttgattaaacttaaaatttagttagaaagaaaattaaaatagcttataacaataacatgaaacagacgtctagtagctaacactataaactaagacaagaagtacaacttattacaactgctcattacttacaacttattagtagtagtcagtagacacgacttgaaaaagaaaaggctgccaatgcaggtgaaaaacaaatctacgagcgaccgaagaagcagaagcaccctggcatcttctcctcctcgttcttcttcttcttcgtcgtcttcttcttcttcttcatcttccccggcgccaccatcccgccgccattgctcgtgtcgagcgcctccagcatccgcaccacctcctccatctccggccgcgccgccgggtcggcgtcccagcacctcgccatgacgcgcgccatggcgggcgggcagcacggcgggatcggcggccgcatcccccgctgcgccaccgccgccgacgcctccgcgacgctgagcccgaacgtgaagggcatctcgcagcagtacgtctcccacaggcagatgccgaagctgtacacgtcgcacttgcggttgtacggcttcccgacgagcacctccggcgccatgtaccccaccgtgcccgtcgcgccggtcatctccctcgggtcgcgcgcctccacgcgggccacgccgaagtcggcgatcttgaggtcgccgccgccgccgccgccgaggaagagcatgttctccgtcttgacgtcgcggtggacgatattgttggcgtggaggaagctgaggccgcgcgccatggacagcgcgaggcggacgacctcgccgtaggggagcttgctccggtagtgttcgatcaggtacttcttgagcgtcccgccgccgaggaactcgaccaccacgcagcacgccctgtccgccggcggcttctcgccggtgttgcgctgctcgccgccgccggcggcggaggcggcggccgggatgttgaggtcggtggtgcccatggacgcgccgaagaagcgcgccacgttggggtgctcgaacgagtgccagacggcggcgaggtcggcgagcgacgcgcgcaggtgggcgatctgctccggcgtcgagtagccgtcctccctccagtcgagcaccttcacggcgacgtcgtggccgccgtagtccgcccggaacagcgtgccgtggtacccctgcgccacgacggagcggatgctcagcttcgacaggtcgatctcccacgccgccgcctcctcctccgcgccgccattgccgccgccgagcgcgttggcggcgatcttctcctcgagcgcgaggtcgatggtgctcgcggcgagatcgtcgctgctgctgctgctgctcgacgccatcgatgtcgcgggaacgagctctcgaacgcgcgcgtcgcctcgatttgtctcgcgggatttttcggcaagcggtttagacacgggcgtacgtggcctgtatttatacgcgtggtagtggtggtgctagttactgtactactcctagattcgaatacggaatacacgaatccgtaccgcgtccgtactagtagattcgaatcgtttctgatgtattcggagtacagaatacaccaatccgtaccccgtacgtacgtctccagataccgcacgacaccggatcggattagcgtgtccgtgtcccgctccctcacaccagtagggggacgggctgcgctttcgaatttcggccaaaatttcggtggcactgaaatttacgaaattttgagatttcgagaaattataataaattttgattgtatttgaataaactttgatcaaattcaaattttttttacaaaatccgaaaattccaagcgataaggtgacctgttgggggttttggattttcaaacaccagacgacaccagattgcgctccaaaagctatccacatcacttctgacgaacgcggccttaattcgtccatcgcgagcacgtaaagtacaacaagcaaaaatcttaagaatccaaatagtgggataagagtagggatgcatgtgggccgacccgtgaatctacttatatatttaactggtaactcatgagttttcacatcgtggcctagcttaccatatctagaaatgcaaatggatcaatacataaacccatttatagatcgaattagtaagtaactgtgagttaatatgcgggttacccactaattacacctataagcgggtttgcaggtcggtccgcttgcatccctagataagaggagatggatgtcatgctatgtggaatgatcaatgagaacatcttattcaaaaatgtgtttccgagagttgtgaactcaatgatgtgatcagttttaacagggaatgaccatgttgtccagaacgccagttccaggtatggaactatggtggtgtcaagcatgaatctaatgacttaacatgtggagactggtgggaatgtacaagggggcatcacatgttcccgacgcagggttttgtttttatgttatattggagggagaggaggatacaggccatcggcccatggtggcaggacacgagtcataattatgcctcctcctgatcgaaccttaggccatccacaatgggtgcccctgggtcgtcccccgctcacgccgtccgccgtccgtccgcgcggcgtgtccctggagagaggcgcgacccccacgcggggaacacgcgcctctagctcctcagctcgctttttccggagatactccctcgaggctacgtattgcggcgacccggtgccccgtcccctgcctcctcccctggtgttcccctttttgcccctcaccgatggcatggcgatgagagatagagagagagagagagagaaaggagagagaggcgacaacgacgagaatccgccgcggtagccgtcggccaccagccggcgacaggaggagacggcttcctcgcgccgcggcggccggtggccaccagccaacgacgggctcggcttccatgatggagacgacgacaatgacccggcgacgactccacctgcgcctcggcctcttctgcccacaccgcgcccgccaccgccggcatgccacggtctcctgcccgatctggccgcaggggggccagatccgcccatgacggtgccggatttgccccctccagccgccggcggcgatggcgagtaagagaggcggcggcaaaaaaatgagagagagagcggcggcaacaagagggcgagagagagaggataaagcggcggcggctggggagggcgaggagggaggtggcgtcggcgctcgcgggaaagagagggagagggagggggatcgaggacggcgacgccaccgagcggagggagtgaaacccggtggagggagtgaagaaaaagaagaggaggagaaagaggcggagaaaaaagaggagagagaatgggggaagaagagagggttaggataggaaaacacccactgtgggtttttgttttgggacacccattgtagggttgagtaccttcatccagttgctttagattttgaggaacccatccagaggtgtccaccattgcgagctgagtttccctacgagtgtcctcaagaggtggctcacattgtggatgtccttatagagttgtggctgtttgtgaaaatgaaactcctaacagatgcttggccgcctagatcccattccaccttcgcattaaaaaatggccgcttgtctaacagttgctctttttggagtagacaataaactgcccaccctcctcttatctcttttttttccatgtttttaccgtcgccttgagtgctaagggatcatatcaactttgttgctctgcttcctccatgcaatccatcgagatgtcaagctagtcgtctatcttgatgatacgtgacttccacttacctctttcatccaaaaaaaaactcaatttctaaagtttaaattttgtcccacaaaaaatcaacttatatcattctacctaccctcagcatttacctacatatcacttttattattttttttaaccattaagagcattttagtcattctcactcttcactatctccatcttgatatgctaggaatgggattttttttgggacgaagggagtaggtaatatgcatcttgatttctctacactgaatttaactacctaggtttcaatgaaggcactattcctttacggattccaacaacaaaataaaagcagttggatccaatcgattcctaggaattttgtatatgaatcaagagggcgattagcaaaatgaagctgtcgtactaaatcgttagcccctctctaagaaagtctggcatgtgcttctacacagggtccttgcaattctaggagccataacttaagttgtgtatagtagacccaaaaaagatgagcccattaccaccaaccctacatacgagtatagatgccaaacgggctgcccggccaggcatgatcgggcctgggcaagagatcagtcgggccggcacagcccgcccacttgttgcatcaacggtccaggcacaatccaataagattcaggccatgccgggtcggcccgaagtctcaaaagctcacagtgctcttccttggaaaaagtccattttgccccctcatttctttgggccgccacttatacagctagaataagcctattttgcatccctcatctctttgggttgttctttatatgattggaataagtctattttggctcgctcatctgttttgccttcatgtgtcgggccggcccgtcgggccgaggcaaaggcccagacatgacccaaaggtcaggctaggctagcacggaccggaataagttcatctgaggtcccttaacttgtcaaagaatctgattttcatccttcaaccagaaaaccagatacaacgggtccctcaactatcaaaaccggtgcagatgaggtcccttggcggtttagatagcggttttggctgatgtggcgactacctgcctaatttgactcggtctttaactgacatggcgcatacgtgacaattcgatccaaaaaaataataaaactcgtgggacccacatgtcagtttcacacacaaaataaaaaaatggtgggacccacataggccccacatgtcatcctcattgccctcctcttcttcccgttatcctctctcttcttcggacactgacagcagccggcgacctcggcgaggcggctcgccgcagccttcctctccgactagtcgtcgtccttcgcagcctcgtcagcgcgctcgaccgcgggctccgacgatgaggacgaccactccagcgccatcgccgccacgcgagccaagaaggtgccgccctccatcgccgtcacacccgagaaggagatggagttcaacggcggtggcggcagtactgagggcgaggatgcggttggtgcaggaccccacagcggcgccgaccaccacgccaccggtctcctacaacaagacgctcgtgcctgccggcacaccgaccacccccgccaccccggcccccgctgcggcgcccaccaccccggctctggccaccgcagcgcctcctctcccacgatcgagactctcgtcgctggcaccgttgtccaccatcttggggatccccgtcacggtgcacgccgagccgccaccgccggagctcggacagcccgcctcgctcgcctgctccgccgcccacctgcccgtccgctccgcgctccctgagaagagagagagagagagggaagaagagaatagtgaggatgaggaagaagagagagaagggagagggatgaagaaaggagtgaggatgacatgtgtgccccaccatttttaaattattattttttgtgtaactgacatgtgggtccacagtttttattatttttccgggatagaattatcacgtcaatgccacgtaggacgaagacctagtcaaatcagccacgtaaacgccacgtcagccaaaaccaccttccaaaccgccgagtggcctcatttgcactagttttgacagttcagggaccaattgtgtctggtttcggagttcaaggacgaaaattggattcggtgtaaagttaagggacctcaaatgaacttattctgcacggacccgacaccagccggaccgtgccatgcttggaccggaccaaaaccccttaccataggccgggccgtcagggccgtttggccaactatgggtgtgtttggttctcgtatccctctagtctggctcatctccctcatccaggctaagttttagcctggtttaggggatacacatgcagacgtttggttgcttggatgagatgaacctggatatgatgagatgttgtttggttggttgcagcatggggcggatggaatggtagcatacagaagatgttgtttggttggatagatatcttgtgtgtaaatacctattattgtgggtggtgagattaccccataaagtttgtgaaacaagatcttttttccaagtccctaatctatttatgtgtgataagtttaattcgtcgtagaggttatagattaaattatgttactctgggtgtgtgcccacctactaatattcctaagctcattcctaaccaatgagcagcactgatgatcattttttttaacaaatgtaacgaaatggcctggatgaacacgcaagagtgattattctagcaaaaatcatgtacataattttattgacgacactggtacatttgacaattcaaaacaaacatacaaatatacgtgctcatggcaagttttttacaagtaaccaatttgataaacaaattagtaaccgcatacaaaactaaaccatctgtttcagctatgttctgcttgcaagcttttgtacagattgcttcaaactcatcaaccatgttctgcttgcaagcttttgtacagattgcttcaaacttatcaaccttagtatatctacacttgatctcacaagtttttccattatcacattttcctgaaacatagtaaaagtaaacaggataacctgtacctttgaaacagtacaggatctgagttgcagagatcaggtcgcaagagcatcaacacttaatagtagtattatctttaccaaaggagcaagtgcagagtgtatcggtttcatataaaaacttgatcatgtcaaaatcaagtgtggttaccaaaaaaaatgagtacatctgttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaattagctactatcattggtatctgttcttaccagtatctatcaaatgtagcaaaagaaaaggtataaggaaaaggaaaataagacgaaatgtaggaaaaaagaaaccgcgagaaaatgagaacaagtgtagagcaaaaatctattcacatgcatcacaacagcagcatatatcatcattggccatctttcccagcctaacagcaagaaaaaagaacaagtgtagaaaaatctgttcatgtactcttataaattctgcacaattcaagtgtagaggtggcctcagttctgataagatcatttgaactataaaatactgagaaagatcacagaaagacagaaacttagaaagggcatgtttggtggcctgactttatcgaataaggtcaagtgcaggcatatctgttcttatgcatcactaataagcactattaatcaagtgtgtatctgtcagtatcaatttaaaagaacgcactattgtatcttgccttaccagtaacttgtatttgtaggcaaagatacaatggcataacacaaatcaacaggaaaataggaatatgtgtaggaaaaatctgttcataagcatcacaaatcagcaacattagtcatcattggccatcttagaacaaaaaagcaagccactagacatttcattccatcgaaatcaactaagaaagatatcagcttttagtagatctagcatatttatgaaggggacacggtctaatccaaacaaatcggctgagaaagggaaggagatgcccaacctagcccttaccagagagctcaacggagagagtcgacgaaagagaggggcgtagcagagaccaaacggcttgacggagagagtgaaccagtggaagaaagcgatggcggcgagcgaaagagagggaggatgaccaacggaagagaggatgctgacggacgaccggccctcccgccggcgaggacggcgcgacgagcagcgccctccagtcgcgagtcggcggaaccctagctttccactggtttggaacaaatgaggaggaggagaggagggatggtggtgaccccatccatgggttctgcacgcgcgggtgcaagcgaaggtcgattctagcgtttccgctcagcctggctccgcgggcctttttcatccaccggatcttgctatgagacaagcccatgcaaccaaacaatcgcaaatctactggctaggtgcaagccaggtgtggtccggacaaccaaacacgccctatacgtacgagtaatgaaacccggcccgagaagttgacgcctacgatgcggagagacgcgcggcggggagggaggagatcgatggaggagagcgcgctcgaaataaccaccgctgcctccggacaaccacgtaactccctacttctacaccaccgcccgtacgtggcctccactcgcagcctctctccctctcctctcctctccgatcgatccttcccctctctctctctctctcaatccagataggaaggcggcgagcgagagcgacacgatgcaggcggtgagggaggaggaggagcaggtggtggaggaggtggtgagggcgggggcggtggcagaggaggaggaggggccggaggagaaggaggtggcgatggtcggggaggagatggcggaggcagagcacgacgaggaggaggcggaggccggggcgtcggcgaagaagaaccggatccaggtctccaccaacaagaagccactctacttctacgtcaacctcgccaaggtatatatatattttgtgattgcagcttcgattttatttttatttttgttagggaagaatcgattggaaactgtgagtgaaattttgtggaagcagtcgaacaaatttaaatcaaaacaaaaaaccttcttatgaatttgccgcctctaccaatgcaatgacaaaatgatactcctatatggccatatgggaaacaaggaaatgttctttatgagagaaatggaaatagggggtatccaattttattttatccgagttttattgactgttttggtgttctatcttgctccgaaattgccatgcctttgctatgttatttatctggccccgttcctaatgtaaaatctttaattcaacaagaatattgagaactgggagaattatgaatgaattgcattaaaaaagtttcaattttcagtgtcctattgttgagaactgggaaaaatattgagcacctatatatgatctctaaggtttaatcagttctttgaatttgtacacataacacatctttttgtttagaaaattatttatctgacatctctaaacccatatggatactggatgcagaggtacatgcagaactatgacgaagttgagctctctgcactgggaatgggtaatgcatccatagaaacttaatacttgttcttaagtttccttcaaatcatctgatgcatatatgtattcagacactctataataaaatctgaagtaatatgcatttttcgcacatccttatttttaattactaagtcatttcatatttacctgaatctttctgaggtatcttctattgcagcaattggcacggtggtgactgttgctgagatcctcaagaacaatggcctggccactgaaaagagtaagcatcttttctattctgctaattactacttgtctacaaaaatcaaatctatgcgcaagctttctttcttattgaaacaaaaattcagtacgacttatcaaaatagtgaggtaaacttattctcttcttccaacttccctgttcagagatcctgacatcaaccattggcaccaaggatgaatcgaaggggcggcttgtccgtaaagccaaggtgagatgaagatttcttggcgtcaacagttcattttccctttctgtctgaactcaccattcttcttaacttctacctgaatccatattgacaactaacaatttatctctgtctgtttttcttatctcagattgagattcttctttgtaaatcagaaaacttcaacagtataatgtccagcaagaaatcagaccgcccgaaatccgccgaggaagagatcaaggtctgatgatgaacaccaacttctgatcgatcagagcctccatgtccagaggttaacaaaccatgcttgagacagtgggaggcagcagcaatgatctgattttagtagtaactagggggtaccttagtccttgtcaaaggaggaatagatcataatattgtcaggcatgcatactatgcaggcaaaattatgtcctttcctcttccttgcagctctgtccaactgaaaccttcaaaagaaattaagcaaaatttgcaactgcgtcagtacggggagatgatgaaattagtggatgtagaaatagagtttatctcggtcagtccctaaggctgggactggaggagtcctataattaagctcttactttttcagtttgatgttcctttgctcatgtatgaagcttttggacagagacagacaggtcactgtcataatggaaggctgaggtttcatgtgattgtgatgcttctgtttccatttgggtgtgtagtagtttttcagtagataaaacatttttgttatctcaactaacttggacaggattggcttatccgtcagcgataatgtgcttataaaaacgtgcgtactgggtagtttttacaacaaaattgagtaggaatggtacgtgcaagaaaataacttatgacgtgaaatgtcaatcaagtaacttatgaggtgatttttacaaattccctttttagaatggtataattgtataaatatatttttgacgggtggactgggggatgaagcccgagattacccttcgttactgttcgccttcgtagttgttgtggtcgatttattggtaggatgtttgtgatagatatttaatcccaagatagcaacgttctcatgttttgtgttacatgtagtcgttgtcgtgctattcatattttacatgattttcacatgaaatggtttcccatgaaattcccctaaaacgagaaagctccccccaccacttaatcttaacgtctcacacaacgctccaaatcaatctcctatttggatttatattagtattagaagatagcgcgatcactaattagtgcgtacacaccgccaacaaagatcgtgtgttttagcccacgcccgcatacacgtctctggccaaccatacgtgtgtggttacaaagggattagataaggtcatgattagtttaattaagtagttttcaataattacagactaaattaagataacatttctttttttattggtgggattttttttctttctttacttaaaaaattgaaaatctatacgtaattttcttaactttcaaataaaatctaaaacttcctaaaaaaattatagttcaccaaaaaatgtaaaactttcatttagaattcactaaaaaatgtaaaactttcaactcaaaatttgaaaactttaaccttaatatttgaaactttcaaatcaaattatttaaaactttcaactcaaatttcaaatacttttgactcaatttttgtaaacttcactcagatttgaaaagttccaagtaaagatttgaaaactataaactcagatttgaaaagtttcaactaaagatttaattttgattcggagttaaaagttttcgaagtcgagttgaaagtttcaaattttgatttgaaaatttccaaatccgagctaaaggttttcaaaaatctatatttaaagtttcaaatctggacttgaaagttttcaaatatgagattaaagcttttaaatctgagttgaaaattttcaaatcgaagttgaaagtttcaaatataagtttaaactttcaaatctggacttgaaagtttttgaatgtaagttgatttaaaaagtttcaaatctgagttatttttttttcagtcaacacaaaaaaagaagaaaaaaaaacacgcgtgggaggatctttccccgtaaagaaaaggagatttttttttccgatgcagaacagaaagacgcctaagaaaaaagtggacccacatcaccatgcgcgagttccgtaaatggcgcatatgcaccaactagtcacccccccgaagattgattgtattgaacctaattaatatattttgggatcaacagagtactacaagtactacaggagcatgagcatatgcctattcaacaaaacagatactatctctgtcctaaaataagtacagttgtggggatccgtgtccaacgtttgtccgtccgtcttatttaaaacatttataaaaaataaaaaaaatagtcacacataaagtattattaatgttttatcatctaataaaaaataagaatactaattataaaaaattttcaaataagatgaatggttaaacgttaaatataaacagtgcaaaactgtactttgctgtgggtcggaaagagtagatagcctcctcatatattaatccctattttgttgaacgcttgggctttctaaaacttcggctggttgttgcttctttggctcctaaattgcactttgggtcacatattcttccccaagtttacatttttctgcgaaagtgaccagctactacttgcgctcacatgatcatatccaatcctttctccaaggagatcatattagttttcccagttaacaagcttatagtactttctagaacagcatgtaaagagcaagccaaacgatgcatcagaggatggaaccaataatggaaattattcccgtttgcacaagcgatgacaagcaaagatattggattaaaacaagggttccacgtaattttacaagcaaatgacagactgtaaactgatcttcatgggttgtcaaatcacaacgaatagaacagcaccgacacaaggttatgctaacaggaactgaaagctgcactatctggcaaattattctcttacattttatcaatagacatggaa

SEQ ID NO: 8245 - DNA, 1617 bp, Oryza sativa
tctctctttggcatggcatgctatccagacgaggcctttgttcagggcttcaagcccagctataaatcttctcaattataaattttcacaggcttctcaaaagtgtgacgattctgcatagtttgaataaccagagtaaagaacaattacatggaaaaccctgctataataatacagataatttcgaaacaccattaatcaacccagcttacttttacacatgcacacattgcattcaatgcaacaaaaatattagcccaaaataaccagtaatgatttcttgaaaaaaaaaagtaaagggagaaatgagtacgtttacacccgaattttttcttaatctaagcacatgcaacactgttacaaaacaaaatgaaaaaagtaaacatactcatttctccctttacttttttttcaacactgcacgtgactataggcaagattctcatgtagtcacgtgcagtggtgattctatcgaacgggatatccatcaaactaactactccctccatcccaaaataaaagaacctaggaatggatgggacatttcctagtacctgtccagattcgtagtactaggaaatgtcccatccggttctaggtcttatattttgggacagagggagtagatgataccccacatgttgttgcaggtatagtagaacaattttggatatacagatttagtatgaactattgagcagaaaaatattacattgagctgcagaaatattgcatttgaaaataaaggcaggaggaaaataagtgtcatctatatgaatgcatagaagtaatgaccatcaataaataaaagaaatgtaactgaatacatgaaggatggttgagattaaacgcatgaaagatccaatggcaaatattttctaggtgatgtggctcaatgcatgtagagatttttggttccaactatataggatatatagattggatgctgaattgagtatgtacgtgcacgtatagaccaacaacccacatccaattggacagttagccttcattttagaaattggaaaaacatagcaggtgtaacatttttctacatttcaaatcttattcatttgcaaagatcatgcaaatcatatctgtgtaaataatcttcatttgttttgtatagcagtggtgcatatcagcttttacaaatcagtttagcaaatatatttttcagtgtaatctgaatatagcaaggcaagagacctgcgaggctgctgatttgctcacttcactagaagcaaagcagcaaacagcccattaatctcttggacatttagttaaacaaactgcacgcttattttgttcggcatcaggttaaccggattgacagcagattgtttagaatagaaatacgaacattgtgtgctcacattcgtaaaatgggtttgcatgtgcttagatataaaaataaacagatatttacactcttaaatcttaaacactcagattatttcttgccagttttgaattgtacgcaaaaaccattattagccaacactgattacctgattggctgtataagacctttttggtgttgtgtcagtatgttccaagccaaggtattgttcccaagctccataaacatctctcctctgcagaatccatccattc

SEQ ID NO: 8246 - DNA, 588 bp, Oryza sativa
ggagctctttctggaagcaggtggaggggaacaaagagaggtgatggtgtgctttaaaaataagtgaatgcccctgctcacccacactgaaggacatcacagtgtcaggaaacttcacagcaaggcaaggcacagggaccccaggacccgcgctgtgccactggcccccttggtgccctcagggtaaagggagctgggaaacactctgtagaagggcaaagggcctgagaacacttggctgctggatggaaggagacgtcattatgagaagatgctgagaagtgcagatgagcaatgaggtccaccaagctggtcagtaatggatcatctactctggccgacgcttgcaagccattcatgagtgagcctgcatttcctgtgatatttagctcctaataaagtgatccccaggagctgacacattcctccaaagtatgcctcaagccaaacacaacctaattcatatgaaatgaataaatatttcattaaaaagaaatggattccaaccttcatgaagatgtctgcatgaacaatgaaggcttctagtaaatgcatcattggtaagaattccaaagatgattcctacat

SEQ ID NO: 8247 - DNA, 39229 bp, Oryza sativa
cgacagatgttagccgattgtagattagatagcggcattgccggagattatgtaagatatatgatagctcgacgaattacataaacgagatcagagtatcataaagatggaagcactaatcccgagaacacaagttgtcataacaagttttacctcttgttgaagatcgaaaccgatgcagctcaacccgaaagtaagaactcgtcgaaataaaactaaagcaaaaagggtggcgatgcgccgaaattgtattgaacgtgtgtgttcaaagttacatagggctcgggtctatttatacccgagaattacaagatatgtccataacggacacgactaatatctctaacaaactctaagataccataagtctttatggcagacttttgcccaagcgtatctctaaagaaattacataaaacatcctaattaatagataaaattgccttcttaggactctatccatgtgcggcaatcaccttgaggtgcctcaactcaacccgatatcatacatcaagtcgcattgccggaatcggctgcatcggcttacctagtccgactcagacccagccgatcctaatcgtagccgatatggactccagccgattcctgctctgtttccgaacccgatctccgcctccgacttcgtttcgatctaatcttctttctcgatgctgatattaccaaatttggttgttaacacatgccccccaagtccggaatatttggtaatgtttcggatttgctgtaaatcgaccccgagcaagtttcgcactttgccgttttccgaccgttactgccgtgctttaaatactaaccgtcaccctcgagaaatctcacaccgtgacttccgttttcaccgctcaagcgaaactttgttctctctctctccgacgattcctccgatgcaaaagcgactcccaggcgacttcatcttcggcgagatttccggccgcagcgatgtcatcctccaccaacctatctgatgtgccatcagccgagtacgctgaggtaagtcctcgtcggctagatcccctttcttagcagcagatcgattttctcttatcttatatcgctctctttttctcggttgtttcggatttgcagcatctctccaacctagttgcgattccaagcctatcacacgaaaaccactattttcttggcccaatcggcaatctcgaccccactgatttcatcatcggtgaaaccaaccaaatcccctttagactagccaaccctaacctgggtcactggaagaataccttcaagtcttggccatctctcgaaaaacctactcctgataagagctggaccacctggtaccaacgcgtattggctagtaagaaagttcactgggatgagattggaatcggccaagcgcttgctctcaccatagccaattctgctaaggatgagcctctgatggctgccgccacctacttctggtccaacaccatcaatgctttcttattcaaccaagggccgatgactccaactttaatcgacatcaccatgattactggatttgatgtaacttcatcggctaaccctatgagtatgaacaccaagaaccaatttgacttcaagaccaaaagcataggtggctggtctggctatgtggcggcatatatgggccaagggtctgttactcctcgagagcatgtagctttcttgctcatgtggctggaaaagttcctcttctgtggatctagttgtggccatacaaccaactggcaatttgtagtcgaagcctgttggcagatggcatgaggcccttcgactaaatctgccgaaacccgtggcgaaggctatggagcaagaacggcatgaggcgaagagtcgtacgagtgccctgccaggccagaggcgtctcaggcgaagggtgtaaggcgaagactatctcaggcgaagggtgcaaggcgagggccgaggaagcctttccggcctatcaagcctaagggctacagggccggcgatcgccagacggcccatcaggggcccatgagcccctataacattatgtacccctgtaaatgtccctttcgtaaaggtaatcatgtaaattcccctgtacaacctaaaccctagtagtaagaacctgtaatggggctataaatagtcccctagggccatgtaatgagggggatcccaaaaaaagaaattcaaaattcaatacacttcgtttccttccaaccactgttgagttaccacgtccttcgacgtatgcagttgtcatttcgacaacagctggcgccgaccgtggggacctccgagcgaaaccactgagagcgaatgccaccgaagagggtcgtgaaggagaaggttgccaggtggaaggaaagcgacgccggactagacatggccgccgaggaaggagcagagccttcggcgcccactgccgaagatggaggaggacaagcgacatcacaactgccttcggcccctgcaacctccgtgcaagtgccgaacgcggccgacgtggcgaaggcggctgcggcggcaagggcactccagaccagggcggagatcctttcaacaatccaactggtggtgccccaagccgctccatcgcagccggcagcggccccaaccgcgcctgccgttgtgcaggcccaagtcagccctgaccccgaagcacaagccgaagccgacatggaaaccatgcggcagaacatgacacggctccaagacatgcttcgccaaatgcaagaacaacaacaagcatacgaggtggcaaggcggaccaaggccacgtcggctccaatccttcagtattcggcaggttatgtcccatctcaagtccatccgcatgtgacgacccagcccattccgccacaagccgcacaggcgccggtgtactttgccgggcagcaatcggccgcagcagtgcattcagcccctcacgtgcaactggaagctcaaccagtcgctgcccaagcacaccatcaaccacctggccaagcgccacaaacagtggcggaaggggcttcggctctgcaggcgcaactccaagctttccttcagcaactcaaccaacctcactgcatttcaagtacaaccccatcggcccacccggaggggaatacaagtcaaggtgtgcctaattggttgccaccgattcagccgggcctaggagtttttgtaacgccccgattttcgttcgggaataaaaatcaattaataatacatcttctagaaattaaataaaagttaaatcaatttaatcaagtgaaattatagaggaaattaaaatttcctttaaaaatcattggccgggaatattttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcggcccaattccccccccttctctccctctcgggctggccttctcccacggcccgctcggctctctctctccctcaagtctgctttacctccctcgcccgttttccccactctctctccccgacaggtgggacccgaggccccacctgtcagctcctcctcctacctctggctggccggctgcaaccgccagggccgcccgagccaccccacgacgccgccgtttccgacctcctccaccccgcgcgcgagcccgccggtcgtgggaccccgtcgccccacgtcctccacccttttccccactctccccacgaaaatcgccgccggttaacctctccaccacccccaagatgccccgcctatctcgtcggccggttgccacctctctcgagcacgatcccatcgctccaagcccataaaaagcatccccggcctcccctttccatttcccccaattttcccgagcttctcgcgccctgtactgctctcccctcgctgctcccatcgccgccgctcaccggcgactctccatccgctcgccaccgctgctacagccgtcgccgtactgttccgccgccacctgcggcttcgccgtgccttgccgcacctcggccccgctccgttttccccattccatcgttggaaccccctccccaccgcgctccctctctccaccactcaacgacgagctccagccgccgctcctcgccgctgcagccaccaccgcgccgtgccgccgccaccgccggcatcgccccgtcgagctccaccctggtccctactccattttcccatttcgcctccggaacgccgccgccacacgcaccacctctctccctcaccatggccacctccagccgcgtcgcaacgccgcttcggtcctcgccgacccgcgtcgtcgccttcctcggctccgcagggacggggagatcctcggccactggccctcttcgccggaaatccacccgagctccacctccctcgtcgccggtgagctcctcctcgtattgtcgtggtcggcagtcgtttccatttacctcgcaccagttctcacctccataggaggctttgagccgtgaccgtgccccagccgcgcgccccgtggccgtccgatcggcttgggccaatccgggccgtcggttcccgtggaccggcggtggaccgcctcggtggtcccggtccacggtggaccggtgcccttgtgccactgaccggtggggcccgcttgccggcgccacccctcccctttgatgacgtcagcaaccctcttttcctttggaaaaataaataataattgcgtcataattcgttaataattctagaaattcatttaaatggctcaaaacttctaaaattcatatctaattcattcgaactccgaattgagccgttcaacttgcaaaattcatctaaaattgagatctacatgtttgtttagtttttatgtactgtttctttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacctagctagaactatatgcttaaccatgcttcattaccactagctcagttgatggggtaattacagttttagaccttttagtatcagtatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgactcaatacactgtagttcaggtgggttggttgggcctgttcaacgtggtgtagcgttgatcagtggagattcaatattactttaattactcaacagttttactgttttgctcaataaaatgttttacaactgcctttatgcaaatagccacaaacccctgcttgtatccccttgcacgtctgcatcgttggtgtggcttgctgagtacggtggttgtactcagtcttgctattattcccccttttcagaagtgtagtgcttctgagctgaagacgaagttagaagaccaaggctcagaccccagttgagttttgcctgtggaatggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagttttgccatggaatcaaggactgcagttcgacttcgtcaacatgctcaggcaccaaccgttcggcagcaagctccaactccaggcttcggaacaaaccaagcaccaatccaagctgccacgacgtggtcgcagccaatttttgacccatccatggcgactcagcaagtacctccaattggagccagacagtcgaatgccatggcgcaacctcacgcacaagctgcgattttgcccttcgccacaccgtacccgcagcaaagtgcagtaaacagggcgggaggcgaaaaggggctaccgctgagtgggggaatcaggactcgtccaatcccaccgcagttcaagttcccacccgtcccgcgctattcaggcgaaactgacccgaaggagtttctctctatctacgagtcagcgatcgaagcggctcatggtgacgaaaataccaaagcgaaggtaatacatctcgctctagacggcatcgcccgtttttggtatttcaatttaccagccaatagcatttactcatgggagcaattgcgcgatgtttttgtccttaactttcgaggcacctatgaggagccgaagacgcagcaacacctcctcggcattcgccaaaggccgggggagtcgataagggagtacatgcgttgcttctcgcaagcccggtgccaagttcaagacataaccgaggcatcggttataaacgccgcttcggccggtctgctcgagggcgaactcacaagaaaaatcgccaacaaggagccacagacgctcgagcacctacttcgcatcattgacgggttcgcaaggggcgaggaggattccaagcgacgacaagctatacaagctgagtacgacaaagcctccgtcgccaccgctcaagctcaagcacaagttcaagttgccgaaccacctcccctctctgttcgccagtctcagtcggcgatccaaggacagccgccaaggcaaggccaggcccccataacttggagaaagttcagaacagaccgtgcgggcaaagctgtgatggcggtcgaagaagtgcaagccctccgcaaggagttcgatgcccagcaagcgagcaaccatcagcagccagcccacaagaaggtccgaaaagacctctgctgcgcctttcacggacgctcttcgcacaccacggagcaatgccgaaaaattaggcaacatggcaacgtgcaagacccaaggccgcagcagggaacaactgtcgaagcatcctgcgaagcaattcaggagcaaacacccccagccgaacaacgccaagatgtacagcgaagggtaatccaagtgattacaagggctgatccgccaagccagttgtccaaacggcagaagaagatgcagatccgtatggtccacagcatcactttggcgggtgaaggggcgccgcagtatcggaaccagctaatttcttttgggccggaagacgcagaaggagttatgttcccgcatcaagatcccctggtaatctcagctgagatagctggtttcgaagtccgatgaatcctggtcgacggagggagttcaaccgatgttatcttcgccgaagcatatgccaagatggggttgcctacccaagcccttaccccagcaccagcatcactccgtggtttcggcggagaagcagttcaagttctcggccaagcacttttgctgatagcctttggctcgggagagaacagacgcgaagagcaaatactgttcgacgtcgtcgacatcccgtacaactacaacgccatcttcggccgtgcaaccctgaacaagttcgaagccatttcccaccacaattatctcaagctcaagatgcccggcccgacaggggtgatagtagtcaaggggcttcagcctttggccgcttcaaaaggcgatctagccatgatcaacagagcagtgcacagtgttgagaccagaccgtatgaacggccgaagcacacgccaaagcccacccctcacggcaagataacaaaagtgcaaatttgtcacgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttctttttcttgggcccggcccatttcctcccgcgccggcccgctcctccctcccactcccgaagtccacccggcctccctctccctctcgggcgctgacaggtggggcccacctgtcagccctttccctaacctccggccgcccacgcccgcgccaaccgccgtcgaaaccaccgcccacgccgccggtttccccgtttcccgcgcccactccgcccgtaccgcacgcccacgtcgccgcccaccttccccgcacctcccgccagctcgcgcgcccgcaaacggcgggggattcgaaatttcccccactctgtctttgctcctccaccccctccactactccggcgaaattgcgccgttcccggccacgactcgccgccccccctcctatttaagcacgcccgcaccttccctctgtttttcctttctcggccgagccctcccgagctctacatcgctcccgcgcctctgataccgccatccgccgttcgccgccaagctccggccgcactccgccaccgatagagccgtggccgcaccgcgccgtcgacgcccccgggttcacaagcttgtgcgccaccccgtcccccggttccccggtcaatcccgccgccggagcttgcttctcctcgcgcgccggtgagtacccccataggcgacgtcttcgacctgcgaatccgctcgctgtaaaccacccctctccctataatccctcccatcttgttccctagaaggtctcggagctcgtccgcctatcatcgccgggccccggtttcccgggtcgctcgccgtcgccgttcgcggtcgtcttcccccccccccacgccggccaactcgcggtgaggcgcccctccccctcttttccccttcctctccctcctagcgccgtgccgggccgagccgccgcttcggctgtgtgccgccgcctgtgcgccgccgtcatccgccgccgcttcccgcgcctccggttgccgtcgccggcgaccgtgcgcgcgcgccgccgccctcgccataaccggccggccggcttgaagccgagctgagccaggccgccttcctcctttccccgtgagccgcgcccctcccgccttgtgccactgccagtggggcccacgtgccggcgcccctccctctctctcttgagccgctgactcatggggcccgcatgccggcgccgccccaccccttgctgacgtcagccctggggcaatattgcgcaataaattgattaaggcttttctttaatagtaaaaatacagagaatcttctaaaaatcataactaattcatccgagctccgattaagtccattcaagtctcagtaaattcataaaaatgtatagaatccattaaaaatggttttgtttcctgtttcagtagtcttatagcatgtcttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagactttgattattggcaatagttttggattagtgccaccgcaatggtgttggttaattaaaatacacttcatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcatgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgtcacggcctctttctggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggtgtagttcaggtggttggttgggcctgttgcaacgtggcgtagcgttggacagtgactggttaatattgcttaattactacaactgttttactgttttcaactactagttttaaatgcctgctttatgcaaatgaaccccgtagcctcctttggttatatcctgcatcatacctcctctaccggtatgacttgctgagtacagtgggtagtactcagtcttgctcttttcccccacaccagagttgaagttcttctcatttggagaggtcttgaagaggttggtttcgtcgctgccgtcaagggttgcctgtggaatggaatcgcccgctgcaggagtcaaggcttcaggcttagctcgctttaccttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctaggcgtgacaaaattgatgacgccgaccccacaaagcccgtatcactggggggcgacataggcgaagaagaagttgagagtatactagaggtgcttaaaaagaacatcgatatcttcgcctggagccctgacgaggtggggggtgtcccggcggatctcatcatgcatcacctagcagtcaagccggacattaagccaagaaaacaaaagttgcgcaagatgtctgccgatcgccaagaagcggcgaaagccgaagtacaaaaattgctcagggcaggggttatccaagagattgaccatccggattggttggcgaatccagtgctggtgcggaagtcaaacggcaaatggcgcatgtgtgtcgatttcacagacctgaacaaagcatgtccaaaagacgacttccccttgccacgaatcgaccagctcatggattcaacagctggatgcgagctcatgagtttcctagatgcatattccggttaccaccagatccacatgaacccgctcgacatccccaaaacatccttcatcactctattcggcacattttgtcacctcagaatgcctttcggcttaaggaacgcaggagcaactttcgccaggttggtgtacaaggtccttggcaagcagttggggcagaatgtggaagcttacgtcgacgacatcgtcgtaaaaagctgcaaggctttcgaccatgcgatcgacctgcaggagacattcaacagcttgcgcatagcaggcataaggctgaatccggagaagtgctttttcggtgtccgcgcgggcaagttgttgggtttccttgtttccgaaagaggcatcgaggagaatctcaagaaaatcgatgccatccagcaaatgaagcctccgtcaagcgtacatgaagtacgaaagcttgcaggccaaattgcggcactcagtcgattcctctcaaaggcagccaaaagaggtttgcccttcttcaagaccttccggggcgtaggaaagtttaattggacaccagagtgccaagcagcattcgacgagctaaagcaatacttgcaaagcccgccagctctgataagcccaccccccaggaagcgaactgctattatacttcgccggtggcttcgcgcaagcttaagcactacttccaggcccacaaagtcatagtgccatcacagtaccccttgggcgaaatactccgaggcaaggaagttactggccggctcagcaagtgggcggcagagctatccccgttcgacttacattttgttgcatgctctggtatcaagtctcaagtgctagccgacttcgtagctgaatggacaccggtacttgcccccgaccccgagcccgccgaacaattctgggtgatgtgctctgacggctcgtggtcgcacaagggagtaggcattgcggcagtcctattttcgccgaatggtgtgccgattcggtacgcagcaagactgcagttcgacacaaccaacaatgcagcagaatacgaagccgttctcctgggcctaagaaaggcgaaagcactaggagtccggcgcctgctaattcgaattaactccaagttggtagcaggccatgttgacaaatccttcgaggcaaaagaagagggaatgaagaggtatctggaggctgttcggtccatggaaaaatgcttcaccggcataacggtcgaacacttgcctagaggccaaaacgaggaagcagacaccttggcgaaatccactgtttgtggtggcccacattcgcctagcatctttttcgaagtcctacatgctccaagtgtgcccatggacagctcggaagtcatggcaatcgaccaggagaaattgggcgaagacacatatgactggcgaaccccatttgtgaaacaccttgaaactggctggcttccggtagacgaagcaggagcgaagcgtttgcaactcagagccacgaagtataagatggtctcgggtcaactttaccgctccggggtacttcaacccttacttcgttgcatctcttttgccgaaggcaaagaaatggcaaaggagatacaccaggggctatgtggcgcgcaccaggctgcaagaaaagtggcctccaaagtatttagacaaggagtctattggcccactgtgttgaaagtctgtgttgagtaaatcaagaagtgcgaaagttgccagcgccatggccgaagccaagccacgccccagtatgatctgcagcccattgcgccaatatggcccttcgccagatggggactggacatcatcgggccgttcccggtggcacgaaacgggtataaattcgcaattgtagctgtggaatatttctctcgatggatcgaagccgaaccccttggggcaatcacttcggcagcagtacagaagtttgtatggaaaaacatcgtttgccgtttcggagtgccaaaagagttcattagtgacaacggcaagcagtttgactctgataagttcagagaaatgttcaaagggcttaacctggaaatcaggttcgtgtcggtcgcccacccgcagtcaaatggggcggccgaacgtacaaatggcaagatcctagaagcactaaagaaaggcaaatggccagaagaattgctatcggttctctgggcccttcggacgacccccacaagaccaaccaagtttagcccgtttatgcttctttatggcgatgaggcaatgaccccagcagagctaggggctaactcaccaagggtgatgttctctgggggcgaagaggggcgcgaagtatcgctcgaactcttggaaggggtaagagtcgaagcgctcgagcacatgcacaagtacgccacaagcacttcggcaacttacaacaaaaaagttcgacccacagagctgatgcctggtcatcttgtcttaaggaagaaggcgaatccagtagctgttggcaagcttgaatcaaagtgggaaggaccgtacctcatcaaacacaagtccaggacgggatcttttcgcctagcgacactagaaggtgaggagttcgaccattcctggaacgccgcctctttcaagcgcttctatgcctagaatgggtggcacccaaatcgctagcttgtaaaaatgtacatacagtcatgtaagcccttcggcaccatgtaagcccttcggcactatgtaagccttttggcaaagaaaaaaaaaggggaaaaagagaaaaaagaaaaaaaaactagatgtagggctattatccaccatggaggcccgaaccagtataaaatctctatgtcctccgccttcttttcatttttcgtgtgattgataatttgtggaaaaaccccaaggcaaacgcctgatcagcgaaaaaggccagggggagaaacgaatcggtcgaagcatcgctcgccgaacgttgaaaccgcaacagcttgtctcggaaaataactagccaaacgacgttacgattcgatcaacataaaagcaaaagtgtctctttcgacacagaatgctacaggtcgaaaacgaacgacgaaaagctaaaaagtcagtacacctattttgctaatatgcgcaaaggggccggcatgttccgacctaacaaaaagcacaaaatgtgacgatgcgaaaaatagcgaaaaggaaataaagcacgtttctttattaacttcgaaaaaaataattgaagaatagaaggttcacaacacgatacaactcactttacaagtaaattacatcttcgcccctgtaatcattatccctccctaaggaatggtcagacgaactaggttcgtcatcactactaatatcatacacaaccttaagaggagtagggggcgaaacacagaccaaactgttgcgacgctgaaagatcatttcctgacgtttcgtcttctgatgatttcgccaaaagcgagccatatcctccaaacgtcttgaatgaacaaggtcgtaatcttctaagattcgcccggggtgcgcccgcagccagtcggcaaccttgaaaaccttatagctatgaccgtttatctccatttcgcgataaacaggacgaaatggacatcgcaccttcggcaggtccttcaatgccacaaatttctcgttttgacttcgccagctcccggaaggggaccgaatgcacaacttccggtgaacgccctgatagacagcgcagagaaagcaaaacacagcttacatagtaagaataggcggaaggagggggaggtatggcataatgcgagatgagcgaaataataatatgccaaagacctcgaccatcaaaaagcaattaagattgtgtcatatattccaaatgtacaaaaaggcgttttttaaggttcggcggcagcctgccgaacgtacatcattcgcctctccaggcaaatgcaaaagtgggaggaaaactacaaaaatctaaggaaagggcggagggcctcacacctctgggtgatcctgggcatcgcctccaacctcttcgcctgcggcaccctctccttcgccccgatctgccgcctccgccttcgccagttgctccagaaggcgcgctttggcagcggaccggccatcattctgccagaactgttttcgccacgcgcgaagagcgggcgaaatgttctgcgcactaatctcctagtcccccttcgcataggtagggaattcggcaacgtgctcgcagccaaactattgcaaaaggtctaaggtaaaggccgccgatacgcgcgcacagcaattgccgtacgcggtggcacagtccgaaaccgatccgccagcttgctgggtccactcggagaagtcaaaggctgaggcatcctcggcaaggaccccccgcaccttcgcgcccatgtcggtaagggcgaggcggagcgtttggcaagccgttctcgcggattcggtggtcttcgccatctcccgcaaaaaccgctgcgactcctccgcggcgcccgcttcgaccctgctagccttctggcgaagagcctccatcttcggctcagtaaggttgtagtaatcgatgagcaccgccgaatgggccttctccttctccagttcggccttgaggcgatcaacctcggcccaggcatctttccccttgtccagttcggactgaaggcgtttgacttcagttttcggctccttgagggtgtgggccagggactccacctccaagttcttgcggcttatttcatcatccttggcccgaagacggctcttaaaaccgtcaaaacgggcccgcacggttcgctccgtcgagcagtgagtcgcaagaatctagatgaaagataggagcgggcgaaaagaataaaaggttaattgccaaacgtaaaaaaaaagagggaagaggaaaacaaagaaggaaaaaaaggcatacccgaaccgccaaacttttaatggtggaacacccctcgtcgaactcgttaagttcggtgaacaggctcggggtgccggcgggcaagacaagattgcttactccctccacaaagggaataaggtccgcctgggtcacgaagtcaccagggacgaagtggggcgccgcaagggaatactccgaggcagatgcttcggcggccacacacttccccttcgccttgaccagcggtgaaatagctggctcgcgcacagggctcccgaaaactctcgccgcagccgacacgatccgttcggcggaggcggaagccccggcggcggcgctaccgcctgccctagcaacgccgagcggagcaaggtgagcagttgaaaggtccaaactgcggccagcaggtgaagtcggagtctcgtcagaagattcatcgtcgctaaaaacgcgagcgatgtcgacgagtcccttcttttttgagatcttcttgaccagacctccttttgccgccttgcccgacgagaacgcaactagggccttcgccccttccaaatcctttcgttgaaggggggagctgttcgactccaccctggtctcgttgtgacctggacttggggtaggagtgtagccgggggtgtcgacgcggtcttcgatcgcttcgttcgcggccttatcagccacagcttccacctcctcttcttcctctccttccccctcgccgtcacattcttcggcatcatcctcgtcgtcggcgtcggagtccgacgaagcaggaacccttcgcttcctgggggcaagcttcacttgtccacgcatccgctttcgcgaaggccctgcatcgtcgtcagctttttggggattcgccggggaggcagttcgccgttgtaaacccggttcgtccgcccagccgcttgtcgtgttagcagctggctatactcgacgaccgaaacatcgccgatcatcctgcgggcttcggcttcagcctggtcgagggttgacattgcaaaagtaaagggtgtagctgcgttaaaggtcagacaaggcaaaataacaaagcacaggagtgtatagcaaaagaacggccttactgttcgtcccctcaggaagaaccaagttcggcaaaccgttagcctcttcgcattgctcgaccgtgacttgccatgactgggagaggggaaagatgcaaagcatacagaactcctccaccaagtcacggcagctaaggcgggagcaaaccttgcgcagtaggatgaaccgcgcctccatagcgccgtccatggcgatcttgggtttccggttcggtgcaatcgccctatgccggcaccggagggcttttgccgagtcagaaccagctgcgaaggggatggtgtgatagaaccacctcgccatccaatggcggtcccacttcgacatggcagcgttcaccggccagagattggaccgctcggggcgaacgttaaagttcacgctcccgaacactgtcttcttcgttccagccggggtaatcaccgtcttcgagttcaaggtggcgaaaaatatggcgccgaagagctcggcgctgggctcaaacccggaagtccgacacgcccagtcaaagatggagatccgaactagtgccgacgggctcagctgcggaagctccacctggaaaaggcgaaagatctccggcaacaacacgttgcacggaaaccgtagccccgcctcaacaaagacggcgaacaccaccgtccgattgtcgacaggcttcggcaccacggctttccccggggcgaaagcctgcccctcaaccaacgccccagagctaaccaactttgccagttcaacgtcgtccacgagagaaacccccaaaaaggcggtgctgtcatcatcgacccggccgggatccggtccttttgccgaagctgggtttggcttgcgaggggccatggcgaacggcgtgtatgcggtggcgaaggaagagaatgggcgaaacacctgaggggtcaagaaatgttgtggaagagaggaatggaagaagagagcgcaagcggtaaaaatggcaagtgtaccggtgaaaaggaaagaggggtgggaatatatagctcactcgggcgaccgtgcctactcaccagtaataaagcgccacgtgtcgcaagggtaggcgaaacggtaaattcccaccgtctgagcggcacagtaaaaagcccacgatgggaaggcccaatactgttccgttcggcccgggaaaagaaaatatataaccaccaatcgcacgaggcgaagcgcggcaaaataataccagccgcacaagtaacaaacttcattcgcaggaataatgtaggtttcggcaggagcatcagtcgaaagggggcgccgcataccataccacatggtttgcacggtctcggccgaagctccaatctcacccttgcccgtgaggggcttgttggcagatggcatgatgcccttcgactaaatctgccgaaacctgtggcgaaggctatggagcaagaacggcgtgaggcgaagagtcgtacgagtgccctgccaggccagaggcgtctcaggcgaagggtgcaaggcgaagactatttgccgaaggaagacgacttcgccatggcaagttcgcccccgcgagggtcgaggaagcctttccggcccatcaagcctaagggctacagggccggcaatcgccagacggcccatcaggggcccatgagcccctataacattatgtacccctgtaaatgtccctttcgtaagggtaatcatgtaaattcccctgtacaacataaaccctagtagtaagaacctgtaatggggctataaatagtcccctagggccatgtagtgagggggatcccgaaaaaagaaattcaaaattcaatacacttcgtttccttccaacctctgttgagtaaccacgtccttcgacgtatgcagttgtcatttcgacaacaaagccttagaatcaaagaaagaatttcctttgggcaaaatccttctcggctatctgtaccaaatgttgaacaatgcatcggctaaaatagccgtcggctcaatagttggagcaggtggaccatggtggctgctgcaaacttggttaaacctgatagtcatgaaggttgtccatcggccctctgtgacagaagctgaattcccactgccagagctgtcgcgtcccaaaacgactctaaaatacaccctctaaattatgcctagaataattaaaaaccatgtgaaagccttcaacaattaaaatgtgcaaagttaaaagtcaaataaggcttagaggatttttgtaaatttcctaaaaagcctaaaatgtgtaaataaattttagtggaattttcagagcacaaataataattattaagaaatgaacaaagttaaaatgattttataaaaagaaaaaccctaaaagtcccccttccctccaagatcccttgggctggcccggcccatctccctccccctctctctctcctctccccgcggcccactcggcctctcctcgcgcgcgcgccgctgacgggcgggcccgcccgccaccctcgctgacgggtggggcccacccgtcatcccctttctcccgccgctcccgctgcctcctccacgccctagcgccgccgccgccgtgaatcccgccgcctcccgccgtccccgcgtgcaataaagtgggggaaatcactccccgtgatcccctctccctttccccccatttttccctctctctctcgtattcaaacgggcggatttgcccccgcaaatctcgtcggcgccattgatggcggccggacctcctgcgccggtctccttcccctccggccgctctctcccccttccaaccctatttaaaccctccccgcacctcctccgtccgtttccgcctctcgccgcccttcctcctcaccggattcgagctcgcgacgtcgctctctctctctccgccgtcgccgccaagctccggtccgccgccgtcgtcgccccggaccgcctcccaccttggtgccgcctccttcgggttcgctgcatcctcgccgacctccgccacctctctgtttcgatcgccgaccgccggaacgccgtcgaccccgttgacccgagccgcgccgccgcctccctccgctccggccgcctcctccgtcgccgccgacgccccggggtgagccgtggaccgtcgcctcctttcccccttccctcccctctctcggccgccgctccgccgcgccggcggtcgccggcggcaaccatcggggcgcgggcgcgctgcctcccgccgaccgcgccggcgtggccgccctcgggcgcgccgagtggctgccgcgtggggcccggccgtcagatgcccgcgccctcaggtgcggctgacgtgtggggcccaccgcgcccgccggtgtgaacccgggtgcacccggtccaccggggaccgggaggctgccgggtgggccccaataccgtggaaccggtccaggcgcccctccccctgggtgacgcaataaacccttttaaaattaaaatttaaataaagaaattcgtaaatattcatttaaagagcatataaacttcaaatggccataacttggccatttgaactcagaattggaccattcaagtctctaatttttccttaagaagtcaagaacccatttttgtgctttgttcttgctggttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgattttaggcagatgcttcgctggttaattaggcaacattatgtggttttacaactctagactttgggatattcatatcacctggacactacggaatggttggattattgtggaattggattcacacctccccctctattcaaaatcctcaaaatggttttaggctgggctcggggtgcatggttttgatagtagcacatcggccatataaggaccggtcttcgggcctctgttgcaaagcactaccgtacttccacatgtctagtggataaggcttagtttgtggctcagtctggttataaaaaaagtacacggatggagatggacgaagtcgggggtcgatggacatctctaggacaaatgaaggctacacgagctgcggcctggtagtcgagatgtcatggcacagggccggtgtcctgctgctaggggctcagtcctgcctacctgatccgggggttccggccgtaggtggggttgggtcggtactcttgtctatggctaggatgggtcggaaactatgtcacgtcttccgtccgtataccgtggtggtatgtggcacgtggttacacgtgaggaagatgtgtcttgtgggtaaagatgtacacctctgatcagagtataacctattcgaatagccgcaccctcggttatgggcaagccgagcaatgtacccaagttagtgtttttaattcttaaaacctgcttaacaactaaaatgtggaatggttggcctgggttggcttgggacgagctgggacccggggtcgggttgccagttcggtctgaatcatcgtaggccttgggttaaggcaggctcgtgtgggttcacggccttgattaataatattatatagctctagaatcgtgtttacaaaatagctttgagcaactaagtgtcttttaatgctgtttactgcaaactctaaccctttatactataacccccttgtactcccttgcatttattctgcacttgtgggtgtgtcttgttgagtacgatggttgtactcagccttactcaatttttcccaaactcagaagaggagttcctggaagatgaaggctttggtgtctagctcgtgcctgccgtcaagcgcctatggtcgtcgccctagtcttccgctgtttttcgtttgtcttcttgtgtgctgggccttcgccgcccatgtaatagattaattaattacgcttccgcttgttaaactctgaattgtatcaacttttggtgtaccttgcctcctgggacaaggaataatgcacgcacgtaaggaacgcccgttgggttatttccggtcgtgacaatccccctttcatgaacaagaaatcccaaaaactggccagccgatacaccaaaagcacattttgtcgggttcatcttcaggccatattttttggttctcttgaaaaccttcctcaaatcggctatatggtcctctatttctttagacttaacaaccacatcatcgatgtagacttcaaccaaccagccgattaaatcatgatatatgtaattcatggctctttgatatgtagctccagcactcttcaagccgaaagtcatgacaacccattcaaataagccgattgcaccagggcatctaaaagctgtcttatggatatcttcttcagccataaagatttgattatatccagcgtttccatccataaaactcaaaattttgttccctgatgtagcatcaaccagctgatcagctattggcattgggtattcatccttcgttgtagccttattcagatctcggaaatcaatgcacaccctgaccttgccattcttcttaataactggaactatactagaaacccattcagcatatcggcaaggacgaataaaaccagcatcatacaatcgtttaatctcagctttgacaggttcaagcatatcggctttacatctcctcggaggttgctggcgtggtctaacccctagtttgataggtagccgatgttcaacaatcaatcggctgagtccaggcatctcataatactcccaagcgaagcaatctctaaactctcttaacagctctattagcttggttctaaactctggagataagttcttactaataaatgtcggccttggccgatcgtctggacctatgtctatttcttccaaatcatcggccgacatgaaaccttgaccttgcttgtcatcgagatcatctactgtatccttagtgtagacatttgaaccctccacgatgtcctcaaaataatagcttgggttctccatcttcaattggctgtatattagaatcggacactttcagaaaatctccatcccagacttttccagataaacaatcaaggccatccatctcccaaagagctaaatcggcactggcaacattaactgacctgtcagctggcacgatctctatcttgtcgccttgccattgaatcaaacattgatgcatagttgaagggatgcaacaactagcatgaatccaatcccttccaagcaataagctgtaagaacccttcccatcgatgacaaaaaaagtagtaggaatagttttactgccgactgtcagctccacattcagaacacctttggtttccgatggattaccaccaaagtctttgagcaccatatttgtcttgatgagatcctcggcatttctacccaactttctgaacgtagcatagggcatcaaatttaccgcggccccaccatcaaccatcattttagacatcggcttcccattgacatagccgtttatatacaatggtttaagatgccgattctctgtcccctcaggtttctcgaacactgcctgttctggtgacagaaccaacttagctgattcctcttccacctcgtcgacatcggcttgatcgatcccgaattcggctggcagggtaaagaccatgttaaccggtgccatcacaacactcttcccttttgccaacctctttgcctcatcggctgcaacatcatcggctagagtaacctgattcttaacacgccactcctgccttggctttgctttcttcagccgatgattaatttcttgttcaacctcctgaaggcgctccctgtttctcaatctttgaacccttctcttctgattcttcatgaaaataccagaatgacaccattgattcttcctgattacattgtcctcttggccatgatcttgattcactggaccaaatctttgatgaacagaaattcttgtctgccttagccgattactcctattatatgatcggcttgatctctcaatgatatcactgcacccagggcagttttcaatagatggcaacctcatgctctcattccagcagaatctaaagaattcacaatcccaatgagtatcaaaaccatcatcgtattcttcatgatgcttctcctgctgcttgtcatacttcctctgatatttatcgataatcatagccgaattcgcctgaaaacccgttgcacggaccctattggctgtttggccagctgtatgcaccatattaacaggaaaagggttaccatcgaccttcatcggctttttggaatcatcaaacctaatcttgcctccctcaatggccacctgaatttgctgtctaaaaaccttgcaatcgttaatagaatgagacccagaattatgccacttgcaatacctctttttgcctaattcctcagccgatgggattgtatgaccagcaggaagttgaatttgcttctctcggagtagcagatcaaagatcttgtcagctttagtaatatcaaagtcatacttctcctcttttccagaactttttacccattggcatggtatgacctttttactcctcacccattcggctgcagctatttcagaatcatcgtcatcatcatccgacccatacatgtacggacaaacatgattaacattcttagagcttttcctaacttccgcagacctatgctcatgcaaggttactttctgtatcatatgtgacaagctatcaaagtcttcagacgagaacttctccctaatcggagcaatcataccctgaaaggccagatcggctaactgggcatcggttaaactcaagctgaagcatttgttcctcatctccctgaatctctgaatatactagtgcacaggttcatcatgccgctgcttaatcgctgtcaagtcagataatttcatctcatgaaccccactgtagaaataactgtgatattgcttctccaaatcggcccaactattgatcgacccatatggcaaagaagaaaaccaagtaaaagctgatccagacaaagataaccggaataacctaaccttcagagcgtctacagccgatgcttcaccacactgagctaagaatcggccaatgtgctcataagtcgatacaccatcttgtcccaaaaatttagagaagtccggaactttgaaccgattgggaagaggaactctctctcaaaccactcagggtaaggctgccgatacaagctcccagtctcttttggtttaagcccaaactgttccctcattacgtcagcaatcacatcggcccatggtcgttgctgagctgccccttgtgactgttgttgcatgggtccgaactgaccgtattgagatgcaaactgaggttgagccaatccccctgggtgatattgggcttgcggggaaggaggctgatattgataattcaagttacccccttggtaattatgaaggttcggctggatattacgtaccaagtgctcaggaacaacttgaggcattactgtgccatctggctgtacgtggtgaaccaagtgttctgggacaacttgatttaaaaattgttgtacaggctgaccaccaggcgttgcaaacccggccgatgtgcttactgaaccctggtgctggatcggctgaacgatttgctgtcttaatggcgttcgctgaatcggctgcagaggctgttgccttggtggtgtttgcggaactggttgcatgacctgttgctggattggttgtacaacctgctgaattgggggtgtctgctgaatcggctgctactgaatcggttgctgctgtattggatcaacaacaggttgaggtggcagaaacatggcagcaacctgatcttgggttagccgattcgcaacctgcccactatgctatggatgctctctcattaacaaccgagggttcgccggctggcctggcgccatcactgatagagcaggtagggcagttgatgccggcgccgttggctgagttgttggtgcaacggagggaaccggctgaatagatggctgaacatcggtaatcaaataccgataatttgggaagacaccttgcaaataaaccgggcctgcagcctgatgctcagctattgaaccatcggctattgacttcatcatgtttgataaggtattgactaacaccccagactaattgatcaaagcatgatgcaccgcgtaatcaacccgatcttggaagttattgaaaaaatcctgtgccacatcactattctgattaagatttcctccctgcagcccctgagcaccatcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgttcaggtgtgaatttttctggatcgatcggcacgacgtttccttcattgacatcagtcaatcccaatttcagcatcttttccttaacagagcctgggctagatggtggtggtggttgtttctcggccatgaggaagaattgttagctgactacttaaaggtcccatcgggcgtgccaaaagcgtgttgacagaaaacacgaggcctgggagatctgcttaactccagtgcaggtccaaagctcgccttcgaatgtataagcgtgccagttgatttgatcctgtaatcaacaagaaatagaagcaaagaacccgcggttaaatctataaatgatagtcgatcggctagaggccgatgacatatcatttatctttgagccgatgtcatatatgtatcgatcggcagacatgaataaataagaaggaactaaatctattcgatcggctgtagatattaacaatatatactccttatatcgatatatacttaaatcaagtgattgggatagatcggtcgccatgccgagacagtataaatcacttaaatcgaaatatatattaataatgggactatatatgttcatagcatagccgatcatatagatctaggatgtatcggctaatactccgataccactctatactaagatgttaaagtaggtagaatatatcaaacaaaggcctaatatacttaaatgcaataagatcttaaaataaagggcagatttaacatgtcaataaagtatatagggtaaatatagttaaattagataagatcagctgaaactccgatgctaccctaatcggcaaccagaaggcaggctagagattgattttctaagcacgacttaatatatcaaacttaactgatacggcattaagtatgaaaagaagaacaatatctagacaatcaagctgctggaagttttatagagtggtagatatcttatataatctaaatcaacgttgaaatctaacctaatcggctgctctctaccgacagatgttagccgattgtagattagatagctgcattgccggagattatgtaagatatatgatagctcgacgaattacataaacgagatcagagtatcataaagatggaagcactaatcccgagaacacaagttgtcataacaagttttacctcttgttgaagatcgaaaccgatgcagctcaacccgaaagtaagaactcgtcgaaataaaactaaagcaaaaagggtggtgatgagccgaaattgtattgaacgtgtgtgttcaaagttacatagggctcgggtctatttatacccgagaattacaagatatgtctataacggacacgactaatatctttaacaaactctaagatacaataagtctttacggcagacttttgcccaagcgtatctctaaagaaattatataaaacatcctaattaatagataaaattgccttctcaggactctatccttgtgcagtaatcaccttgaagtgcctcaactcaacccgatatcatacatgaagtcgcattgccggaatcggctgcatcggcttacctagcccgactcagacctagccgatcctaatcgtagccgatctagactccagccgattcctgctctgtttccgaacccgatctccgcctccgacttcgcttcgatctaatcttctttcccgatgccgatattaccaaatttggttgttaacaaatatgtaaaactatatgcatacataaaaatatatttaacaatgaatcaaatgatagaaaaagaattaataattacttaaattttttgaataagacaaacggtcaaatatgtttaaaaaagtcaacggcgtcaaacatttagggatggagggagtattaggaatcctagtcctgcaatgggcaatgggcaatggcctggagaaaattcagcatcattcagagatctcaagtttgttgatgctaatgttcagggctatgatcctgcaccatggcctgtcggcatccattgcttgtcaactaataagaactgctaccaattaagttagtccatatttagatggtgtattccattttggacgtcctggtggttgtacaaggttgtaaaatttttccaagtcttaatggcagaataagttgttctcatggaaatattttgggcttattatttgcatatcccaactgctttagcaagaacagaggaggtcatgttaagcactccctaggcttgtttcattcatgattaaccttaccataacttagtggagaagtattacaatctctgcattaaatgcgtgtcttggagaacaacacgaatattgccccgtgatggggcccgtcaaatcatgccgcctgacacgggggacatccctgtcagcggccgtcaaggggcaaagacttctgggtccatgttcacactgctcgtcgtcgttgcgcttggaggccacaaacgtgaaacagtgaaggacccaccggtcagagaccccccacttgcaccgggaggcggcgatatccgccttaattatattaaggcagacgtgccaccctcgattgtgacgggaggctaaaatctctcatcatgatcgatgggacggggccaggcgcacgccgcctggcacgcgtggtagtgcgcctgacgcctcggtcccatcagtcaatcaaccggtcatgcctgctcaggtcaccataaatgcgggtaggtgggcgctcgaaggcaaccacctaacccgttgcacatggttcccggtggaggggttcgggggagcccgaccccttggtcacacgagagggcggccgccacctagtctcgggcctaacccccctcgtgggtaaggccacgtggtgctgggggcagtctcctctctctagtcttgatacccccggacccgtatcaccgacaccggcatctatattcaatcggatatatgcaccctttttttttagaaattataaacttagcctatcaaataaggaacttagcgctcaaataatccaatctgaaattcactcctatttagatttgaactcaggaccttgagatgctacttaggtcactgcaaccattaggctacatgcccatttacatatgacaatgccaatggcattggtgctatcatgttaaaccacggtgtgccaatgatgttagtaccgtgaaaagggtttattctcggaataaaatttctgggtttatttgtaaaataagttttcaaataggctacagtcacttcgttgaagacaaccgcaatggttacatgtgtaacacgtaattgccaacgattttttttaatattctgggtttgaatagatgatgggagagctttagcaagaacaaagaagggatcatatgttactacattgagcctgaagaaaaatatggtcattttaagtttaagaactccctaggcttgtttggttcatgattattaactttacgtggcatatctcttttctaaacaacaaagtctggctaacaaaatggtaacctaaacataggcaatgttagcatgaaccaagctgtcacagcactcttcgtcatgccagatagaaatggcatacttaattacacacctgcacaattcttttttttaaaaaaagtaaattttgttttggacttctttctaccaaagtttcaccttggacctcctgttgacattttatgttgccgatgaaagcctgcaccttggtgcttgttaacatgtattttgattatttgaactaatacaacaacaataaactcaaaactaatgtatatagaacagaagatgtacacattgaatttttgccacaagttcaaaagaaacttttggaatttaagtttggttatctcacatttttcttttggaatattctcatgattttgcaacaaagtttatgaaaccacatgcatgttccaatatgtttttacatacatgagttttcaagaatgttttcaaatgcacaatttgcataatcaggaaaagtgtgcctaagagaatgtgattaacaacagcttctgagttatgttaccatctgtagaaacagagcatgtcaatagcacccaccaagcgaattctttacaaaaatatatgaacgatattcggatgagtttactaaagccctcgactctgtatactacataatcaagcactaataaaaggaaaatgccgtttgtattcgtacagaccaagcacaccagtaaatcgaaccacatagttttgacgctacggtattcgggcagatacaacacatattggaatagtacagtgaaagcttaaaacatggagaccgaaattcaagatggtaagcgagtcgacattatcaatatattgtgttatggcctatatcaactatcaagccctcgatctttgttccatcgagctttaatttcttccagttcgtcatcctgtcattgaagaaatcatgttatttagtcaatcctatgctttcattccagaacaagtgatttctctatcctgagttaaaaggacgttttagaatcaagtgaacaaatacaattacaatttagaaagcatatttatttacgtttgcaaaatatatatagttcatgtgctcagtggaatttctttagtgtgtcactgatgcataaagaaagaacatgaaatcactttgaaagccattatgaatagaatcgcaactggtatgtcaacgcacctcaaaccgatggtagatccactcagcgtataagccatcaaggaagttctgtggtgcagaattgttgttcatggaaatcactttgaagaaaggctggaaggagtgcttgatattagcattgtcccactgcaagtgctccaacaattcttcctcacaatgaataaccttcatattacatgggacggttgtgaaaggcagtgttgtcagctggggacaacccaagatttgcaagcactccaatgaaggaaagtgaaaggatgagtcgcagatagtagtcaaactctttaaataaattaaagtaaacctttttaggcaaggctgcgaaagagatattctttctttttcatctgtatttggcagattatcattgttagaagtgcttccaattatttgctgtagtttttcgcaattatatactatcaggtcttccagataaggaaaatgttgaacccacgatatgtttgtcaagctaatgcatgatataaggtccaatcgtctcaggttctgaaagagatcctggctttcaactccttcccataatacatctgtgaagtaatggccacatatgtagagcttctcaagattagaacttcgatgtggcctgttgctttcaaatacaatttgttcctcatgtgtgtagatgtataactccaacagattcctctgtatcagatcatttccgaacaaactgtctgaaaatgcaaaccttttccattcgtctagagactttgatttaatgattacacagagggatctgacaggtaagctggttttgcagagcatattcaagtattttatcttgcctacagtaattccaagagctttcaagtctgtcatgcattcaagagcaccaaatggtggttcaaaagaagcaggttgttccaactgcaacgagcaaaaatctgcaacctgcagtctggagagctttgacagaataacttcgggaatctctctgataggatttgacctgagaagcaagtactgcaacttaaaaaggagtccaagctcttgaggcaagtctttgattttattatctgataaattcaggtaatataagttcacaagtttgcacacttcactgggaatggttttgagccagttccttgagaggtctagatattgaagagatataaaaaaacataagctactcactgaacttccatgtaaatcattattctggagtatcagcacagtaagcttggtctggtcctcagaaatggcaggcagttgtgccatttcagtgcccactgataatatccgctccgcattacaccaatgtgatactgtttgtacaacccatttattcttctctcttccttcgtcaccaacaatccaaagtgccatgtcacgtatcacatcgtgcatttttacaagcctgtcatcatcagtttcctccaaaaggcacttgtctaccaactcacgaattcgtgcatatcctgcgttgtaacatctatgaatatcctcctcctctactagacccagtcccatccagtactcagatagtttgtttctatctaacagataatcatcaggccataaggcgcatgatgtgaaacaatctttcaaattagtatcacttagatattcataactgagtttcagtcgagcaaacacactttcttcattgcaaactggcccttcaatctcattaaggcgtgattgctgaagaaagtcgatgcaattctgccattctcttggatgcctcttggtagacatggccctgccaactacaataagagctaacggcagtccagcgagttcatttgcaacatcttttgccagtttaagtacaagggggtgattttcaataatttcagtaccaacattttccttgaaaagatgccatgcatctgtttcatccaggcaatctattttaatcctttgcccattcttgacacccatttggccacaaacactttcagagcgtgttgttagcaacaatttttgtttgtaattgccaattgagataacttcgtttggaatcccaaccttatcaagatcaacatgttcccacaaatcatccaataatataagaaaatttttacttttgagaaattcatatatgataactgcctgagattctgtgtcatccttcttcaccagcatctgttccccaacaattgcgtcttgaaccttcaagtaaaaaagtacttttgtcatttggagcaaattgacagagagcttaattaaataatgttgtaaagtatttaaaattagaagtatatgcagttttttgaaatatcaaaatgttagctggctgccaggagcccttatttaacgctagttattactccctccggtcagttttatatgctgtttccgacagccaaaatatgttatgtgtaagtcatttcgttggtctgaaacaacaaatatttccgtccggagggagtattacatgatagtagtacctgatggcagtcaatatgaagactgttagtatcctagaaatcgttgctcctataaaacaaactataattttagctggagctttgaggctccatgaattgctcattaggtcgcttaccctagatggtttgtaatttttgtcttttgggcaagctggatgcattcatctttgcaacaaatatactttagcaagatacagaaacatgtacatcaagggtcaacagttagcttcatctaattagttaaagacaaactttgatcactccctcgttaaagggagcacaacatacctttgcaacagagcaacctttggaagcagtaactcgaataacaacatcaaaagcagggtttttgtgaaacaagttgttgatctgatggagcagatgtgtctttcccacacctccagggccccataacccaaccttgcttacagcctcatccctgatgaacttgacagcgaggctgcgataccgatctgtaccagttaggcttacgtcagttatgggcacttcagaggaagcctgtggcaccatgacaccatattcttcaaacatgccctcactgtatatcttctctgcagcctgacagtttgctgctgcactcttggctatcatgtagtagtttacacagatacaaggggacaggctccccatgcacttggtcctcttaccatactttgcctggattttttcagtctccacacatacatgctcagcgcgcttcagccatccttcaacttcattcctccgctgcataccttttcgcatagggctgtccaacttggtctcaactagggatgaaaacggtcgggaatggtcggaaacagtacattattttattacttttttcgaaaacgagcgcaaacggtcaggaaatttctatatttatgaattcatctatttagtgtcaacttcaatgctacgctgacagaaattaaaaaaactaaaatttgaaaacggtaacatcggtaaaaatattattattatattagttttgcggaaacggtatcggtacggtcgggaaatttccataccgtttacacccctagtctcaacatcgctgagcctctctcttaaacgctcggtggcagcttcgagagcgcgcacacgcttgcgggctttgaagaagtaggcggcgtactgtttcgagaggcgtatcaaggagatcaggatagcaccagagcacttgatgccgatgatctccatggagtttgtggtattccttcaaccaggagaattttgtctgtgtttattaagagtgcaagaaccaagaagaccaaaaagttgtcctgtgttcaataataaggattgggttcctatctaactgacatcttaagagaaaaattaatgcaatagcgatggcaaatattattacatgaatagaagattcacataggtccaaaattagatggttcattcgatcatttaacacctaacagatgtattctatggaatcaatctgaattgatgagttcctttctggtgttaactaagaagaaaactgaatagttatcaaaagcgataggccgcacatagcttcaaacttttcgacatatgtgaagcctattgttttgttgatagttcatggtattgatgactaattaacgtgctttcagatgttattagtttaacatctgatggatgatgatgcatgcattcagtgcaatttatgcaggaattcctttcttactgactgagtctacaagaaaaaattaatataaatgacaaacgatgattgaactcacacgttggttaattctaaactagacagctaactataatacatctggctgcaggcatcgtatagctggatagcagtgcgtataaattaaatacttaattttagacttgggtgcagtgtgcatactcaatattaccattacaataatccataagaatcagttttttttaaaaaaaagaacatgccaactgaaataaaggataatgaaagttgctggttccgtccgtcgtcaattcctgcatgacttaagataaggatagacaacaaatcgagctcatgcttgaaggcctcgttgttttggcttatgcttattcctataagtcaaattttaaattttaaaacttaattttgaattctactctttgtttttttatcgtactttattttacaacatgcttatcagtcgctaagaacattatattaaagatttgtacatggttagtcttttatttggtaataagttattcatataagcacatgaataagtgattatttatccaccgacacatatatacaaattaaattggctcaacccgttgcaacgcacgggcatattttctagtacctaattaaaaataagcaaggtttccctaaaaaaaaatttcgtccgtctttttttatttttcgcccttttttctttttttttctgtccgttttccttttttttttctcagtctgtttcttttccttctttctctccgattctttttctttttttatccgtctgtttttttccttctttccgtccttttcactctttttcttttttcttttttcccagtttttccgtctgtatttttcgcctttttttccatctgcttttttctcttcgccttttttcattttttccctctgctgttttttcttaatttttttctatgcctttttaccgggttttttcatatgtttgttgctgtttttttagttgtattttctcgcacgtggtaagcatttgtttttttatgtgccatattttctacgcccggctgaacactagcgtcgccggtcgatctgccttcccatgcgttccctcttccaatcgattgccaaaaatcaattccccgctactcccttatcattttcctatgattttccttttaacgctgctttaattcactgaatttaatctttatttaaaaatcactgtttttatcccgatgtttgtcgctctgattttaataaaaacggaaagagaagatcgagtgtatcaaaaaccctcgaccaattttgaaagatcgagaaagattcgaccaaatttgatgggaggatcgattttggcatgtacagacacgacattgtctttcggaggttgaagactacagtcggatatgcgagccggacctacacagctccacttgacaaggaaggaacgaaatgagcttttggtctaaaaccaaagagtaaaatatataacgatccaaaaatatttttacccgttgcaacacacgggtattttttctagtaataataataatagtaagaaaacaaaaaagagctctgacgacgtgtacgttttcgtgtgtcgtttaattatttttatgccgagtctgccgatgtttgtcttgataatttgcttatttttttctatgtaagaattatcgatgatttatgggtgaataggtaatctagtctctcaaagttcactaaaggcacaatttaaaccctgagatttaattttatgcacataagtccacataagtcctcttaagtattcattttaacttaaaatcatctttggaccaacttaatatgcctcatggataatcctaatcaacatttgaattaggaaatgtcccttttgctcctaatctgcatagattagaaaatttcacaagaaaagaataaataggacagaagaaaagaataaataggattgtgcaggtactttccattatttaatggatacggtatacataaatttttttattgtacttaaattgctatgcattacgtctaagaaaattcgttgtgcgtaattttttttaaaaaaatatcatataattgttggatatatgtccaaattaaagttaggtatacagaagtcccatcttacaatttatttttcttgtatatgtggatgagaggtattagagtcattattaatagagatgcgcatgactttttataaagagagaatctcttatatgccactgaaaatttgtttgatcccttggatgccattgaaaattgtcacattcccttatatgacattgggtcaaattttcgctccctctcatgccattgccgtccgttgactggtagttgactgttgataggatgtaatcactgtcatttttttacagaaatgacaaaaataccctttggcccaaacataagaatatggcccaatcgtccaagtgggccaagcccaacatccctctgatgcaccatgtcagtaagcctgaacatgtattttggtactgtgttagtatgcattttggtactatgtggtcatttaaacagctccctataatatttgttgcatattctgtgctactgtgtatatctccatgctctagcaaacaatctgttggttattttagctatttagccgtgcattacaaacaatgtgcaattacacattatcttaaatgtctgtcagaagcaatctattatattgcttgaatgttttgtcatactgtgaaaaacagagaaatgttgtgctccctagtaaatattgttgaagcttttgttcgagaagcacatggtcaatgtatgtggaaaatacattaatgccataacagattgctttgttctactatgaaaaacagagaaatatgtgcctcaaaattatgtgactgaaaaatattcatatattcaatatatagattaatgctatacattcatatattcatttattccaaatatatgtgatgcatagctaaaa

SEQ ID NO: 8248 - DNA, 8529 bp, Oryza sativa
  unsure (1)..(8529): unsure at all n locations
ccctgcctgtaagaggtgaaggtacatttttatattgtagtgtatactccctccttcctaaaaaggttaattcttaaatttctactccccgatctaccatcagtcaaaaaatacagaagtttaatctctggagtatatatgaccaatatcctaataaaagttttatttaacgtttcattctcaagttatcgtattcggacgttcaattcttaagttcttgcactgtatcccacccacctactaagttgttgtaccgtaggtacaatttactcataaaataattatgaagaggaagagggaaaaaattcatctaaatcaaactaggcttaggctatttccaagactatgaaactagttaaaccaaggattgttttctaatttgtactaccagattttagaaatttcatattttttataaaaaatatgttgtataaattaaagcatataaattgacggtagcgctattctatgctctacaacgcggaatattagttcaagcgccgcataacgccctctcctttcagttttccccttttttactccctcacctttcctccgcatcccaccttttctcagttcatttttttgttttttaccactccaccttccgtgtttcttttttctcttttcatctcatccgtgatttttctgtttttctttccttctctgtagttttttctgttttctgtttttctttccttcttgtaaaaatattaaccagatttttttgtttttctttccttctctgtagctttttctggttttctttccttctctgtagtttttctgttatcacgtccgtttagtttttctttccaagttttcctttttctagtatctccgcacgtttcaaaagttacgaatttactcccagcctgccacatctgctcattcaaaagtaacaaatttactcacatgaatgcctccacatcgtatgctgccatacctagatggtcgtaaaagaattattaccagcttacaacgctggtaattcttttaccaatataaatattgtttagattttgtggtccatgagtaaaacaattactatcttcctcttgatatagcccatgatcttgtaaccaccgtgttgtaatatgtttacatgatcttgtagccaccgtgttgtaatatgtttactgatgtgttcaatacacagtataagagtaaaaactgaaatttcatggtctacgagtaaaacaattatcaccttcctctcgatatagccatgatttcatagccaccgtgtagtaatatgtttactgatatgttcaatacacaatataagagtaaaaactgatactaagagtattgttgatctgtatcacaaaatagtcgtatgaatgaaaaaattacaggctcaatcacacacaagcgataaaattacgccaaaaaatgattcagccaaaaaatccatccgatggctttgctggatcttgctatgaggatgaagagcacggtctgtgccttgtgactggtagtggagagggcaaccgggtggcgagcagtagtcgatgatggaatcatggaaggatgcgagcagtagtcgacgatggaatcatggaaggatatagtagtgtggtatagagatgagctcgacgtagctcagtagcagccatccatcatctagcaagcacgaaaaaaaatgcaaaaacattctctttcacgtcaatacgaatgacaagcaaatgaaaaaaagcgaacaacctccatcaccggtggactccaccctatcctctgcggccagccacatggagcacgatgtgcaaatgtaggacctgtgcagcccatcaattgagatcaggtaatactggagattgcacgttaatttgatttgaaaaaaaaattagagcttcatgcgtgaagttgaaggagagtatgcagatgcaaatcagagtgttatttccttacttgtttgttatatcaatatcgccgatgtggagcagccgctggttgctgctattggcccaggtgaacacctccttgctggttaaggtgatgcctagcgtttggcagtgaggtccgaagtagtgccttcgcctcaaccgctgccagccaccgctcgctggccaccaccatcaattgccacggtgtcgtcgtcctcctgcatggtgtgtcgccgatctgtgggctgggctgggatcgattcagatcccaaaaaaaggaaaaaaacatagtggggcgagagtggttggttgggtacgggataaatagaatatataccggaagcagagaagttgttttttatcaaagtaaatcatttactccgataatggtgggagcacgatgcgggacgtggggtgggatcggaagcaggggagttttttttattatcaaagtaaatcgtttactcgaataaaggtgggtggttgaggcgcgcgataggagtaaatcgtttactccgacaacggtagaagtgggatgacgaaacgtggggtggggtgggcctgggctgatgcatgtttggcgctgcgctcctaacagtagttctaataaattgatttcaataaatttaattggtttttatgtaaacttaagcatattttttcatattattttcaatccaccttattttaaataatattttataggatcgtagggatcgtagaatcaggatacaaactaagatttcatatgatcgtgtgtaaatgaatactaagattagaataccataaaaattaggatactaggtaggatcaatatcatttcagcttggtacgattatagtatcgtaaaataatataatacggatcgggatactgacaaccttggttgatagtaacattaggggctagattgatctcatttcatccaactacatctaattaatcccatatatcgctattaaatgccatgactaacctataaagtcacgcaataaaattgtgtactggagggcttaattcanggtggttggagcaagggtgagtgaaggtaggtagtgtgaaaattaaatcagaggtgattagtaagaatacagtactagtatatttcggatacagggcctgtttagttaaaaaaaaacttttccaaaaatatcacatcgaatctttgaacatataacatatatggagcattaaatatagataaaaagaaaaactaattgtacaatttgcatgtaaatcgcaagacgaatcttttgagcctaattaggccattattagccataggtgctacatagtaacccacatgtgctaatgacggattaattaggctcaaaagatttgtctcgcggtttccatgcgagttataaaattagttttttcattcgtgtcaaaaaccccttccgacatctgatcaaacgtccaatgtgacaccaaaaaatttttatttcaccaactaaacaggcccacaatttaaacgctataaaaaccaatattttgatatggagggctacatagataaacgaatagagatgtaactataatagacatgcaatgttgtcatttaattttcaacgaataaacgagtagataccggttagatgatgatcaatttgaaaagatctaaaagaatattcttaggagatgattaaattgggatgtggatggatcgagtacgtatgtacaggtagatagactcgcatccatatacttcctccgtccataaatgtttaacgccgttaacttttttaaatatgtttgaccgttcgtcttattaaaaaattaaataattattaattattttcctatcatttggtttattgttaaatatatttttatgtatatatatagtttaaatatttcgtaaaagtttttaataagacgaacagtcaaatatatttaaaaaagtcaaaggcgtcaaacgtttagggacggagggagtaccatatttccatctgaccttgtttactttgttaattaatttgctcacacatattgtattgtgcaggcaacaacgatgctaccgagttccatatgctccatgggccaaatcccaagaacttcaccccattcctatgggatgctgccaaagcagatgagcaaaggacatcctcctacggtcactagaggtacaatagtttttattgggattgatgttacttgacatgaccaagtccctctctcctatactaatcgttctaacgtggagtagtaaaggcaggagacaaattagctttaggtaaaaataaccaaactacccttaattattagttgcagatagttatttcaatgcttacgaaattgtcacaaaataattgcaccagccatgcctgctacccaaggaatatttctagcatggagtacaattatttaaacaaaaagttcgaataccccctaaaatatggcgctagttcgaattatcccctttgaattcaaatactaggcattttacacccgagttcttaaatctagacaaattacccctaatttaatcatgtgtagttttcagcttacgtggcacacacatggcatctgtcagaaaaacaaatactccgtaaaaatctggcggggcctattgtcggtgatgctttttttcctcaccctcaatgcctcgctctccaccaacaactcggaatcgaccagctatccgccgcccgtgctccaccgacaaatatctccttctcctctatacgatgaacacctagaggaggaacccaccgatagagggtggtgggacaccataacctacttgccttcctcttcatttcttcccctcttccgagcatgcttgggctttagatgctcaccgctgcatgccatccacccgactccctcagcgaagaggtcgacgcagatccaccagctccgtgcaggaatgagctcctcggcagcgacaacgatgagcttgatgcctactggcctctcctcaattcggcactgccggctatcaatttgatggggcggcgcctcgaacagaaggctaaggagggagcagaaggaggtccaggagaggcacattcgatggccagaggaggaggtggagccggtggtctcgatcagagtggctccgtcgatctagaccgcaccagtgcttaagcccactcactgaggtccgtggaggcgaattgcctccgaagcccaagccaaccaagaggaggtggtgtggatccgaacttggttcattgtcgagagatcgagtttgctctgcgatgggtggatccatcgctgtgatgttgccaccaccaaccaccgccattgttccacctctaacatcattcgccgccccgtgcacacttggcccacagccgtcactctaagtcccatctcggcaccgtaacttgggaataaggggagtcgagaggtacaagcccctcctaggcactgccctcctcatcggcaagcgcatgcaatggaaaagctgtgatgcgatgcatgcgctagcatgcttgtgatgctgaggaggaggcggcgtgactctttgtgctaaggtgatctttgtgttgatttgtcacgcccagaaattcactgatattttccgaacttatttgtgcataaaatcctcgtccaggaattagctgaggtacacaaactgacaatttaatatacatattcatcaaaataactaaagagattaacacttactgaagaggcacttagtccacacaacaaagaaaactgcagcggaaaataaaatctagcgaagctccggctccactcccacaggcagctcaactggggtataagctaaacgtcttttccctctggatcctttttcttcaactgaggtttaattgattattgcaaggtgagcatatgacatactccgcaagccacacagcaaatatgcaagtgcacaaggatatcaaatgatggcataatataggctcatttgcaaaagcagcatttagcaaacatttaagagtaataaaacagtggagtaattaatcatcaattttaatcaacactgaacagcacacccatgctggtcaggcccaaccctcctgaacaaccatacccggctgtacagatctaactccaaaccaggagctaagcaaactattaccagttatagcatcaataattattgtgagaggtgtgactctaatcatgaaaaacattgctcaacccgcccatgaccgcgggcacggctattcgaatagttttactctggccagaggtgtaccactgtacccacaagacacagccccaaaacatgtcaccatgctctcagtaccaccacggtacctcggaacgggactgtgacagtacccttcgcacaacacaacccaccacagcgcatcattcctggatcataatcactccctctacaaccagaggcatggactccctagcgacccccacggacttctcgccgcttctcagtctggtgccccgcaatgaaccatgctatataaaaaggtaaagccgttgcccacgctggcttgtggttggtacggttaatgtctcacatcagtagctcgcgaaccggtccttaattgtcatgagcacggccttcaaaaccatgtgctcacaacccaccattatcaagttttagttggcaagtaattaattaatcaatcacgattgaccatcgtgagctaccattaaatataacaataagtgatagtgtaacattagttatcccaatcatgtgctaatatttctaagcatggctaagtaattatgtctaacatctagcggaaccaatatataaagctcaactagtcaaattataataacccaaggtatcaaggaaaagggtaatcaatgcaaattggccataacaaaggaatagattcacaccacccggtgacattcgagaataaatgtacagttgaaataaatagagaatttaaatataggatcaacatgctcaaaggaattgtgtttgggatctgtatgacttgccttgcaataatcggtcttcaattagtcttctgaacaacttccgacgcactcacgaaccttcgcaacgacggaaacaagctaacacgcaaaacgagaaaaaagactaataaaaaccaaataaacagtacataaaagtaaacaaacatgtagatcataattttaaatgaattatgagacttgaacggcctcattctgacttcatatgaattagttatgaattttacaagattaattccaattaaacctattaaagaaaagactattccaaattaattaaacaatttacaaataatttataactgaaatataagactaaagcatcctccggaaattattggaatgaacttagtagacgacatatagtaaaaacaactaatatgccattgaaaaggaataacatgatttatattgattttggacagctgagatcaactttgacctagttgaccaaaattggatggctcggattgatctgatctaaggttttagatggctgccacgtgggatctgagagacggcgtggcacttaggtggcagcgacggcagctgacaaggcaatgacatggtaaccacgcgggatcaacgccggcggctctattcggcggtgaggacggcaaatggcggtacaacggtgaaaaccgagagcacggagaggaagaggaggacgcgacgatccttaccaacacttacgcagcgatgaacagcgaaggagatggccgacgacaagctccgaagggcggcgagatactggtcaacgatgacagcggcgttccagcgatctttggcgaagacgagatggtggacggtgttctccttgcagctgcgaatctaatggaggcggcggcgaccgaaggcgacgacgggagtgcaaacatgttcatggagtattgcattggtaagtagaaagttgagcactattagcgatggtggcctccactgggactgtcctaacttagccatatattccatgctatacttacgacaccataataaactttgttgttcaagtttggtgtccttcagggaagaacaaagagatggaggtgaccaaagtagttttttaaagtgttttgagtagatttgtggtgcagtagtgtagatacaatttgtttatggtgttgatcattactactaaattttttatgatatagatagaatactctcttttgaaaatgaccgagggtaatcgttcgatgatattttaaaaaattatagctcatgagacataccaccacgataatatccatatcatcattttattatttatattttggcaaatatgtatagtgaaatagttctaaaaatataaaaacattttgagaatcttaatctcaaacaaattataatttaatcagaactacttgaaaaacacaagtgttgaagttattattttctaataatagatccaatctaatagtgtaaaataatgagtccaccaatttaagtgaaaatcaacggtgagattatatagtgcccatgtggtggcttagaagtgagtgccacgtagcgacttaagagcatccataggaggtttaatggacttttagtatataatagaatttttacatatgttgatttaaattgtgaagtgatattgccctccctaaaatatgttgtgatttttttgaaaagttatcatacatatgttggcctcatgtgccgtggtgtatttaggaccataatataacttttataatttaattaaagaaatacaacatgatcgcaaattggatatata

SEQ ID NO: 8249 - DNA, 1157 bp, Oryza sativa
catatttatattgtagaaaaaaccgtccatttttatatatctatgtttattggttgccttttctatctatgttcgtacgtatggttttttcccgttaaaatcgcatgtactactcgtacgtcgtaagtactggagaacggtagtaccatagtagcgtttgtatctaaacagaatgaagttattactttcaataatagatgcaatctaatggtgtaaaataatagatcaacaaattttaatgaaaatcaacggtgagattatatagtgcctatgtggcgacttaggagtgtttataggaatgccacgtggcggcttatactacaagaatatatttaatctgtcacaaaatttccgtgatattttcagaaatcgtcatggatatgcaactattgatacaaggcccataataccgtgacagtttatcgatttcatcgtaaaccggcccaaaaactgtgacgttatatcaatttcgtcgcgatttacaaatataatattaaatacttcaaaattatgaatatcaagatctacaacttttgttttggtcattttgctatatgactctgtttcaataatttcaatttgaatttcaaattatgacaacttcaaacaacattttcaaatactaaatgatttcaagtgaaaaagtcatcaacaacaaaatatctgtaacttttattttgatcatttcttcatccaatagtaatattgtttataaaattttcacctcagccctagtggccgtgttttgccctagccgacggcgtacggtacgtcggtacataccgtggattaatcgatctccggctcaaattaatcgagccaaatcagtgcatgcatcaatgcatgggttgctgatgtgcacaatgagactcaccgatggttaaccggggattgacgaagcttggacagtgaagtctactccgggaacggctcaacgtacggcggcggtggtttcgcacggacggcgttggcgagttagggccatcggctaggaagaaggttagaaaaacatgcgcaagtgatcgatctattgctcaccggttgcggagaaatccacggctaagcttgacggccgagcggaggaagacgtacaatgggcgttctcctcgcttgggactcatcttggggttttctactcctggagggatgcaagcttg

SEQ ID NO: 8250 - DNA, 638 bp, Oryza sativa
aatgtttcacttcttttgttaaatctattccgaagtattttattatttttgatgctattgtaaatagtatggttttctaaatttcttttttggatagttccttgttagtgtgtagaaaaacaactgatttttgcatgttgattttgtatcctgcaactttacggaattcatttgttagttttaacagtctttttagagtctttagaattttctgtatataagatatatgtcatgtgaaaacagagacagtttcataacttcctttccaatttgaatgcattttctttttcttgtctaattgctccggctgggacctccagcactaagatgaatagcagtggtgagagtgagcatccctgtcttgtttctggtcttagaggaaagagccttcagcttttcatcattgggtatgatgtaagctgtggtcttgtcatatataacctttattatattgagaagtattcctgctatacctaatttgttgaaagtttttataagaatgttgacttgtgtcaaatgctttttctgcatctgtttagatgatcatatgattttttttttctccagcactgaattacatttatttaaatttttgtcaactccagatgagaaaaagtaattttccttgtacttgtaat

SEQ ID NO: 8251 - DNA, 5514 bp, Oryza sativa
caaccgggactaaagatcaatctttagtctcggttatttcacccgggactaaagatagcgatatttaatcccggttgaataaccgggactacagggaggttgcgaaccgggaggaaagatggtttttccaccagtgatacgaaagaggtataaactacttataggccatgtaatagacagagcagtatatgaactacaaacacaatcaaataaagaagataattttattattgagctcatagtcttacaacaaaagtaaagtactaaaagcatgcatgctcgaatctatgagaaaactaggaaaccgaacaactattctaagcctaaactctactaaactagagagtatacaaatatagaatagagaaattgcttcttgagtgtgtgttatgaagtgagaaggatttctccttctatagtggcaccgcggcccgaggtcgctgagcttcccgccacccaccgccgcctgctccctgctgcctccttgttggcgccactgcccgctgcccaccggctctcgctcggagaggagaggaagagataggggagaggagaggaaaatatcaggagagagagagacagagagagaggagaggaggtgaaaaaaaattgaagttgtgagaagacaaagagaaaggataggagaaaaaactgtggagaagagaaaatattttcgcaccccacatacgaaaataggcttatttttttatgcagctgcgaaaatatatatagttttgtatgtgagcctcttaaggagccgtatgcgaaaatagagatcgatttttgcatacacgactagttacggtccgcccgcaatttataggggttctcatatagaaaaattatttttatagtaatgtatgttaaactatctataatgataattattttgggacggaggaagtaatatacaactggttgtatacaagcacgccatcagtacccagtatcacttagctactatatattaattccagatgaccgtacgattatctattatatactatattatatactaaaagttcattaaacttcctagaaacgctcttaagtcgtcatgtggcgctctataaacactcctaaatcgccatgtggcgctctgataaattagaaaaaatcctagaaatttttttaaaaaaagcatctcaccattgattttcacttaaatcagtggacccattagttttaaccattagatcaattttaaagcaatatatactcaatccaacatatgggcctactagatcgatctcacagaatatgtacccttcccttcccctgccgtacatgccaacgtacgtatgtacgtaaatatgtgatacgtattccatatgccctccccttttctcctattttctaacaactcattacaaaatagtttaaattttaaatagctaaataaccatgattctcaatttatatacaacatttgattcatttgtactattttcatttgtaattaaataaatacatcaagatcggtattgcatatattttgcgaaggtaaagaaaaaactgaaatacgtttggacatagaccctagcatgtcagtcattaaacaatataaaaaaaattgacaacaactatatcatcttaaatcattctatatatacatatgcacattaaattaaatatcatgtaggacacaaaccatcacccttcacatcttaaaaattaagaaatatcgttgaaattctatgagaaataaaaagcaaaacatcctactatcattttacacttaaatcggcagacgtattaatttcagccattagatatatcattctactctcataagccgctacgtatcacatcttaaaaattaataaaaatcacataaattctaaaagaatgaagcatccgacctcaataaaatcattatttcagtcattagatctatatttaaagaaaaactataaaaaaacaaagtaccatcccattccccctccccctcacctggattaacaaagctccatctttatattctgaaattataaatatatagtaaatgaataaaaatatcgtgggagtatataagcatactaacaaaatcatggagtagggaaatcgtcaataattaactcaagttgcacgcattagatttttaacttatgtggtatgaaaactattctacatggaccaacgggagtgctagaaaggtccattaggacacttccaaggctacacgtggccgtcgatggagacaacaattaataaaaattcatacggaaaagcgtaattttgtagtagagagagcatgtctaatatcatatcacgaaaagacaacctttcatgagaaataacatataaactataacttaaatgattatctcaactctcctttgtactatgttatttgtaggagtaaatttgtctactgtggtcaatattgtcgatggcagtaacatccttaactctcctaagatttatttcgaggcctaacaaattagagaacaagtcagagcacaatggggccatagtaagaatgcacggggtttgtgcgagtcaggaatcccgacaatggaattgcctaagcatcaactctattttatactgacaaagaattacattggactctagcaaatgagagaaaagtccgggcatggcaggcgttgtgcgagctaggcattcatggcaatgaaattgccaaagtacaactcgatctattttgtattaacaaagaattgcataggaactaactccactgttgaaaaataagtttgtcgtaaattcaagattccacaattttggtgaattttaatttagattttctatgttttaagggtcgttacaaacaaaatcataaccaaatttcagagcaatcccaaatagatttttgagagaagtatcataagtttaaaatataataaaaaatccaagtaaaaatcagccaaatttatacattcataaatctattatatactaaaagtccattgaatttgctgcaaacgctctcaagactactacaaatgctcctaaaccaccacgtgatattctaataaattagaaaaaattctagaaattctgagaaaaataaaaacgtacggctcttgattgtcacttaaatcagtcaacacgttatttccaactattagatctaatctttataaactaaaaaaacaaattgagaaggatatgtgcttcaacggtgattctcaccaagactagctaatgcgggagccctttaattgtttatatatggtgagcttgagtggtcgtgtaagtgctgaagtgagaagcatggtgatggtgaagttggtgtgtttatatacattggagccataacttcaacgtattggagaaaaataaggtgagccaatgtggggccttgattgttgtgtatgtgagtagcttgagcagctaagcggatgcaaacaaagtaattatacaagatgttaaattcttatttgttgataatatattatagaagaacttaatggtgctttggaaataccttatatttattttgagaggtgactggagtggtggtgaagggtttccatataactaggagcagcaaccgtggtttataagtgaacaacatatgtattcttattatttgatatctgatagatccaagttcatgacatatttgacagcatatatagctctttcttttctgtctccgataatgaggtaattaataataaaaatttaaggactattttatggtgtagatcatcatagaaaatattaaagacgctcgcgcaaatgcgcgggtttccttcctagtttcttaatttctttatccaatagatcgcagtagccgccatagtagattaatttgcactattaatcagcaggtttgacgatatattttctgttttacacagctggtccgattagacttctgacctctatggcttctatatatgtcgagtttccattcgagttggatactctgctaagatttttagctacacataaaacgatacgaatataaaattagatgggttattagaatataattaactaaatagtattaattatcatagattttaaatatatttatttgcagaagagaactaagggagtagtttacatggtgttttaactttcaactcatgtatataaatataaataaatactgcgcctatagtcctactttttgattgatctgttcgtcgttgcagataattttagagtgtcaatcttgcacataaatttacatatattctctactaaattaattttcgtataaagcatgtgcatgttttgataaattggaaattgaaggtaaaggagcgaggtagctatagcttcttcttataatttaccaattcgacaatcttaccgtacatgttttcatcctgtagctgatgtatatatatatataacctgttgatgttgacagtcaacatgcatgtgccgattagttggagttctaagttccaacgttaaagaaacatgtaattaacagtttcacatactaattaatactagcatataacccggttacatctctcgtcaaaacagcagcgtttgcccgttctagttccaaccttcaaaggagacacgaacataaaaaaaaaaaaagggacttacctgtactcgcatacgtctgaatatttcagtaaacttccaatatcattttgacattggtatattttaacctatgtatccatcaatgattaagaagcagagataataaatctcaaaccttgatttgtcagacgagctgagagatcaattgcttcggctcatcatccgtggagtatttgctacgtaatctttgaacattcaactgcggggaattcaatccaagaagtgacatagtactaatgaaaggtaattcaggaataatagttctctaattagcgaagctgctaggaaatcctccactgaataatcatgtgcgctatatatctgcaactgatgttgaaacgagccagttttcaactgatgttgagatcgctttcccaattattggttgactcttgagttcgttcatcacgagtctatgggaatttctttgactagccatgaagctgtaacatagacaaggacaatatcatattttaataattagctgatgcaaatgaaaggcaatacaggaattaataattcctgattcatgacgccagtcttctttatgaagaatttattttttaaggcttcattttcacccaagttaactactttgtcagacgtgcgttatttttttaatttatccgaaatatttctttgggtagttccatgatagaacagaactagatgttgtacaaaaacgacacaagccatacggaatttccatatatatagaaaacaagtgcagcaaataatatatgtttatcacgatgatttgtgtaccatttctttctcaaattattggtcgctttgacttttttcttgcaatgtttgaccgttcgtcttattttaaaagttagtgtaaatgtaaaaaagataagtcatacttaaagtgcttttgataataagtaaatcacaaacaaaataaataattatttcataattttttgaataagacgaatgatcaaattaaaagttacaaacaaaaac

SEQ ID NO: 8252 - DNA, 16520 bp, Oryza sativa
  unsure (1)..(16520): unsure at all n locations
tacatgtcactgttaagatgtcgactagcgagtaccatgtaatgccagtccaaactaacctaatagttcacgacaaacatttttctcatagtttgactcccttgctgatcagctccatgattcaagccgaagcaactcccttatccatggaaatgtctatatctttgacatattatcattaatttccattcattgcatagctaagctaaagtcctaaattcctagctggaactctgaacagctataccaaagttttgtcgacgaacatcatcaatttccgacagaaatgatcggtgaagattaattacagtctcactgtctccgattgcatcacatccttgacagctgctggactgtcatctttaactacagattccttgagaatttcctcgtcgcagctgctggactgaagaatgaactgaatattagctntgcttctagaagtgatagtagtggttagcaatcgtattttctcagaatcagtcagcagctagaatcattaattgttagtcaatgaagagtatctttactttaaaaatgatgaaaagcgtcttgctcttacgtagctagctagccattctccatttattttagtactcagaaaaaataaaattaaccaaatgtttgaattgaggatagattcagttttttgactattggcccggtccatgcttacccatttgacatgttagtggtgccagttatgtactgcagcctctgatgctgatcgagtgataggctcatagcaaacatagttgacgaaaacacatgaatgaccatatgagttgtctaggacaaaatattctgacaattgactaatatattaccccaatttgtccaaaacagttttgacatagtacactcggagagttttattttccttgtgcatgaggtgcaagaacgaaaagttcctcgtatttcgtactcctacatgataatatatactccctccgttttaaaatgtttgacaccattgactttttagtatgtgtttgaccattcgtcttattcaaaaaatttaagtaattatttattctttttatatcatttgattcatcattaaatatattttcatatacacatatagttttacatatttcacaaatttttttgaataaggcgaatggttaaatatgtgctaaaaagttaatggtgtcaaatattttgaaacggatggagtatatcacagcaaaacatcctgtcatagatcgattctcaaggtctaaactctagcaagatgctaaaattctaatcaacacttagtcacaaatgcatgtcattaagggtgtgttcgtctttaccacctcttcccaacttttactcaatcattttccatgcgcacgcttctcaaactactaaatacatttcttttgcaaaaagtttctataggaaaattgctttaaaaattaatattaatcaacttttaactttatttcagctaatatttaattaattatacactaaattaatattaaacaattcgaatgatatttatagttcaaactccgaaattttgatcgagtggttgttgaaaacaactaatcttactgtgtttttccccattagctgagtagctttttcggcccctgcagttttaattagtattcctcccagccattgattttgaagacaatattgaaaacctcaaaaagtcttttagctagttctacaatttatgtgctttgtcttgcacatgtattgagaaaggctagacttccaatcaattattctctaaggctccatttggtgttgcattggatactattctctagacatctcgttgggtacaattgttttgaacttgttattgttatgatgcaaaggataataatattttgtctagccttaatttgtctgtggaacaatactacaaacaattattgtctttattttcccaacaacttaaaaatatgagcacgaggcaacataacaaccacaaactgagtgtaccccttttacttctcacctagaatatataaagttcaactttctaaaaattgaagttagcaagttaaaataatgtgactatctataaaaacaatatcgattggtacatttattttcaaaatattactagccacatcgtcgtgctttgtgcgactattgattatgtttaagaacttatgtatatagtttattagttcagcttagcttttaaaaaggttttgacataagttaatttatttatagaatatcgattggcctagtcaactattgtcttttttaagttatatatgtttataagaggaattggagcctcctgttttaattcttcattatctttggcccctctctatttgtatcagtgtctaagatgagacactagaaacatacagaaattctcatatgtttagccatttgtgtttttttattaatgcatgtatcttttgacctaatgatcattggttatctaaactcttgatccgacggtcaatatgtttttgtgatgtagcacatccttatgcaagaaagcttgctgcttttactatacagtaatataagttcattaatatataacaatgtataattatgaaatatagtcaccagaattgaatgcgtgaacgaggagataacttatccaaagaaaatgctctctgcaaattaaaatgtttgtcatgtccttttttttcgttcacaccatgtttaaactatactttcattttacactgctgctctaagccaaaatctggtgttagagtgcaccccaacccaacgtcactctactctaacctaaagatcacaaaatttgacgatcactttatagtttttttagagaagggtattttttacccggcctctacatccaactggatatatgcagcctttttaatttgttaacttagaccctcaaacaactcaatctaaaattcgctcctatggagattcggactcaggactttacaatgctactcaggtcactggaagccctttcgcgacaatcactttatagatgcatagtgccatagtataaagtgcaacactcaaataacccatgttatataattagtgtttttttacttggtttgagaatatatctttacttgatttgagaatatatcagaaggcactatattttctactagtatataaaaaaggatcatatatacggcgcataagaatatgcagagaaatttatggcatgagcattcaaaatgtcccctaaaaattaacaaacaaacggagtaattaattaaaatcatttatctactcaatttacatagagtttgtaatcttacggcaggttgttgagaagactttgcacggggaagaagacgacgacgaccactgctgctgctgctgctggaattatgccctgtggccaacaagctgacatccctcttctcgttgagaccctgcaggatgccagccacggcatccatggcactgcaccccgacgacgaccccagcactatcttcagatgaagctcttgacacttgttcggtgaactgccctgatctgccgctgatctgctcgtgttgacctcaatcttgtcatcgtcaggtccgtcgtctcgctcgccgtcgccgtcgccggcgtgcagctgctgtgattcagatagcttcctgttcttctcctccagctcagctatcctcgccttgaggacgttcacgtagtcctttgctctcatcagcactgatgctttgtccttctgtgctcatcgtcgcacaagttacaaatcaattagcattaattaattggttaaaatttataaatgttactattaataaagcatatataggataactgatattagccatgctagtcatttttagctaagcttaagatattgataagcaccttatgagtagccaagctagcgagaatctagaaaaagctagaagctagattttcagcttctggtctccattttattttcttaattctataactatagtttgtattctgaatgctaattctgaattctatagctacatattctccaggtaacaatctagatttgagagagtttgggattatgtgagaatctttcgtcaagcaagacaacagattttgctcgagattctatatttacgtaagcttttagattaaattggtcggtaagtagacggaccttggtggcgggtgggagcacgtccctgagagccttgaagctatcgttgagcttctcccggcgcttgcgctccgacaagacgtgctgcagctgcagctgctggttctcgccgccgccgccgccggcggtggccgctggcgaagcccgcgcggccatctccatgatctggtagtactgcgcgagcctcgccgcgtggatctttgacagcaccgatatggccttcttgaacgccctctgtccaccgccgccgccggtggcggtggtcgccgcccctggccgccggaggagatgcttcttcgggcccaggtaccgggagtacggccggaacgcggtggcggcggcggcggcgccatggccgccgctgctccgccgtgctgcttgtcccggccgtggtagtagtatctgcgacgacacctccgttgtctggtggtggcaagaggcggcggcggcggcgagcatgagcgacgagttgtcgtcgcggctcgtcgtcgtcgtcgtcgtcccggcggagaaggagcggaaggaggacgacgacggcgacggcggcgtggcgtactgatgatcgtgctcctccatgtccatcagcatgtagatctgaatcaaataattcgcaacgaacacgatgatgaaaacatgattactccacaacaaaacaaagttcgtcaattactagcaataaacaagatgaattaatcatgaaaattgcctggctaagctgctgctgcatggcctgcgactgcgagttcatcatcatcgtcatcgccggctcctgctcgtggtggcgcagcagctgatcagtagtcgccatgtcgctccagctgcatctgatgcaagcacaaattaactaattaattaattaattacagcctgcagaagcttaagatatcaaggatagctgcatgcgtggcaacgacgaccaggccgccgccggccggtgatcaccgtgtaattaatacatatatacctgatcatggtgtcgccggcgccgccgtgcatgtcgccggcggcggccgccttgagcatccagctgccgccgtccatgcctgtacgtacgtacgcacgatcggatcgagctagctctagtcgcgttcaatcgattaattgctctttaatttggctgcttcttgagctatctcgtctttgattgggaatggtgtgtatatatactagctagtaggagctaattaagctgtgaacacacttaatcgtcacaaattaattagtgtgcatgcacaaccaaactagtacacataagcgctgattcgcgcgtattctaccgctccctccgtactcgtaaagtaagtcgtttaggacaatgtttaaatcaaatcttagaaatactccctccgttttgaaatatttgacaccgttgattttttagcacatgtttgaccgttcgtcttattcaaaaaattttatgaaatatgtaaaattatatatctacataaaaatatatttaacaatgaatcaaataataggaaaagaattaataattacttaaattttttgaataagacgaacggtcaaacatgtgttaaaaagtcaacggcgtcaaacatttcgaaacgaagggagtataaatcatgaataactctcaagttattgggtttgaaaatgtaaaaattatatgaatagatttgtcttgaaaaatactttcataaaagtatacatatatcacttttcgataaatatttttatagaaacaagaagtcaaagttgtgttttggagacagtgtcactgtccaaaacgacttcctttacaagtacggagggagtactaaatattcctatcgatttttaatatacaacgtcgttaacttctaaatatacgtttaaatactcatattatttaattgtttttacaaacataacaaaataagtcatgctataaacattttctataaattaattaaaaaaataaataatagttatataatatcttaaataaaataaatgattaatgtatataaaaagtcaagagattttttattaaaacctgatagtatatataagtaaggaaagtattctaaactctctaggagacatcccttattgtttatatgtcatttaaatagttatgacaaaatttgaaaaaaataaaaaatatagattaatatcttataaatcactccacaaacatataaggttaaatttaatttttacaaattataacgagataaaaaaatttaactataagtatacattgtatacttattagttatagtttttttttaacttgtacaagttaaaatctaacttacatatttgtagagtgatctattacatattaatctacattgttgaattttaaaaattttcttcagatgacatgaaaataaatactcggagtaacaaacgtatgtatcccgagaatttagaatccacgagtagatcgaaatgtatagtaagggtgtgtttgaggagaaggggattggagagattggaaagatacgtaaaacgaggtgggccattagtatatgattaattgagtattaactattttaaattgcaaaaatggattaatatgattttttagagcaactttcctatagaaattttttgcaaaaaacgcaccgtttagtagtttgggaagcgtgcgcgcggaaaacgaggagctttctcacccaatgtcactggaacgaacacagcctaagtcgtacgtggtgcaggctataactggaattaactagtactaggactagtagtttagtattttttaactgaactagtagtacgtattaattactcaactaattaatgaacgtacgaacgatgggggattaatcaatttatcgtaagccgccggcggcgtagcgtacgtacatgcattcgatcgggaacgtttcgcaatttcgcggacatcgtctatatatcatactatctaggattttattttaatttcgggatgaaactttggatcccttcaaattcagttcaaacccgttcagacttaaggacttgttcgaaactcaagtcaaatcatcgccgtccaatggtatatacgaattataaaaaaatctcatataagacggacaatcaaagttggacacggaaactcagggtttgtctcttttttttacggagggagtactagtacttttttttttttacggagggagtactagtactaagatttgtaaatcctaatactggacgaagctggctttgtcgttattgtgcgcatatatctgaattaaaaggtaagactactcggaatcagccaccattttgttggatagaagaggctgtaggtagatagaggccacagccacagaggctggaacaagatgatgacaagtcactcgaaaaatctctgctccatgcatactagtaacataccagcacagttaatcgtcagtcgtgccatcgtttatgagcaaactagttattccctccgtcctaaaagagtgtcattttagctataaactaagacatatagcaccgtagaaaatataatagaggcttggtctgatgaaagaataagaagagtgcacaagagaaggaagactgacttaattaagtaatattagcttccaatcctatggatcaagactcaaaataggtgctttgcatcaaaccagcccgctggactcaaccttagctgtaaatccattttctttataagcataaattgcaagtcctcgctagcaagccaaggtagcaatatgaggttgacacttatcgatagaggatgcgtctatacccacatgaattagaataagcacattactctcccttggaaatgtaaccaacattggcatgtttctatgacccaaaacattaggacgaccttgtttgaatcattaccaatctaaccttattaaaatattggtaatgacaagatttggtaaagcaaaatttaattttggtaaaggatggttgtttggattgttgctaatttttggtatctgtatgagcttgccaaaatttttggcaccaaatcagatagatgcttaccacattatggtcaccaataattttttggcatggcaagattggggataaaatcaaacaggttgtatatatcttccccacccgccctatgaaaaatccaccaactgcatacaaccctcaatttgttatctcccattgacttctgcaactcgttgcatgctatagttgtttgtccagcacatatgccaccacccttccacttcactagtggtgtcttgacgcttacgatgcataccaaaactaccgatgccttcctctaccccataaatacattcatctctaaggctccgttctgttcttcaactctaaacattaacttcctcgttttccatcgtcagcatgcttttcaaactgttaaattatacgtttttttttaaaaaacatctatatatatgttgtttaaaaaaaataaatttatttttcaaatttataataattaatattttattaatcatgtgctaatgaggtttctcatttcgcgtgcagtacgaatctcatccaggaggaatctaacgaagcctaaatcatctagcatgtttttgcttcaatccaatgagttcccgccaccccacccttcaagcctatttctttccactgctaggccattaccctgcctttctctatacctgaagaaactcccctcttctaccttcctaacccttcccaaccagcctccccatccctagcctcgcaaattacactaccagagattgtgaagccaccgcgtgcctctctacgttaccgagaggttttgcatactctcggtaagatttagaacataccgtgtgtttccacatagaaactcgggaacatcgaaaaattaccgtgttccaagccgatactctcggtatccgtgggacccactgtttcaccgtgacggggcatattatttggcttcgtaggtgatgatttccgtcaacgtgaaggatgggaagcgctattttcgttggcgcggaaggatggcggggctgcgattttcattggcgccaaaggaacagtagattcccgagaatattcagtgcatttgccttcggtaacagccaggcccacctgtgacccaattagcgatcacatcaaaaattaaggtagaaatagaaaagaagtgatatgatgccggaccgtacttttggtattatatatatatttaacatgaataaggcataaaagtgacaggttaagagattgaatggacaaatcagatgaggtttattgtactttatttttggaaaaaatacgaattaccccctaactattgtggtcgatcgaattaccctcataactcgaataccagatatatttcacaccctaaactttttaaaaccggatgaattaccccctgacaatatctagagtggtttccgtcctacgtggtatacacgtggtagtctaatcaatattttttttaaaaaaatggtgggacccacctacttctcttcccctcacccctctatctcttccattattcgtcgttctctctatctctctctctctctcatctctctcgcgttgtgtgcggcgaggatggtggtagacggcggtgaacggcggtgtcacggggagggcaccacggccggtgggccgcgccgaggaggatagtaggggcaacggtggcgacgactagctggaggaggcggggttcgagatgagggcggcggcgggccagcgacgaagctaggaatgggtttgagatgagggtggctgccacccgcgccgctcccctacgctcgcgcctgatgacagagagagaggggaagaggagagagagggggtgagagagtatgacaggttgaacccaccaaatttttttaaaagaaaatgttgactgggttgccacgcgtacgccacataggataaaatcgctctggattgggtcgaggtgggtaattcgtccggtatagaaagtttaggatgagagatatctgatttccgggtttagggggtaattcattcgaccatgatagttcgggtgagggtaattcgtactttttcctttatttttctcaagatttaaaaacataggggcaattgcgcctatgactccattttaaaggctaacaaccaatttaattattttttatcttgtttagtggttggccctcttttatcaattttactcatttgaccattctttttaaaactgaatatatggcctgaccttattctattaaggcaaaatttgctacaggttgaacccaccaccgcttgcttcgtttgtacgcctaatgagagtgaatgggagtatgagacaatcatattgcagtggagaagagattggagaggagggaggttgaccgatgaagagcgtaaggtgtacaatatctggtttgttagtttaggagggtataatccgaacagtatcaataattcactggggtaattcagactttttctttttagaaacaacacagacacaagtggtcatatactcacccctttaaacgtatgcacaacacatcctacccctaagaccggatacctcatacaacaagcgtctttgcatgaaatgcctaccactgaaacaaaaatagttgttaaggcgagtacgcatgccacgtattgaacttcaatcgggatgagtatgtttcactacaagaaatagcatttgtaattttagaacaaaatttatttaatttctttgtattattatcatttgcattttctttaatcagccgaaccctatatccttaaaataccattatcaggtccctaaagctggttgatttgtttttattttttttccaaagtattgttgaaacagacagatttatcgatgaaaatcaccaggctgacgtaaattccaaatggattttttttataacaggatgagttaaattggggttagtagatcacatagggctaatttccatatatctttatcgtttgtttttgtaagaaaaactcatgataacgtatcgtgccccacaaaccagaaatcgtgccgaaaatgtggcgggcaccaaaaatctggcgggctcttatccaaacctcttgggtggctaggtcacaaaacaatccccaatcctggcgtccaccactcatccccatcgacgcgcttcctagtccccccgcccccgcgcgccgccgcgccgcaaaccatcgagccccccgccgccgcgctgcgcgctaaccaggcccccaccgccgtgccgcccaatgccccatccagccccacgtagccgcaccacgcccccatccaagccgaggccgccgcgggcacatccccatcgaggagcacctgccttcgtccccacctttgatggccgtctccatcctctgctccaggtggaacgctatacacgaagtcgtagctccgtttgtgacccccgcctactcctcctaggacgccactgtggctgaggcaagcgactccgctcggccatatctacatcagtgtgcttcgtaaacgagaggtcagtaaagcaactccatgtttccatctgtggctctacaactttccacaaagaaccatggtatgttcatagttgatatgcattagaattagagattttagtatcagggtaaattagttctctttggtcagaagtttcttggttggggggagaacatattttgaatttgttgaacctcttgcagtcccgtttgtgcttgatggtacagattattgtgaagatttatttgccaggagtcatctagatattctaatgccactgtgcagtctttgtacaaagcaaacgaatatagtgttgcaaactctattgaatcgacatgttgtccatccttccaaaagagtgttgtgtgctgccatttccagatttgacttgtatctctgaaattaatatctggagactgtataatatgctaatggaaaggggaccaggttacagaaagatggaggatggagcggctaaattctttacattctggttagaaattatattcttcttgcattaaattatattcttcttgctgaattgaaattcagttactttcttgcactgaacagttatgcacacatttctacttggttaattataggtgctatttgactaggccgctgtgatagaaaccagtaattgccacatggcttgagatcatcttgtaagggggtggcacatgcagatggtgcaacattgctgtatgcaggatctctggatttttgttttttccctttagttcttgtttttatgctcttgcttcaatctgtgctatcaaattgctttgtaaagaatacatttctgcactaagattcacaagcagttggttccatgacagtatcctatctcctgtatctgttttagataaccaattttgcctcttctaaactgtaatcaggggtagaccataaattaaagatcgagttaagactgaagattgctaacaccctaatcagaatggaggagttgttctgttaattaattgctgcttgcatcttcttctattggttgtgttttgcacatattgtgtggattgaaactctaattcagtttgctacggcgaataagatttcaaattttccttatgggagagaggataagattcagttttttttccaaaaatatattaatttcctgccaatgcaacacaagatgacaatcatttcttcaagtgcataatattttaatgttctttttgcagaaaatcattgtttaaactatttggatatcatgcctgaattagagaggctacagaacatcatggaagcaatacatggacctgatagcaccaagcactccgcatggtcaggatcagggtgagatgtagggctagcgacagagcttggatgcaaatgattgctctatcccaacaattggttggatctctgtcttgattgaaggtaattttctgtcatggttattttatatcaatgtgttgtaagtttgtttggtacgaaagaaaaacaaaatgaagattaagagatccattatagtgttgactaagttaataatcagtgttgaacaaatgtatcatactaggagtctatttgcctgtgttgttgttaggccttcacaagaatcagtagcagagatgttctgcttcattcttttatctgtgcagtggtgtgtacacacacacattaagagatgcgcttgcaagttgtttcatgccacctctttgtcatatggaatttcatacttgtctcgcgttactttcattgacatgtttagtcaaaaaaaaactttcattgacttgttgcttcataatgtggtatgggaaactaactataatattatttggcactcagataacttttatgtctgatttcaggcatataatgatcatgccaaaggactgggattgatttatgttgtcaatgcacacatttggttagtcagccactaagatgtgtctattacctttccagcagaggttgtaagaactaaggctcattctgcttctcttgagttatgtgtagctagcgactttgtagatccattcatgttgtgttcttgcctcgtgatgttctcattaataccggggaatcttcaacttatgttcacatgatatttttctatggttctaatttatttctgtgatgcttgcctatgttctgcctgttatgtttgcgtgaaatctgcctgactgttgcttgtctcatatccgtgttgtactatcatgaatataagaaatctgtaaatccaggtgtacaatattatctagtgttcattctcagcaagttactgtgatgagctacacacacgggaaaaattttaacatccccgtgtgtccagtactataatcctctcggtaagctctgtcctgttaccgtgttttgcgtaccacacacggtaatgattgtttttttccagtgtttttgtacctctcggtaacactccgttccgttgcttctgtcccgtcttgtgccgttaaacagattgttgccgagtggctgtgttcactcggtaattttgaacatcatcccgactgtagaagcattgtcgcacgggaagaatctcacagtaaaggtgtgaagccaccgagagcgcgttcccgtgagcttgctctcggcaacttgtgttaccgagtgttttcaagatgttgccgagtgtttttggcacacggtagcttcgcagtctctagtagtaatttaccttgaatcctaactgattgctcatggtcctaccaccaccagagttggagatgaatcgagctctctagtcgccggaagtggagaagaatggcttggagagtagattttgttgccaattgacaggtaaggccgtaagggcaattcacttgttgcaaccaccaaaaatcatatgaatccaatttctactagcgcagctggcagggtgtgtcatctcaattggtagcatgaaaggctgaagagattcacgatggtaagttgggacatcatgtagccatttaatcttggattggtcaaagtgccttattactttttaagaaaaagaagtctaaatgtatttaccaatcagcggccagagtaaatttctacttacatactacctataggtaccgtaaaagggcctgattaaataagtccctactttagctgtaacatgtaaaatttggataattttcttgatccaatgggttgatatataggagtacttgactggttgacttcaactctagaaaacatattctagtataaaattgataaccaaagtttcaaaaagattaaccctacacaccaaacatttataatcggatagagtagttcttgattgtctaaatgtagaggctgagattatcccaaagcatcctagaagggtctgttcaaataactttaatttctccggaattttaaaaactttcaagatttgtgtgggacttttgggttgcaaacattggcccaagcctggcccaaatacgctcaatacactatcaagctagacagggatgggcttttgcgggccaggcaaagtttaggccctctttgtttaggcttagacttattggcctagatttttaagtcagtttattagcgtatatgatttatacgctggtggatttaatgtcctaagtttagtgatttagccatacatctacctcacataagccaaaaaaagcttctccaacctagcttttggcttaatagtgttagagtggcttatggcttaaaaaagacaaacggaaaagctgcctgtttgtttaggcttaaactttttgacttataagttggcttataagcctaaacaaagagggcttaggccctcttttaagcttaggcttaggcttaggcttattggcctagacttttaagtcagtttattggtttatatgatttataagccggtggatttaatgtcctaagtttagtagttgagtcatacatctatctcatataagtcaaaaaagcttctccaacctagcttttggcttaatagtgttagagtggcttatggcataaaaaaagccaaacggaaaagctgcttgtttgtttaggcttagacttttcgacttataagttggcttataagcctaaacaaagagtgccttagacaggtccgctagaaaggatgagggactttaagtgcactaattcctcagcaatttaatgcagtagtaagcagtgttctcccgacgaaaaccgatcaaattcagtgaaattttgacatttcgattggaaatttgaagcttaaacaatagatttggtcgaaattcagttaaaatttatcaaaagccgatcaaaatttatcaaaaactgtgataccgatagggctcgaaatttagtggtcaatcggaaatgtaaactctggtagcaacacgccaacaccacggaaagactgaaatgaactctggtagcaacacgccaacaccacggaaagactgaaatgaatacagtgatcagtacaagcccaacccagcagctgtctgaagcttaaccaaagcttaaacccaaagcaaaccagaggcagatcagatcagagctagtagcagcaagctcgcgatctcccccaacttctagaaccttctagaaccgccgaatgcggctccaccacggccgccaccaccaccactctgccgcggtcgccgtcgcggtagcggacgacgacgacgaggccaagccgcgccgcccatactccactttcgcctccccgcgcgcgcccacgtccgcattttccgccgccttctcaacccaccgcctcctcgtcctcttctccgtcgcctgcctcctcgtcgccgcggcctccctcgccttcgccttctccgcccgcgccgcgaccctgcagccgccgcccctcgccgccgtggccgaagccaccgccaaggtcgccttccgctgcggccgcgccgaggacaccctccgcgccttcctcgcctcctcctcggggaactactcctccgcggcggaggggagggagagggagaaggtgctcgccgtcgtcggggtgcacacggagatcggatccgccgcccgccgcgccgcgctccgggccacctggttcccgcccaagcccgaaggcatcgtaaggtttccccccacattgctttcctccattcccacctaccaacttggatctagctactcgctttgctctggattgctgctgctcatcttacgcttac

SEQ ID NO: 8253 - DNA, 777 bp, Oryza sativa
ttcatgcatatttctattgtccgctcaatagtcaatttcactgcattcttcatttcccgaaagtcaagatcagccatcttgattggcatttggttaggacgaaagcagtgtatatctgatatacttccataaacgaaatcaagctatataatattaattacttattacaattttaccgttaatcactaagaatcaccttagcttctggattcacaaactttttatgaagaggtgtactgactactgaagcacattaccagagagaaatgaatgtgctgatttgaaaattactgtttgtcaagaagaattgattgtcgtaaagtttactttgtattctgtttggaacttataaaatacatctctttgtgtaacttagctgtcttaaaaaatcattacattcagttaagtccattcactaattcaatgtttgaatcaggaacacatgtgggctagtatgaacagttcatcagtaaagaatatacaatcttttataggctaactctggcacttctctctatattgcagtttggaacatggaactggtttatcttttaggtttgttgttggacgaaccaaagataaagaaaaaatggcagatcttcagaaagaggtagacatgtatcatgatttcttgtttgttgatgctgaagaagatacaaagcccccacagaaaatgtaaactctctctcctcttatgtttgtacctttttacatatacacgtgattaatcttaagcctcccctcttgttgcccatgtgacaggttagcgtttttcaa

SEQ ID NO: 8254 - DNA, 23119 bp, Oryza sativa
attacgcaatgagtacttcagccatgcatctggtttactatatgctctttcttcggaggtgggtggatctctaactgctacaaataatgatagggtggccagtcatcttttcctatccatgccatagagtgaaaacacaggaacaatttagttgaccattcttgtctcttaaaacataataaagcaaaattgcaacagttctgcgaatccaaaacatcgtgtagtttctccttatcctgtatatttccatttacaagaatacaagaatcaagccacgcttgaaattctatatttgattcatattatagactagtctaccaacaaaaaaaaaaaatccatccttgtttttctgtttgttttgtgtatttttcatgtaatcattatttgtttcttcatgcaactctcagtttaaggatgtttgattacgaagatgttactattggatcatggatgcttgccatgaatgtaaagcatgaagacaaccgtgcaatgtgcgattcggcatgcactcccacctccattgctgtatgggacagcaagaaatgttcaagtatgtcttggtaaattgtgtttcgtgatcgtagtgataaaatagtcagaatgggaaaattcatcatcgctgatttaattatttatgaaatagtactatttcttccttttcctatttctaatattgcgattcctgatgaaagcaaaactaactttacatctgatatatctctgtgtagatgcactagctattattactgcatactccatccagtcatacatatttgacgtctaggacaagattcggtcaaacttttggtactttgatattaataatctgataatttctttaattcttaatctacaaataaaaagaaacaatatgtatagatttgccttgaaatgtactatgtactattaaattattagattttgtaaacttatgttaatacaaaattgatggcgaaagtttttattattagattttgtaaacttatgttaatataaaattgatggcgaaagttttaaaagtttgaccgaaacttcgtaaacatcaaatagtcatgactggagggagtaatatttttggtgtctgaagacttaatttgaatatattttttagtaattagctgatattgcaaaataagtttgattaaccataacctcatgcctttgacttcttttgatgcataaatgttttacattagccttgttgacttccagattcatgtaacacaactgagatagtaaaggcgcttcacaacactaccttgtgctcaaagagccctacattgccacctgaggtggaggatgagtagaaccttagtgttattttttttcccgtcaacagatgccaggtattgcctgtcgtaacatctgatttctagttaaatgtatttccataccgttgtattcattggtgaactcatctgagagccatactgttgcagcttcttgttgctgagagttctccgagaagtgtaccatcgcgagaatgatgtaggatttgtgtgcacactcccgatattgggataagcgaacaagacaatatgtaggttcaggcaaaatgtatactcccgactgatagaagtgggaacatttgttgtcttatgtgccatagccgattctggccatcgattctttcactggctatgttgttcattgatgtgtatataaccatatatataccccagtctgcattgttgatcatgaacttcatttcatgatcatggataactccagcttatttggattgatgtgttctcatagaaccagaacccagcttatgtccggtcggagtaataatgaccaattcatgttgctgattacactcctgagatatgattatctgaagtaaggaccaatttatgttgctgattacactcctgagatctgattacctgaacgcgttgcgtttccttgcgtgtatgtgttgttgttccctttgcaatgctgcgttgcaggtgttgcttcttgtaagaaactgagaaaagctgtgggcttttcacaccgttaatgctacactgtgaataccatgatgccgatgccccacttttgccattgcttgtgcctgagcctactccctctgtcaaaaaaaagaatcaacctaggaggggatgtgaccccttctagattgatgtatgtggacacccttatcttaggaggggtcacattccttcctaggttgatttttttttttggacggagggagtattctccaaccacaagctcgctgctattcatctgaggtgacctgagatcagcaaaatataggatccatctgaggtgacctgagatttgacctgagatcagcaaaacataggacgtgttcagattattatgtatttactaaatttgacaacaaactaaacaaacatagatactttttttttaactttacttaagaaatggtgaacaggcccatagagttaccaccgatgcgtttgcaccagcaaacaatactagcactatcaaattataatggcaccaacaatggagcgagcacactaagatatttatttgttactattaagatacagattttaactctgtttttcgttagcacatttaccaaactgttagatggtatatgttggcggatggcatgaggcccttcgaccaaacctgccgaaacccatggcgaaggctatggagcaagaacggcgcaaggcgaagagtcgtacaagcgccaggccagaagcgtctcaggcgaagggtgcaaggcgaagactatctgccgaaggaggacgacttcgccttgacaagttcgcccccgcgagggccgaggaagcctttccggcccatcaagcctaggggcaatagggccggcgatcgccagacggcccatcaggggcctgtgagcccctatatcatcatgtacccctgtaaatgtccctttcgtaagggtaatcatgtaaattcccctctatagcctaaaccctagtagtaagagcctgtaatagggctataaatagccccctagggccatgtaacgggggaatcccgagtgaaattcaaaatttaatacacttcgtttttccaaccactgttgagtaaccacgtctttcgacgtatgcggttgtcgtttcgataacagctggcgccaaccgtggggacctccgagcgaaaccactgagagcgaatgccaccgaagagggtcgtgaaggagaaggttgccaggcggaaggaaagcgacgccgggccggacatggccgccgaggagggagaagagccttcggcgccaatggctgaagatggaggaggaccatctgcttccacgactgcgccatcacaactgccttcggcccctgccgcctctgtgcaagtgcacggccgacatggcgaaggcggctgcggcggcgagggcactccagaccagggcggagatcctttcaacaagccaactggtagtgccccaagccgctccattgcagccaacagcgaccccaaccgcgctcgccgccgtgcaggcccaagtcagccctgaccccgaagcacaagccgaagccgacatggaagccatgcgacagaacatgacacggctccaagacatgcttcgccaaatgcaagaacaacaacaagcatacgaggcggcgaggtggaccaaggttacgtcggctccaatccttcagtattcggcagggtatgtcccacctcaagtccatccgcaagtgacgactcagccctttccgccacaagtcgcacaagcgccgatgtacttcgccaagcagcaattggccgtagcagcgcatccagcccctcacgtacaacagccagtcgctgctcaagtacaccatcaaccacttggccaagcgccacaaacagtggcggaaggggtttcggctctgcaggcgcaactccaagctttccttcagcaactcaaccaaccccactgcatttcaagtacaaacccatcggcccatccggaggggaatacaagtcaaggggcgcctaattggttgccaccgattcagccgagcctgggagtttcgccatggaatcaaggaccgcagttcaacttcgtcaatgctgctcaagcgctaaccgttcggcggcaagctccaactccaggctttggaacaaaccaagtatcaatccaagcggccatgacgtggtcgcagccaattttcgacccatccatggcggctcagcaagtatctccagttggagccgggcagtcgaatgccacggcccaaccccacgcacaagctgcgatttcgcccttcgccacaccgtacccgcagcaaggggcggtaaacaggacgggaggcgaaaaggggctactgctaagtgggggaatcaagactcgtccaatcccaccacagttcaagttcccacccgtcccgcgctattcaggcgaaactgacccgaaggagttcctctccatctacgagtcagcgatcgaagcggctcatggtgacgagaataccaaagcgaaggtaatacatctcgctctagacggcatcgcccgttcttggtatttcaatttaccagccaatagcatttactcatgggagcaattgcgcgatgtttttgtccttaactttcgaggcacctacgaagagccgaagacgcaacaacacctactcggcattcgccaaaggcagggggagtcgataagggaatacatgcgtcgcttctcgcaagcctggtgccaagttcaagacataaccgaggcgtcggttataaacgccgcttcggccggtctgctcgagggtgaactcacaagaaaaatcaccaacaaggagcctcagacgctcgagcacctacttcgcatcatcgacgggttcgcaaggggcgaggagaattccaagcgacggcaagctatacaagctgagtacgacaaagcctccatcgccgctgctcaagctcaagcacaagttcaagttgccgaaccacctccccccttcattcgccagtctcagccggcgatccaaggacaaccgccaaggcaaggccaagcccccttaacttggagaaagttcagaacagaccgtgcaggcaaagctgtgatggcgatcgaagaagtgcaagccctccgcaaggaattcgatgcccagcaagcgagcaaccatcaacagccagcccgcaagaaggtccgaaaagacctctactgcgcctttcacggacgctcttcgcacaccacggagcaatgctgaaacattaggcaacatggcaacgcacaagacccaaggccgcagcaaggaacgactgtcgaagcaccatgcgaagcagtttaggagcaaacacccccagccgaacaacgccaagatgtacagcgaagggtaatccaagtgattacaagggctgacccgccaagccagttgtccaaacggcagaagaagatgcagatccgtatgatccacagcatcactttggcgggtgagggggcgccgcagtatctgaaccagctaatttctttcgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccaagatggggtttcctacccaagcacttaccccagcaccagcatcgctccgcggtttcggcggagaagcagttcaagttctcggccaagcacttttgctgatagcctttggctcaggggagaacagacgcgaagagcaaatactgttcgacgtcgtcgacatcctgtacaactacaacgccatctttagccgtgcaaccctgaacaagttcgaagccatttcccaccacaattatctcaagctcaagatgcccggcccggcaggggtgatagtagtcaaggggcttcagccttcggccgcttcaaaaggcgatctagccataatcaacagagcagtgcacagtgttgagaccgaaccgcatgaacggccgaagcacacgccaaagcccacccctcacggcaagataacaaaagtgcagattgatgatgccgaccccacaaagttcgtatcactagggggtgatataggcgaagaagaagttgagagtatcctagaggtgctcaaaaaaaacatcgatatcttcgcctggagccctgacgaggtggggggtgtcccggtggatctcatcatgcatcacctagcagtcaagccggacattaagccaagaaaacgaaagttgcgcacgatgtctgccgatcgccaagaagcggcgaaagccgaagtgcaaaaattgctcagggcaggggttatccaagagatcgaccatccggagtggttggcgaatctagtgctggtgcggaagtcaaacggcaaatggcgcatgtgtgtcaatttcacggacctaaacaaggcatgtccgaaagacgacttccccttgccgcgaatcgaccagctcgtggattcaacagctagatgcgagctcatgagtttcctggatgcatattccggttaccactagatccacatgaacccgcttgacatccccaaaacatccttcatgactcattcggcacattttgtcacctcagaatgcctttcggcttaaggaacacaggagaaactttcgccaggctggtgtacaaggtccttggcaggcagttggggcggaatgtggaagcttacgtcgacgacatcgtcgtaaaaagccgcaaggctttcgaccatgcgatcgacctacaggagacattcgacaacttgcgcgcagcaggcataaggctgaatccggagaagtgcgttttcggcgtccgcgcaggctagttgttgggtttccttgtttccgaaagaggcatcgaggcaaatcccgagaaaatcgatgccatctagcaaatgaagcctccgtcaagcgtacatgaagtacaaaagcttgcaggccgaattgcggcactcagtcgattcctctcaaaggtagccgaaagaggtttgcccttcttcaagaccctccggggggcaggaaagtttagttggacaccaaagtgtcaagcaactttcgacgagctaaagcaatacctgcaaagaccgccagctctgataagcccatccccaggaaccgaactgctattatacttagcagcttcgccggtggcagtcagtgctgccctcgtccaagaaatagagttcagacaaaaaccggtctacttcgtctccgaagcactgcaaggagcgaagacaaggtacattgaaatggaaaagctcgcttacgccctagtgatggcttcgcgcaagcttaagcattacttctaggcccacaaagtcatagtgccatcacagtaccccttgggcgaaatactccgaggcaaggaagtcactggccggctcagcaagtgggcggcagagctatccccgttcgacttacattttgttgcacgctctgctatcaagtctcaagtgttggccgacttcgtagctgaatggacagcggtacttgcccccaaccccgagcccgccgaacaattctaggtgatgtgctctgacggctcgtggtcgcacaagggagcaggcgttgcggcagtcctattttcgccgaatggtgtgccgattcggtacgcagcaagactgcagttcgacacaaccaacaatgcagcagaatacgaagccgttctcctgggcctaagaaaggcgaaagcactaggaatccggcgcctactaatccgaactgactccaagttggtaacaagccatgttgacaaatccttcgaggcaaaagaagagggaatgaagaggtatctggaggctgttcagtccatggaaaaatgcttcaccggcataacggtcgaacacttgcctagagaccagaatgaggaagcagacgccctggcgaaatccgctgcttgtggtggcccacattcgcctggcatctttttcgaagtcctgcatgctccaagtgtgtccatggatagctcggaagtcatggcaatcgaccagaagaaactgggcgaagacccgtatgactggcgaaccccatttgtaaagcaccttgaaactggctagcttccggtagacaaagcagaagcgaagcgtttgcaactcagagccacgaagtataagatggttttgggtcagctttaccgcaccggggtacttcaacccttacttcgttgcatctcttttgccgaaggcgaagaaatggcaaaggagatacaccaggggctatgtggcgcgcactaggctgcaagaacagtggcctccaaagtatttagacaaggagtttattggcccactgtgttgaaagtctgtgttgagcaaatcaagaagtgcgaaagttgccagtgtcatggccgaagccaagccgcaccccagtatgatctgcagcccattacgccgatatggcccttcgccagatggggactggacatcattgggccgttcccggtggcgcgaaatgggtataaattcgcgattgtaactgtggaatatttctctcgatggattgaagccgaaccccttggggcaatcacttcggcagcagtacagaagtttgtatggaaaaacattgtttgctgttttggagtgccaaaagagttcattactgccaacggcaagcagtttgactctgataagttcagagaaatgtgcgtagggcttaacctggaaatcaggttcgcgtcggtcgcacacccatagtcaaatggggcggccgaacgtacaaatggcaagatcctagaagcactaaagaaaagactcgagggggcagcgaaaggcaaatggctagaggaattgctatcggttctctgggcccttcggacgacccccacaagaccaaccaagtttagcccatttatgcttctttatggcgatgaggcaatgaccccagcagagctaggggctaactcaccaagggtgatgttctctgggggcgaagaaggacgcgaagtatcgctcgaactcttggaaggggtaagagtcgaagcgctcgagcacatgcacaagtacgccacaagcacttcggcaacttacaacaaaaaagtttgacccacggagctcatgcctggtcatctcgtcctaaggaagaaggcgaacccagtagcggttggcaagcttgaatcaaagtgggaaggaccatacctcatcaaacacaagtccaggaagggatcttttcgcctagcgacgctcgaaggcgaggagttcgaccattcctggaacgccacctctctcaagcgcttctatgtctagaatgggtggcacccaaatcgccaacttgtaaaaatgtgcatacagtcatcggcaaaaaaaaagaagaagaaagagagaaaaaagagaaaaaactggatgtagggctattatccgccatggaggcccgaaccagtataaaatctctgtgccctccaccttctttttgtttttttcgtgtgattgataatttgtggaaaaaccccaaggcaaacgcttgatcagcgaaaaaggccagggggcgaaacgaatcggccgaagcatcgctcgccgaacgttgaaaccgcaacagcttgcctcggaaaacaaatagccgaacgacgttacgaccgatcagcagaaaagcaaaagcgtttctttcgacatagagcgctacagatcgaaaacgaacgacgaaaagctgaaaagtcagtatacctatttcgctaaaatacgcaaaggggccgacatattccgacctaacaaaagcacgaaatgtgacgatgcgaaagaatagcgaaaaggaaataaaacacatctttattaacttcgaaaaaataatcgaagaatagaaggttcacaacacgatacatttcaccttacaagtaaattacatcttcacccccataatcactatctctccctaaggaatggtcagacgaactaggttcgtcatcactactaatatcatacacaaccctaagaggagtaggggcgaaacacagactaaactgtaacgacactgaaagatcgtttcctggcgtttagtcttctgatggtttcgccaaaagcgagccatatcctccaaacgtcttgaatgaacaagatcgtaatattctaaggttcgcccggggtgcgcccgcagccagttggcaaccttgaaaaccttatagttgcgaccgtttatctccatttcgtgataaacaggccgaaatggacattgcaccttcggcagacccttcaatgccacaaatttctcgttctgacttcgccagctcccagaaaggggccgaatgcatgattttcggcgaacccccaggtagacagtgcagaaaaggcaaaacacaacttacatggtaagaataggccaaagaaggggaagatatggcataatgggaaatgagcgaaataataatatgccaaaggctttgatcattaaaaagtggttaaaattgtgtcatacagtccaactacgcaaaagggcctcttctaaggtttagcggcagcttgccaaatatacaacggttcgccacatctagcgaacaccaaaagaaaactatgaaaatctaagagaagggcggagggcctcacacctctgggtggtcccgggcatcgcctccaccccctccggccgccgcgccttcatcttcacaaaggtccgccgcctctgctttcgccagctgctccaaaaggcgcgccttagcggcggagcggtcgtccttctgccaaaattgttttcgccacgcacgaagcgcaggcgaaatgtcttgcgcactgatttcccaatcccccctcgcgtacttggggaactcggcgatgtgctcgcagccgaactgctgcaggaggcccatggtaaaggccgctgacacgcgcgcacagcagtcgccgtatgcggtggcgcagtcagaaaccgaaccaccagcctgttgggtccattcggagaagtcgaaggctgaggcatcttcggaggggacaccccgcactttcgcgcccatatcagtaagggcgaggcgaagcgtttggcacgctgtccgcgcggactcggcggttttcaccatctcccgcaaaaaccgccgcgacttctctgcagcgcttgcttcggccttgcgcacctcctgccgaagagtctccatcttcggctcggtgaggttgtaataatctatgagcacggcagtgtgggccttttctttctccagttcggcctttaagcgatcgactttggccctggcttctttccctttctccagttccgattgaagccgcttgttttcaaccttcgcctccttaagggtgttggcaagggcctccatctccaaatttttacggcctagttcatcatccttggcccgaagacggcttttgaacccgtcaagtcgggctcacacggttcgctccgttgagcagtgagccgcgaggatctgggcgcagaatacgagcggcaaagagaacaagtgtcaattgtaaaaagaagagagaggaagagtaaaaataaagaaagggggaaaaaacgtacccgaacagccaggctttttatagcagaacacccctcatcgaactcattcagttcggtgaacaagctcggggcactagcgggcagtacaagattgcttaccccctccacaaaaggaaggaggtccgcccgcgtctcgaaatcgccaagggcgaagcggggtaccgagagcgaatattccgaagcggacgtctcagcgaccgctctctttcccttcgcctcaatcagcagcgacgcaaccggctgatgcggaggactgccgaatactttcgctgcggccgtcacaatcctttccgcagaagccgaagccccagcggcggtactaccgcccactccagcgacgccgagtggaggaatgggggcggccgaaagatccaggctgcgaccagtgggtgaagtcggagtcccgtcggatgactcatcgtcgctaaaaacgcgagcgacatcgacgagcctttcttcttagccacctttttgacaggaccttccttcaacgctgcacccgaagagaacgcaattagggccttcgccccttccaaatccttccgacgaaggggggagctgttcgactccaccctggtctcgttgtgaccgggacttggggtaggaatgtagccgggggtgtcgacgcggtattcgaccgcctcgttcgcggccttatcggccacatcctcttcttcctcctctccttcatcctcgccgtcgcgttcttcggcgtcatcctcgtcgtcggcatcggagtccgacgaagcaggagcccttcgtttcctaggggcaagcttcacttgtccgcgcatccgcttccgtgaaggccctgcatcgtcgtcggctttgtggagatttgcccgaggaggcaattcgccgttataaacccagttcgcccgcccggccgattgtcgtgttagcagctggctatactcgacgaccgacacgtcgccgatcatcctgcgggcttcggtttcagcttggtcaagggtcaacactgtaaaagtagagtgtgaagctatgtcaaaagtcagataaggcgaaataacaaagcacagcagtatatagcaaaagaacagtcttactgttcgccccctcaggaagtatcaggttcggcaaaccgtcgacctcttcgccttgatcaaccgcgacttgccatgactgggagaggggaaaaatgcgaagcatacaaaattcctccaccaagtcacggcagctaaggcgggagcaaaccttccgcagtagaacgaaccgcgcctccatggcgccgtccacagcgatcttgggtctccggttcggcgcaatcgccctgcgccggcaccggagggctttcactgattcagaaccagcctcaaaggggatggtgtgatagaaccacctcgccatccaatggcggtcccacttcgacatggcagcgttcaccgaccagagatcggaccgctcggggcgaacgttgaagttcacactcccgaacactgtcttcttcgttccagccggggtaatcaccgtcttcgagttcacggtggcgaaaaatatggcgccgaagagctcggcgttaggctcaaacccggaagtccggcacgcccagtcgaagatagcgatccgaacaagcgccaacgggctcagctgcggaagttccacctggaagaggcgaaggatctccggcaacaacacgttgcagggaaaccgtagccctgcctcaaaaaatacggcgaacaccaccgtccgattgtcgataggtttcggcaccacggctttccctggggcgaaagcctgcccctcgaccaacgctccggagctgaccagcttcgccagctcgacgtcgtccacaagagagacccctaaaaaggcggtgctgtcgtcatcgactcggccgggatctggccctttcgccgaaccagggtttggcttgcgtggggccatggtgaacggtgcgtttgcggcggcgaagaaagagaatgggcgaaacgctggagaggtcgagggatgctgtggaagaaagaaacggaggaagagagcgcacgcggtaaaaaggcaagtgtggcggtgaaaaggaaaggccgggggggatatatagctcgcttaggcgaccgttcgcctacccaccaataataaagcgccacgtgtcgcaagggtaggcgaaacggtaacttcccaccgtccgagcggcacagtaaaaagcccatgaagggaaagcccaatactgttcctttcggcccgggaaaagaaaatttataaaaaaaatgtgtataatatatatatatatacatatatatatatatatatatatacatatatatatatatacacatatatatatatgaatatgccaccaaatgcaggaggcgaaagcgcggcaaaacaataccagccacacaaataacaaacttcactcgcaggaataatgtaggtttcggcaagagcatctgtcgaaagggggcaccgcataccataccacatggtttgcacggtctcggccgaagctccaatctcacccttacccgtgaggggcttgttggcggatggcatgaggcccttcgaccaaacctgccgaaacccatggcgaaggctatggagcaagaacggcgcaaggcgaagagtcgtacaagcgccaggccagaggcgtctcaggcgaagggtgcaaggcgaagactatctgctgaaggaggacgacttcgccttgacaagttcgcccccgcgagggccgaggaagcctttccggcccatcaaacctaggggcaatagggccggcaatcgccagacggcccatcaggggcccgtgagcccctatatcatcatgtacccctgtaaatgtccctttcgtaagggtaatcatgtaaatttccctctatagcctaaaccctagtagtaagagcctataatagggctataaatagccccctagggccatgtaacgggggaatcccaagtgaaattcaaaatttaatacacttcgtttttccaaccactgttgagtaaccacgtctttcgacgtatgcggttgtcgtttcgacaacagtatatttcgtatgaagacattataaataaaaattgatttaaaatatcagataattaattttttaagtttataatcattaaaactcaattaaccaagtgctaatggctttatcgttttacgtgtctctacttaatcttcatcttcatcaaatttagcataggcatgttcaatttactgctaaaatcaacctttataaaaattatcaatgtcaatttttttttgtaagttagcaatattccaggttttgataggatagactaaatgtgatgtaatcaaaagtccctatacactaccaatgtttagtaataaactaaagcattcacacgtttgttaattttacaaaataatagtatggtttaaactgataccaatttgaacaagcccatatgtagaactaatctttctaagggcctagagttcaacaattttacgagacttctttagtgattattttaatttgtgtgaaattgcttgaaaatccatccatttcaaagaaatcaacgagcctatttataggagcttttatcagctacagcatcttctaaaattaaaaactttctaaatagttcagatttttacctaaaatttgagaagctggtttgtcaatttctttagatctcatcagctacttcttaaaatctaaaactcctacgaacaaacccctatgcttagttcgaatttacctataggatttttgcaaaaactatatatgtgaaagtttctttaaaaattaaataaatcatttttttatgattgtaatagttaatatttaattaattatgtgtaaatgactagtcttattttaggtgcaaattaagcctatcccttatttgaaaaaagcctaaattttactcgaatttgaaggatctcacccagtgtacaactatcgtgcgaatcgatttctacgagaaaagaaagatttctacaagaaaacaagaaagagccttgtacgcggaggagttagcagctgggctcccctatccattattacctttgggacgcgttgacgcgaccgcggaagaggtaggtttgcgcgtgagctgcgttgttgcaattgcatagcgtcggtgcacgcaaagacgccactcccgccgacggtttgccggcttgcaagttggaacaccaaatgctaggtccgccacaaattctaaacgagttgtggctgtttggtgtatactgtattgctcttgctcgatagtcaattcaaccatactcttttccttcactacgcaaaatggagtgacaaaattagtacataattaattaaattatagtattagttaaaaaaataaaaaatagattaatataatttaaagtaactttcttatatatttatttaaaaaacacatcgtttatcagttcggaaaacatacactaaggactaagggtgtgtttagttcacgtcaaaattaaaagtttggttgaaattggaactatgcgatggaaaagttagaagtttatatgtgtataaaagttttgatgtgatgaaaaagttagaagtttgaagaaaaaatttgtaactaaacacggccttaaaaaataaagaagtagagatgaggaagagtgagtaaagatcaacacattaaaagactgggcaatgcagatgaaactggttgtgttcagcaaactgagttaggaacttatcctttacgcacataaaatagtgtaactcattagttcataattaattaagtagtagctaatataaaaataaattaatatgatttctaaagtaaattttctggagaaattattttacaaaaagatacaatatttagcagtttgggaaacatgtacagaaaataagtggaatgaagctagaaacattgagtaaagaacacaccattgtccatcttatttgtggtaaaaagattagcatcaccaaaatgctggcaataaaagcaaactaaccaggcttgcttgtaaaactgcacttggctgtgttcggtctgcgttctataccaaaggcttctaacttccctccctcgttttccgcgcggacgctttttaaactgctaaacggtatgtgttttgaaaaaaaaaatttctatatgaaagttgtttaaaaaaatctattactagggttgggaacccatctccccgcacggaaaacggagcagtctattagcacgtgattaattaactattagctaatttttcttaaaaatggattaatttgaatttttaagtaacttttgtatataaactttttttaaaaaacgcaccgtttagcagtttgaaaaacgtacgcacggaaaaggagggagatgggttgggagtgagctgaaacgagcactataccctactaatatttgaatcatatcattaccaatctttcttttcttttcataaggtttacattgttgatgccgagatgatccagacaacccctaagggtctcatctttttcttaaacttatgcttatcagccaaaatttaaattttcatccttaaatttagagctgattttaaggtttttttttaatcgaagtttacttttcagcatttgcttttatatcgctaaaaacacgtatataaaaactttattcataaattattttttgtttgcaaatatgtcgttttgctgagtccgtgaataagcgaaacgatggctccataaatcgtatcgtgcaagtgagagattaattgataatcgctcatcgtaccgtaataccagtaacgatgtgtggagaaagaagcataggtaagggcccattaaaatcgcaggattgacaaaacgtaggaatagaaaaaacgtaggattctgataggaatgtaagtataaaacagaggattgcaaaatgcaggaaaaacacaggaatgaacgtttaattgaaccacaggaaaaacgtaggaattggattagagagatagactcaaaggaaagttatcaagaggttgaagctcttgctaaatttcctccaaaatctctataggattgtccattccataggaattttaaaggattggattagattcaatcatttgtttcaaaggacttcataggaaatttttctatagaattaaaattctccaaaattcatatgattttcctccaaatcaaaggggccgtaaatatgtaatagtagtcaacgtattacaaacgatacagttgttgaaattcaaattcaaattttggttatagctgataagctaataagcaaacgatgagatgccatggttaggcataaaatttgcctggtgtctatatggatttaaagagaaatacaaattgcaaagttcaacctaagatgttcaccgatgacaagtcgaaacttcatagtgcctcccaaaatgcacttgtaataagcaaccatacagattaacgaccctaatcgtacaaaaatagggttctctgctccctttttttttccctgttgccgaaattctttgcttcagacatacgtacatacctgacggctaatcccgatctgcatattaaacaatgaatactgaagtgtcacacgcagactttttttttttactacacgtcctttgcagttcagctagcacatcattttcacaccgatttcttggcaaccatttcgatcagattcagagagaggaatattaatgattgacgtaagacgcatcaagttggttattgccacacaatattagcactaattttaatttagacaagacagaagctgccttgcatgacacgtgagcgacgcttaccgaacaaatgtgacaatgtgattagcctggctacagttaactacgccattattgcttgtatattgaaatggaatatcttctaggactcgatactcctatgcttaagttaattggggtcataagtaagagtattaatccatgtgtttggttgctaatcattacgaccaatcacccattcgttgtgcttgtatcttgagttgcatatgtcggtgcttggtgttgattctggagacaaataaaaaaagtgtgcattatattgttggtttcaaatttgaatatgatatgcgcctcacaaactaaaacaaataattaagcgtctatggtttatcatcagtaagggggggatacattgtatagaaaaaagaacaaatattttgtacatgaacgatgcgtccttgtactagcttaattagcttggtcggaacatttgacgatttgcttaactgctgcatttgcagatctgaatgtttttagttgttaatatactcgacagctagatgctctattacttgccaaccgttggatggttcaccattggatttggaggagcctcaattaggtgaggtgtgcctagctatgtgtttttcacattattcaagttttaggaaatgacattacgaataatttaggttcctaattttaaaactaatttaggtgttttgatcattatatatttttagttgtcttttgaaccagtaggagtagaggtataaaacaagtctctacctaaatttattttcattgcgtataagtcatagctggccgacaaacgtcaaccaatcatgcggttttgaacatgaaacattatttcgaaaattttctctgtagactgagtgaaattggaaaacaaaatgttcttccaatttgaatgctactataacaaatattttatcatgtcaataacaaacttaatttgataccatagaaagaaaaaattgcttgtttccttattccaaacatgatcaatcatgtaagctcacaggtgatgtgctcaagccacaaaaatggcttgcattaatgaacgtgttcggctagccgtactactgcaagccgctacggttgcgacaattgtaagtggctgacggctgcagctactatgaactgttgcagctgcagccgctgctgatcaacccattgtatttgagtaaacaataccaacaaaaaagaacaatcaagctagcaaaacattgctggaaatatatggagtttacacatccctatttgattaaaaaaaatggttatccatttgtacagttcaggtgtacagctcgagctggatcaacatcctaaaaggggccatggagttgtatgattcgacatctctaccgtgaatgccacatgccgtgctacaacaacacgacggtgcatcggtcacaagccaacaaattttgagtttcctgctgaatgacattttcaggtagggataaaaaaaaagttttgtgttcccatgcagaatgatatattccctccttccctaaatgtttgacgccgttgacttttttaaatatgtttaaccgttcgtcttatttaaaaacttttgtaaaatatgtaaaactatatgtatacataaaagtatatttaacaataaatcaaatgataggaaaagaattaacaattacttaaattttttgaataagacaaacggtcaaacatttttaaaaaagtcaacggcgtcaaatattttgggatggaggtagtatatttcactagtgtcttggatatgttttgtgttcctttacaatattgacgataactgatcaattattctgataaatattggtcatattcaaccacactgaattttaaaacaaaactgctcgataattcgattaagtttcaaaaaggacatatattaaactttaatttttttgataaaatttattcaacattaaccggttttcgtctataacatttcagttatcacgatttttcgtctataacatttcagttatcacgatttttcgtctataacatttcagttatcacgattatcgatgaaaatccaaagtagcggctatacgtgcctaaacaatattgggaaccctgatctaaggagtgcgttctccacgcccattttttcttgtgggaattagcatagtacctatttgttgcgatggatgattaaaaaatatatattgtaagattaaaaatagggaaaagaattagaagaagttaggaacttaggttccctttaaatcgcaggattgagaaaacgtaggaataggaaaaacttacgattttgatagcaatataggtgtaaaaaagagaattgcaaaactcaagaaaacacaagaatgaccgtttgattgaaatgcatgaaaaacgcaggaattggatgagagggatagactcaaagaaaagttaccaaaaggtagaagctattgttaaatttcctctaaaatttctataggattgtccattccatagaaattcaaaggattggataggattcagtcccttgttttcgtgggtaatttggagccatgccattataattttgtaaagtttgagatatgtcatcggtatctcaatgacatgtaggacccacatgagtcaatgatatgtgcgtcaggatggcatatcttaaattttacaaaattataatggcatggttccaattttcccttgtttgaaagggcttcataggaaattttcctatggaattaaaatcctccaaaatttctacgtttttcctccaaatcaaataagccctttacagtggtgaataaatcccagagtaaaagcacaatgtcagtatatctctttatggagacctcgcataatgttcggtaaaatgtggcccaaaaattcccaaaaaagtgttgcaaattcaagcatctgttttatgatttaatccatgatcccgtgggtgggccaaagtgttgcatcaccccggaaccacatcagatttaattattatgtgtacttccatatataagagtttgttcatatatgagaaacatggggtttcccataaattaaaacctcgacgaccccttcatgtagtacatgtaccatgcacttgccctaccggattagtgaaataagctggttggttggaacttaattggaagacctcagcttatctgaacatgcacagtcaagttcagttgggtggtcgctaccatattacgcacacatatgtacctgcatttttctagttgtaacagccgaccattaagctaggtcgccaacgttgttcctgtatatatggtgcccacatgaacgattgacttttccttgctataaacataaagctacagtctaagatggagtttgaatagaggattaatttatcagaattgctaaatatcattcgattgaaaataagggttaaaatcttaaaagtttctaactttaggatccgctttacaattcatgctccggcaaccctagctccccctccaactccggcaaccccttctactttagctccaatgaccgtcggtgatccgacgagttatgatttagggtcctgtcttaggataggggttgggaggagggagggaaggagaagaagggggaatcgtcaggcttagaggaatgaccgtgggagatggtggcctcgcggtggacggtgaacatgggtggtcggtgaggcgctggcggcggcgctagagccgcggggatggaggagtgcaatggaccggtgtgggcggcgggagcaaaacaatgaaatggttacaatgcgcacttcaatggcactgttgagtaggaggagaggtggaggggaatgggttgagggaggacggatgaggttgattggcggaggagggtgatgttgattcctttggctagtcggtgaggccggacggcggtagcgtagaaggtagggaaagcggggccatgggcaaagtagcagtggtggcgcggagggatgagaaagggaagagaatagggatattaaagttagatgtgttgcactaatctcaaagcaattcaatggtcgagaatttacaatattaggaggtgtatttcggtcgaatgtcatacgggcagtctcttaatttatttataattttgatttcatttaatattcctttttattttagacataggtagttttggagttaggcacaatttaaaattgttaaatgatgtttttgccctactatcattacacatttggatagttgacggataaaatatggagttattcattacacataagggggtaatgttcgtcacttagtaaaacacgcaaggtaaagatgagagacaagtgttagattctacgttgacttacgtttagatagaaaaaagtaaaaagaaaaaatgtgccacgttagaatcaaaggtagtacaaatgtatttatacaaaagttctcctgctaatttagtttgtaaagaatataattaaaatcacaacagattttcaaaaccaaacgaggggtgaaccacgtgcaccatgttattcctgcaatgttttcccagcagcaacaggtcttcccgatcctccgggctgtgtcgatgataagcgaaaggggcaattaaaaccaaacacatgtttaattaacaggttagttagatctttaaaaatctcgctttaattttatacttggggcagatacatgaacaaaggcatacgaccagtcacttcctagctgttgtgcaacggtaagatcattatagttattgacaaaacatggtaaaaatatattgagtaaaatacaccagcggttcttaaacttatcaggaggtttcacttagatccatgaacttgtaaagtacacatcgaggtccctaaacttgggtataagggtgagagaagatgtgacgaccaaagcagaagtcgcagtaatatgggatcacaagctggggaatgtgacacctctggaagctgaaaagacaagcagacagattttacccaagatcttgcagaagaaacacagtcctgctgtgacagcaggatttcaccccagggagacttccacgactgtaagataataaattgatattatttaacctaccaagtatatggccatttgttatagcagcacctggaaattcatacacctggatttactttcattcatagaagttaccacttttttttttttttgggaca

SEQ ID NO: 8255 - DNA, 35458 bp, Oryza sativa
caataaaccaagtttagggacatcgatgtgcgctatgcaagttcgttgacctaagttaaacctcccgacaagtttaaggactgctggtgcattttactcaaatatatttatacaattacttcgattagcattgacttcaatatttctatgcatgctatagagccacatgtgcacctacctgaaagccttaggtagctcctgtcctcaattactattcatatattttaactgtttagaaggcaatttatcaatgtagcttaagccataggtacatgtagttgagcaatgtaaaataagtttaggataaaactttacttttgttcttagtggtccaaaagcaaaattgaaagatgggaagtgaagaaaaaagttcatatatcaaatctaaaatctaaaattaaaagtgtgttcctgtcgaaaaggttggagtttaatatctaacttgaactatgatgaagaaatttaattgtcaggacgtgttagaccttcctatcagggtttcaaaaaccgccgggggcccggttaccgccacccggcggtacggcggttaccggcggtaaccgcggtaaccgcgcaaaaccgcgacaaatttacaaatcgaaatttgaatttaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttaagaaatttcttcaccataaaacactataaatcaagcactaccttcactatttttttttgatttttttcttttttttaaaaatttttttgaatttggacgaattttattaaaccgtaccgcgcggtacgggtaaccgtacccccgcggtacgggcggtaaccgcgcggttaccggcggtttttcacaccctgcttcctatcttgtagaagtatgattgcagtgcatgatctcgtgagatccatccaccaaaaggtaacatttcattccaaccattcatttttcctatcccattttataccaaattcaaaattccctatatacccatgagttttcgttcgatggcttctgtaaccttgaattttgcctcatcttccttatgtccatgagtttttattttttatccccctatacctatcagcccatgccgcttattaactgtgagttgatcattagatttttttttcaaaaataactatattgtactctgatactttacgctacatactttaaaaacatacttaatatgaaagaattcttactctataataaaaccaaaatgaacataattaattggcatcggattctaaaaccaaaatttaaatttacaaatatttttgaaaaatgatgaaatccatacataggtttcactaaaaaaatttaaaaaaaaacaaaactgatttttaattgggtttaaatttcagcaaaaattctgaaaaaattatatcaatttgatttgaaacattttctaaaaaataaattttagtttcaaatttatgataagtaattatgtcctgtttattttttaaaataaatcaattttttacattaagggccgtatttttttccattgaagagcaagtaaaagatatgggtaatatatatattttaagaaaaaattaatggtcaacaaactaccaactcacggagtaggcataaagaaggtcaaaatacatagtcaatgatatataaaaagaacggaattgctaaatatcatttggcataattgtagggtcaaaatcttgcaaatttcgaccttagtgtttgattcgtggttcatgctccggtgaccaactctccttctccataagatcctgtgaccccttctcctccatcacgggcaaccttgacgaagggaatggagttacgagttagggtcccgggttaggataggggtgataaatgggttggagaggaggaagaggaggaggaggagggaggagatcgtcgagcctagggggatgctaatgggaggcggtagctcggtggtggacagtggacccaggtggctcactcggagccgcaaagatggaagagggtggtggactgggaagacgatggagcaggggcacctcgccgacaccggtttgaggaagagggaaagggggagaagccagtcggggaggtctcatcagcgccattgatgtcttccggctagccgataagatcggacagtgacatgatggtggtggcagtgggagcgacaagatcaagcactcgagcccgcatcatggcggcaccgagggtggatagaaggggtaggttagtaagtgcagacgaatcttaaagcaatctgacagttgaatttctacaggatttttggtgggcttctctatcaaacaatacacatacagttccttaaaaaaaaagtctaaattcagggacacagaaaaaaatagacgaaaattcgtaggcacatggaatatattttctcaaatggaagagtgggcgcccaccgagagcaaaggagcggctggctgttctgaccagtgggccccaccccacggggacggttggattcggcctgtttccaggcaggggaggcgaccgttccttcccagagaagcacgacgcctccagctcaccacaccacacctcgtgccctccaattatttctctcttttttttttctagaacaattattatttctctcttcctatttccctgacggcctcaacatgcatcctaatgacagctactgatccttctaatcaacccatattttttttgtgaatattgcatctgaaatgagaaataaaaaaaaacaaccacatgttgtgttcacctcaccactatcactgaacattcctcttaattttgctgggtagttttagacaatttttcatctccttttagtttctctattggaggtccctcccttacattggagattagttagatgggattagtgaacttgagcatcagggtcagtggcagccaattttgttagtaacctgttgatagcaactccagccactaaagtcaaaccccatgtgtaactgctcacactctttgctctaatcatatggttaattaaaatgtggcacacatggttggcttattgactgatacgtgccaacttgcggttagtattttacaaagatgatacaacggttcatacattcaagtcgtgtttggacccaagtaaactttcattttccgatccaccaggaattgaaccgtttcatgtgaaattttaatgtaattttctcgcaaaatgaaaattatgacatctttatttctcatctagatttactaacgttcatataaatttgaacgcatatgaattatatatatcgatttttgcataactatattcaaaaatcaaagcgttttgtaatatgaaacagtagagagtttaatgtaatgcatgaagctaccaaattaatcaagggaacaagtcattaactgttatatagcctataggtttgtttagcaaagcaccaaaatcattaggtgaggcgtcaagccatcaaaccccaattcgcgcgtagaatttggtgacgcgtctcttttctctctcttcttcttcttctccctttaattatcatcacaagacctctctctctctctcactccaagaactccacgccaccatccccaccgcctccattccaccgccgccacaagcctcgcctcgccgcgccgcgttctcggccacggcggcgccaatggccgaccgcgtctacccggccgcgaagcccaacccaccgccggcaatggcgaacgcgggcggcggcggcgcgacggcgtcgttcccggcgcccaagtcgcagatgtaccagcggccaatctaccggccgcaggcggcggcggcgaaccggcggcgcgggcgttcctgccgatgcagcttctgctgctgcttctgctgggcgctgctggtcgtcatcctcctggcgctcgtcgccgccgtcgccggcggcgcgttctacctgctctaccgcccgcaccgccccagcttcaccgtctcgtccgtcaagctcaccgcgctcaacctctcgtcgtcgcccacctcgccgtcgctcaccgactccatccagctcaccgtcaccgccaagaaccccaacaagaaggtcgtctacctctacgacgacttctccttctccgcctccaccgccgccaacgccgtcccgctcggcgccgccacgtcgccgggcttcacccacgacgccggcaacaccaccgtcttcaccgccaccatcgccgccaacgccgtcgccgtcgacccggccgccgccgcctccgacatcaagaagtccggcgccttctccgtcgccgtcgacgccgagacgcgcgccggcgtcagggtgggcagcctcaagaccaagaagatcggcatccaggtgcactgcgagggcatcaaggtgacgccgccgccgcccgccgccctgccgcgccccaaggcggtgaaggggaagaacggcaccgtgctggctccggcgccggcgccggcggactccgacacggcggcgaccaccgccgcgacggtgagcaccgcggcgcactcgtgcaaggtcagagtccgtgtcaagatctggaagtggaccttttaggtacagaatttcgcgaaagtttaggggctcggatgcaaaattttcagaaaaaaggattttcactttatcatttattatatattggagtagaaataccatgcgtcggtggggtgtaaattctctcaaacatttgtttttttgtttttttgcttttcgttttcttctatattatcttattaaatacttttttcctcctctttgtagcgaatgtactgtataattttgtgatttattatttgtaacattataatttgaattttatatttaaattttctacctacaagctgttgccagtactccagtagtagtagtactactgatacaattttggctgcgtttagatccaaagttaaagtttggatctaaacttcaatgcttttatatcacatcaatatgtcatacacacgtaactttttagtcacattattttcaatttccaccaaaatctaaactttgcgttgaactagacacattttggaatttggtagtgtatgccaattgccaagtgagtgttggtaaggtgggtaatcatgaagtcattagtagtataaaatactactaacaatctatataattagaattaattatttaactaacgagattaaataaataagtaaataataatgtaattaaaatcaagtcatggaagggcatgacatgagtgagagattgaagacatgtgaaggacagcgaggaaagggttgctacgtgacgtgcagatagcggtgcacacagctgtaacgccttgtacttgagcgcaggagattggttagtttaacgacgactactatagtagtagtattaatttattattagttttagtttaattaaccgtgctagctggtcaggtaatagtacaatcagcagcaaacagtagaaggaaggcaaaatgtcattaaaggtcaacaccatcattgagtggcgtgagcattttcaagtactacctccgtaccttgcagccatgaaaattcatatctaacgttgacagtatgttttatttaaaaattttataaaaaattttaaaaaaattagtcacatataaagtaatagtaatcataaatttttttttaaataattcgaaaacattgggtatagtaggtcggacagacggagacaggacacacaccgccgtggatggacttgataacaccacaactttgcacggcatcggctgtgtttccgatgtgactctacgaccctgaccatcttgtagcttcatccatctctccctctctccactccattggtgcagcaagtaaagcaacctcgctgccgttaagcggggtactggagaggaaatcagcgatacagtttggatgaattttgaccaaatttaaaattttggaaaaaagcaaaaaaaattaaaaaaaataatggatgttgttcttaatttgtaattgccaatggtgaaaaaaattttaaatagagtaagctaaattaaaatttaagggcaaaatcgaaaatagtttacaagttgaaaaagagaagagaatattgggccttaagtatcctacatattcttccaattattccaattattctcaatttctagttttctatacatattcaaccgtatttttgattttttcccctatttattttacatttacatgatttcagctacacagcccatgataaccgtgcgaatatcgcggtaaaccgtgcgattatcacggtcaaactgcgaaaccgtcaagttttgaatttgaacttttggatgtgatttttgtgcgactttaggcgattatcgcagtaatcgtgttgccgcggtgtggcggtaatcccggcccaaacgataaggtaaaccctgggcagtacattatactactccctttacttttagctcctcttatttaacctaaaataattctatttttaataattattatatcgaaatttagaaaaatagggataaatataataggcgtaaataaagtggagaataatatcattgatattatgcaaagatattactttttttcttatctgtatatgtgagatgggggaataagatcttccttcgttctgagtgtacgacgttattaactttttatggaacgttttaccattcattttattaaaaatatatataaatattactacatcggtattaaaataagtttattttcatcattctccacatatcaccaaaagactataatatcactactttattcaatcccaacaatttttcactttatttaccctcaatacaattattctctaccttcacaaactctaataaaataattacttaaatttattctcttaacttaataagagagggagggactatttatacttttacgtatttatactaaatttttaaataaaatgaatggtgacgtgttatttgaaaagttagtactccattcgtcccattttaagtgcagctatgagttttcatgtgtaactttaatcgtccacctatttgaaatttttttgaataaaaataaaaaacataagtcacacctaaaatacttttttatctctaataacaaaaaaaactaatcataaaaaagaatttaaaataaaacggatgatcaaagttgaacacggaaactcatgacaatgcttaaaatgggacaaaatgggacggagggaatagctttatatattttaggatggagttagtaaaataattatttcgtgagtttgtgagagagatgaggtcgcgcatcacatggagagggcggagccagaacgaaatagaggaggatacctcttgcttaatttactctgttttaaatcaagtttaagttaatgcctgtgtctaagtttgtattaagaatgcacacacataataaaaatcgataagttataacttaaaaaaaaaatttgaccaagttactagacacacccctcccatagtactctacctccgcccaagtgacgacgggtcgaacggagcacgcgcgccggaggcgatccatgtgacgacaacggcgatagaccttgtgcttgcttgatgtacacatactctctctggtctctgctctgctaatacagctgctgccattggttgctttgctgctgccgctgcgcctgcatactggagtaagtaggagtactccaggccggactatcccgtgatccattttttgaatccgccggattcgattcggcataaacgcagcagcaaccaggaatacggccgggtctagaagatcctctgctgctggtcatggtcatcgtctcatcttatcgagacatggagagatggatccatgtttcgtcacgtccgtacttccattttatatttaactccctgtctccctcgtgtactcacgctcaggcctgattcagttcccaaattttatttccccataaacagcgtatcaaatctttacacatatgcatagagaaatatagataaaaagaaaaattaattacacagtttgcatgaaaatcgcgagacaaatcttttaagcctaattagtctatgattagccataagcgccacagtaacccacatgtgctaatgacggctcaaagatttgtctcgcggtttccagacgagttatgaaattagttttttcattcgtgtctaaataccccttccgatatccaatcaaacatttgacatgttatccaaaaattttcttttcgcgaactaaacacaccctcagtcttgtgagagtgctgctgtcctttagaatcatccttcgtaaaagtgcatcaccggagcggcaaaggaatattgaaaaacatattcccatttttggtgcaaatgcatatataaaagaaaaaagaattgcaaacccgtagaaaaaagagtaaattacacccattgtacaacaagttggcaggtgggtgcgatatagtgcaagaattttagaattgaacatctaagtacaacaacttaacaagtgggtgtgttttactgttttatataagaacttgacgatttagtattttagtgtatcaacttggctaagcatatgctaggtgattttttttcacgatgtcaatatgccattacatatgccattacatagtaatcctacagatattaacttttaatattgaattgagcaaatttcataaaactatatgtattttgattaaattatcagaaactataaatttaatatgatgtatcacaaaactacagatttaacactaaatttatcacaaaacaacaaatttaaggtgaaatgtcacaaaactacaaatttagtaacaactttatcacaaaactacaggtttaatgatagtttaatcataaaacttgacaattataagtccaacatatcattaggacgaacaatttaaacccgaaaatctgtagttttgtgataattttattattaaatctatagtagtcttaaacatatagttttgtgataaatttattgttaaatctgtagttctgtgatacattacatcaaatctgtagttttatgataatttgaccaaaatatctgtagttttatgaaatttactgtactgaatttaatctttaataattatattgcacatacatacaatttacatcgaattaacttttaagaattttttgttttcttaccttcttaactatcaaccaaatataataatttctacatttaatttaattgactttcagttattagttattaggataaaatataaatatgctccaaataattaagatgtcgcataacttcttctcaatttattgtattaaaatcgtacctactttgtaagttgtatttatgtgaccatttataaagttcttatactaaattacacctacctgctaagttgatgtaccgtgagtgcaatttactctagaaaaaatacacaaataatttatagggactatctatatatcttgctagaaaaccatagctcatagttttcgaattttggaacattagatatgctttaaattttatgtgcaacagtgatcttatcattttcctccccgtccgcttctccccgcaaccgcacgcagcacaaacgtgaggcaagctcgattgcttgcttcctcgagcaccactgctgccatcgccactgccaccccacaccatcgctcggtctcgttggctggccaaaaggcacgaatggcgctggcgaggaccccctggccagcttcctaatccccttcccctctcccaccccctctcctcctaaagtcatcatcatcgaggtgtccctgctatgccatcttccccgtctccgttagctccccatcgttgaatctaccaccacctcctaaccagttgctttgttttgtcctcatcattgacgtcggtccataggccccctccattcccgcgactccagcggtgccatcgcttcccgctcgagttcaccgcctacttctggtcctccgccactcacggtgatccatttaaagtcgaactcctccctctttccactctcccacccctttgtcacctaggactctaaatggttaggatcgtccccaccatttgttggaattcaacaatgtcactggagttggaggagaagctcactggagcacgaatcgtgaagcaaatctggaggttagaaatttgcaatattgtgctctcatttttctatcgaatgtggtttagcaatttcgtaatttctacatcaatgattattatacgagaatccttaaagatcgcctatggatatagggttattgctacaagtaattctcctaccagcaatgtgaaaatcaggtgacccgtattaaaggccgagagtccgaccaaggaagcggctaactagtcctagtctcgcttgctctacctcaccccctctgccctctctcctctcagagcaagaacaatattgagctataagtaagctatatacttgtatataagagagttaaagaaaaataataagtgttaactcgcacgtaagaactaactctacatgactacatatactcaaataaatatgcataaaagtcataataagagaaacagtgagagaaaaatagagctaaccttataactaacctattactccttcccataatataagagattttgtagggatgtgacacatcttaagaccatatatctagacaacagtatgtccagatacatgattctagaatgtgtcatgtccctctaaattcccctatattatggaactgaaggagtactatactctatagtagtaataaatttagaggttgctctatctcagctccatctcccagctagctagcttctcctctgtcactgctaaagccgacgtcattgctatcgaccatcgtcgcctcatcgaacagatgccatagagtcaagtaggagtattcggcattggcatgtcttggcaagcgacaacgacgcccttggcttcctgcgggcttgtttacgtcagatatgctgacgggcctcggcaagtggcgctgcaacattcgggcattgatccgattgtgaaaacccacaatttcatatttcatccgtcccccaaaataataatttagatagagatcaatatgaacaaccccatatccaaaggtgttaatataaactagctgggtgacccgcgtaattacgcggctagttaatataaattctcacctagattgattttgtatgaacggagggagtagttgattagtcagatacaggcactactacaaaaaccctcataaggatcggtcttataggtgccggttcctaggcctttttccacctccgcacgtgggaaaaaaaaggcacctttaaggcactatagctgtcggttcattagtagaaaccggtaccaatactagatgtgtcggttttttaaatgaaccgacacctataatatattataggtgccagtttattaaaaaaccgacaccaataactataatatattataagtgccggttataaaacgagccgagccaacgagccgagcatcgtatgtcgtccttgtccactcgctctcgcaactcctctccctctcacgtctctctccctcccgcgtctctctagcgacggaggctacccggcggtggtggcggcctcccgaggcgggcagatgcttggcagaggtggcggctgccgcaccctcccctccgccagatccggcagaaggggaggcggcggtctccagcggccgcccggtggtggcggcgggctcccgaggccggcggctgccgcgtcctcccctccgccagatccgatggaaggggaggcgacggtctcccgcggctgcccggcggtggcggcgggctcgcaaggctggcgattgcctggcgaatgcagtggctacccgatggaggctgcccggcggtggcggtggctaccgcgccctcccctctaccacatccggcgggaggggaagcggcggtctcccgacgaaggcggcagcggcagcggtggcggcgctcctccaccaccgccatcccggcgacccaagggcctcgttgccgctgcatcatcctcaaggccgctgtggttcgagtgtgttctttttatcttgtttatgttctcttgtttaatttctctcaagttctcttgttcatatgtgtaccgagaacatgcggatttggatcggatgaacattatagttaaatagatgtaggaattgttcttgttgttgacgtgttccttggattttgattttcggtgtgtggatattgttctgggatgtggaggggatcacgggatggggaggggttctgattcggctcgattcgagccggagtttttttagctcgtgtagacgtaaaggtgccggttctattttacctattggtaccgatgccagcaataggtgtcaaccaattggcgccggatgggaaaccggcacctattgccagttttcaactggcacctatagggcttttttaccagtggggtggccgtacatacaaataaatttttttggctttgtatataaacaactttcgtaatatccgtgcaaaagaaaaaaaaatacttcgtagtagtgaaatatacacaactatagaaatggaaaaaaaaatactattacccttctaaatcagcgttgttatcttttctaccggtagtatagaatattggcaaagagcacaataaagccacttgtttttctttcaaattattaggtgttctttaaaaaggtttgacaaatttcagcaattttaattcctgtaggattatatgtaggggtaacattgagtttctgcgttatattttctaatctctatgtttcagtgtttttatggttgttataagcaaattattaaggcttgccatactttttaagctttaacttgtggctaataaaattgaagcaacgcttaagagagcaaccatgctacacttttatgtactatcattgacataagtgacctatgcaatgttgaagggatcttgtccgagcatctccaaacaaactatctaaattagactctccaaacaactaaatagtcagctcttcaatagacttagcaagccaaactcgttactcactccaatagtttctccatctatcctctctatttcgacttataacactgggatccacatgtcatcctctgctacccctttcttcttcctcctctttctctcccccctcctccttttcttctcccaatggcgccatccggagctcctccacggctctccctctgtggcggtaacaacgaacagttgacaacgatagtgacggtgacggtgacggtgatggtgacggtgggtctgtgcgtgtgtgaagataggtcttggcatagcggcctcgaacacgcggacgaggaagggggtgacaccgcatgaggtgatgacgacgaggattaggaggcacgggagggtgggagccgatggcgatgacagtaggaggcgatgccgacaaggattaggcggtgcaggagggtggaaggcaacacctccctttcagacttcctcagctccgtcttggtccatcgccgctacgccaagaacaacacctccgttgcgccacctctcccaccctcctcggctccgtccccgtccatcgctgctgcaccaagaccggagcctccaccgctgtgacaccctgacccaattattatgaggcccatgtgtcctatgaaagctatatgcgcatgttttgtaccaccttactaatttagcaagggtagaaccagtttataaggcctcttctctccaaccatattactcccgggttaaccctttttacacgatgcgaggatgaaagtgtaagtggagtggtatgtgtaagtgggcctacccgttggttaggctaggctacgcggttctggagggaggactattacaaatgatattagaatggaccctcacggttgcgcgtatatgtcagtgtgtgtcacgcccagaaattcccgaatagaattccaagcaaaatgtgtattaaaacccccgtccaggaccggccagggtacacaaacgacaaagttgacatacagatccacgtcttacaaacattataaaagtcttacataaatgcagtggaaaattaaaggataaccggagctaagccttgacttggactgcagcgggaacaccactccacaggcatcctcgacggcacggacgaatcctactcctcggagaagccactatctgacacgtactcaaactctgggggtttggggggaaaatagagcaagactgagtaccaccaccgtactcagcaagtcataccggaataggggtatgatgcaggatataaccaaaggatagctagagcggttcatttgcataaagcgagcatttataaatagtagttgaaagcagtaaaaccattgtagtaattaatcaatatgaatcatccactgtccaacgctacaccacgttgcaacaggcccaaccatccacctgaactaatcaattccattagactaagctagggtgagactaatcacggtgaatctggttgaccacccataaccgcgggcacggctattcaaatagttttagtctgatcagaggtgtacaactgtacccacaagacacggccccacgacacgttaccgtgcgccgacatgccaccacgacatactggaaagaggccgtgacaggacccttcgcataaccccctctagccaagcacaccacacctcaggtttcaccccagtccccagcgggcaacgggtagtcccctctcgtgtctaggtgaatccggaagcgacagaggccgtcgcagggcccgccccgctccatcacgcccacccttgcctggatgcgttaactagaggaaagctacactacaagcccagccgttgcccacgctggcttgtggtaagtacgataagttcttccagggcatcccgcgaaccggtccttaaatgccatgggcgcgaccatcaaaaccatgcacccacagcccaccatttaatatattttaactaaccaacaccggagcggtggcattaaccaacatcattactagaatctgatatctatgcattaatgtaactcccccattgtgtgctagttgaactaagcatggctaagcaatccctagtccaatctctagtcatgttatatcccaagctaacaaaggagcatggtacaaaaatagcatggctgtaacagtaggtaagcatcccatagtaacattataaaacaatgcaaacattataaaacaatgcagtattcaagggaaaacgatagagcatttgcaatataggatcaacatgttcaagtgacaagcatgacttgccttgctctgctgctggaggaacttcggcgactatttcaaggtacaccggagcgtcgggagagccagaatctaagcgatatacaaagcaaacaatacaaacaggccataagacaattgaaacagagaacaaaaccatttttaatggattctgtgcatttttcttgatttactgagacttgaatgggcttaaacgaagctcggataaattagatatgaattttagaagattcactgtgtttttactataaacagaaaaatccttaattgatttattgtgaaataattaaaatcctggggagagagagggggcggcgccgacatgcgggccccacatggcaatgactcgggtggcagtctgcggcggaccgggtccacggaccggggaaggagcggcgcaccacgtggcgctgacgtggcgccgacatggcgtacacgtggcggccacgtggagccacgcgggcagccgaactgacggccccgatcggacggcggcgggagagcgcggccggcgcgcacgagcggctcaagccggctcagcggccatggcgcacggcggcgcggctcgacgcagcggcggcgcaaggcggcgaccggccggcggcggagggcggcggcgtcttggcgatgcggacggcgctagcggcagctaagtggctaggcggcggcatggtggctaagcggcgcgggagagagagaagaaggggaggaggtgtctcacggacggcgattgacgacggcgagcgatggaggatgatgacagcagcgggacgagctccggaatcacctagcgaacatgatgaaaggggttagggagagagaggaagatggaagagggcgaggacgccgaccgaaggcggcggccatggcggtgctcaccggcgcacgatgcggagtgggttccggcggcggaatccgacggaagaggggaggacggggtggcccgctcgatggtgaaagcggcggcgtcgacggcgcggctcggcatggcggctagcggcggccggagcagtagcggcagcggcggaaaggagggcgacgacgctagggtggcggagggcacgggagcgggtggttgcaaaacaaaaaagagagaggaggagacaggagtgctttatatagacccgcgggggtcgatcgtggccgggatggccgcgatttcgccggcggagtggggagaggtggggaggagagagaggcggccggctgctgggccttggccttcggtcggctcaacggggagggaaagagaatgggtcggcggcccattcgagaaggaaaaggagggaaaagaaaaagaaaaggaaggaaataaatttccagggattaaatattgcttgtgctcatttttaattgattaaaattatttctagagctctgaaaattccactaaaaatcttgttagcatatttcgacatgtagaactcaagaaaaattccacatgccaattccgattattatttgcattaatttattagggtttcgctcttgcttttacaccggtattttcttgaggtcatttataaatttaatttaggcttgggaaaagaacttcagggtgtgacagtgtgcaggcatatggcgcatgtgcgctctatgtgagtcacatatggcgctggcactggtcgtacggacgtgctctaagagggggggtgttcctgcctgtgtggctatatttagtacactttgatggggggaggggtgtatgtgacatcctaacccaattaggatgatgcatgtgtagcctatgagagctgtatgcacatgtttagtaccatcctactaatttagcaagggtggaatcaacttataatgactcttccttccaaccatatcactcccgggttaacccttttacataaagcaaggacgaaagtacaagtagagtggtatgtataagtgggtccgcctgtcggttgggctgggctacacgattctggtgtaagggctgttacagccgtgccacctcttccgttctcaactccatccccgtcgtccgccgccgccaagactggcgtctccatcgcgccgcctctttctaccgtaccgcctctttcgccctcctcggccagcagctgtgacaacggagggcctgtagctaccttggcttgtggcggatagggggaggtagctccgtgccatcgttgttagcaagggcggcgacgacgtcctgtctccgggaggatggggacgacggcgtggggtatgcggatggaaggagggaactccagtgcctctctgctccgtgccatcgtcaacgccgagccagcgaacaatagcaagtggcgctgaccgatacgagagagaagatcagcggtgaagaaaagcatgtggtgatgggaggaggaatgtgtgcggggccaccgttggcaagtgaatttggctggccaagtttggcgaattaatggaaggagggttttggcacaaggatggtttggccacacaattggagagggtgttggaggacgtgttttttttttgttacaatagctaaaatttagcttagagagtcacttggagaggttattggagatactctcagaagagtataacaaatcaaacaaaccgtatttaaattgagatgtactctatagttcctactacctctataccaaaatatatttatttttcacaatcccacacatgccaatacaaaataaaaaatggaatacccttatatgttatcaaatcccaatgcaactattcttcactttatattctttcaatacaactattctctactttcacaaactttaatgcaataattactttaaaataaacttattctgtactccctccataaaaaaaaacccaattatgggtttaaacctaaacacatgtctaggtttaaacccaaaattaggttttctttggacaaagagagtaataaatagaaggagccagaaatgaatttattatgggacggaggaagtactaagatggcttaggcaaaattgtgatagtgaacttaataacctttaatttcatgaattacaaagaaggccaaatgctctattagcaccaaaacagaaaaaaataacccctttttatgccttggtgattggtgatcagcagcaacatctttgtgatgacggatgaacagggatggccccgccgactgacacccatctgccccgaaagccgggcagaggcagaaggcggtcaggtcaaggctgacaagctaccagtagtagctatccatagctctctgtctccctcccataaaaagcgcagtttcccgaagcacacaccgctccaaaccatcaccccccaaaaagcaaacacaaaaccctgacccctctactcctactgctgctgctaccactaggtctcatcattcatttgccctagtgatttatatagggtaagcggctattaaaatttaaacttaaaattttattaacaaatatggtttttatgacttttaacatagtttttctatattagtgtgtcccagaatataagaaattagaactagatgatactccctccgtcctataaaaaaaatttaggaccggatatgatatattctataaaaaaaatttaggacgggatatgatatattatagtacgatgaatctggagatatgtatgtcagatttgtagtactagaatatgttacatctgatactaacttggtttttttaggatggagggagtatatttttaagtactacgaatctgaacaaatctatccagaatcgtagtattgtctcacccgattctagatccttgtattttggaacaaagagagtactacctccgtcctaaagtaagtgcagctgtgagtatctgtatctaatgtttgaccgtttttcttgtttgaaaaatttatgaaaaaataaaaacaattagtcacatataaagtattattcatcttttatcatctaataacaataaaatactaatcataaataatttttaaatatgaagaatagtcaaatgatggatatgaaaagtgcagaactatatttatttctggatggagggagtaagatgctaagtcctatattttacctataaattaattaatgttcatccaatctcagtatatttattttaagatgaaaaatttacccctattttaatatatttatttggggacgaaggaagtattataaatatgatttcaccgtttataatcagatcagccgtggcaaaccgatgagaaccatgttagaggaggtacaataggatattacaagccggttataaacatattttaatgagaaaaaagaggagagctaaaagcagcgggctacaggttcgtagccagctgtagcatagacttcaagatgcatgtgtgtatgacaggtgagactagacattaattatatagtatatatttgttggtaattattgtatgaattagctattaaattgactatagctgatttttagcacatactccctccgtccaaaaaaaaagataaatcctgggttttcgtgtccaacgcttgaccatccgtcttttttaaaaaaattataaaaaatttttaaaaagacaagtcacgcaaaaagtattaatcatattttatcatctcacaataataaaaatattagttataaaaaaaatttcatataagacggacagtaaaacgttgaacacagaaatttagggtttatcttttttttcggagggactagttaggccccgtttagttcgcgaaatgaacatttttagatgtcacatcggacatttgaccggatgtcggaaggggttttcggacacgaatgaaaaaactaatttcataactcgcatggaaaccacgagacaaattttgtgagcctaattaatccgtcattagcacatgtgggttactgtagcacttatggctaatcatggactaattaggctcaaaagattcgtctcgcaatttcccccctaactatacaattagtttttgtttttatctatatttaatattttatgcatgtattcaaagattcgatatgatgttttggaaaaactttcttaaactaaacaggaccttagcactattaaacttgttcttatcgcagctactgtagggacaaacccgtcaattcgcacgggccatcgtccgtactacgtgcatatccggcctcgccgcacgaatctcgaggcaagacatcgaccgacgtcatccctccgcgtctcgtctcgtcggggcggtgctacatatacgcgcgcctctcgtgtctcgcctcgccgcgcgacgcgacgcgacgcgacgtcgaggtgagccaccaatggaggacgaagccggcgcggcgcggaagcggaagcggcgcggcgaggggaagccgaggccgaaggcgaccaagggcggcagcaaggccaagcccaaggggaaggccgccgccgccgctgctgctgctgcggcaaccgaagaagcggcggcggcggtggaaaaggtggcggcggagcctggggtggtggtggagaagaagcaggaggaggactacgcggaggggatcacggaggagtccatcgccgaggtgatgagctggctggagctggagatcaagctcgcctcctccgccgccgccgccggcgcggccgccacgcccgcaccgttcgccccgccgcctcctcctcctccggcggcgggcggcggcgggtacatgccggcggcgaagggggtcaacaccagcaacatggagggcagctgcggcgcgtcgttctcggtgtcggcgtcgacggtgatggcctcagtcgacctccgcgccggcgcgccgccgcctccgccccttccgtggccgctgcccggtcacggcggcggggccacggcgtcggcggcggcggaggaggcggtggacgacgacgagtgggtggaccagctactgacagatgggcccgccatggagtagtagtagtagagtacagtgtccagtgagtagtactagtactgttgctactggtagtagtagtaggaagtagtaggagtaggttttggagggtagcgtaggaggctgacatgtgggggccatgccctttgtgatgtgtaggacagcagggcatgaactgggaacatcttttgtcggtgtacaggggagattcggaggagtacgttgtgtggggtttggatggatggatggacggacggatgtggctctgtcactgcgcgtgtcattgatcagttttgtcgtcaggctttgcgaccgagccataacttttttgaatcgccttctcactccagcgttgttggagaaatcttagcgcagtagcagggattttttttgtttttttagaccttttatttctaattttattaatactagaaaaaagcctgtgcgttgcaacggatgaatgctattttagtcgtattattgttaatttttttatctaaatagtatatgtgatttttatttgatagtatcgatatctaatttggaatccttatttggatggtggccatatcatgtacggtgctttcttatcgcctgaaaagaattctgaagcaattaggagtatgactcttgtcttaagttagcatgcaagttttttaaaaagactttttatatgactccttatacagacgaggtaccaaaaatatcgaaaaaacatttttaatttttaaaatagtagagattttcgtttgatttaagtgttgttatatattttctaatgggtgaaaaggagtttgttggagcaatttatatgttatgcttgcatacatacaatgttctttgttgttgctggcccgctgcatacgtgggcaacgatagagtcggattcacagtgcccactacatggtgacgaaggacggatatgggaggatatataagagtcggatgacagtaaaaaccaattcaaatacggatgacatatcaaagttctcaaaaaacatattcaatttttataatagtagtgagatagagatatagagataaaggtatagaatatccagtttgggtgtaggcaatatcttgatttaatttcatatactgatgccatgattttttctcgataatctacatggaaaggaaacaattttattcaaggaggattataatcattaatccacatggaccaggaaattaatcttgtgttagtagcaccagccaatagcactgccgcatgtataagacacctatctgtgccactacctgaccaagtgacagccatctgattaattaaatgcaacagtaatcgatcaaaagctctggttacggaggaaatcgacacggactcacgtcagccaataggagacgacgtacaaaatatataggcaaaaacattttaaacttttataatagtagatagatacttttctaaaaaatattttcaaatttgaaccttttcttgtttggtatggccaaataactgtcacaccacgcagtgatggcctgccacgccaagacctcgccatgccaatcaacgcttaagcttcggtttttcaaaatattttttttaaaagtctaataataaaattttaaaaaataaaaaagtcttaaaaatgaaaaaaatagtagcagcacttctaggtctcaacaagaagcccaaatcttcacgtagaaaaatgcaaatgaagctctcgtttttagattgacccatcaccaaaactttttccaggccggtctcaccgaggaaatcactttcctctccttcattcaactccaacctgcaccgctcttttcctttttctctcacttggctttcttctacgaaaatcactcagctcccatggcggcgtcccacctgccccctcctctcattcgactcgtggtgcagatctgatgacggctcttcttccctaatcctgtgttgctctcccctttccccatcgttggcgccgctcgccctcccccgcttcgcctgcgccgcatgggagaagacgccacggcggcagtagcgggcgcctctcccttccttctcgccaacggatttgtcgacggcgacacgacaaggaagttggtgctacagatgggttggtgacgagtggcggggtagaattgggcatggcgataagcttggcgtaacaacgaggttttttttagataatggattgacaacaacaaggttaggcgacagatttgccacatcattttccttcaccgtcgccatcttcccttctcttctacgggtggtgatggcttcaccagcgaccgcggctgcctcgcacgaggcgcaggagcatcgcacggggccacaccttctctcaactcatcgccggactcatgtctcacctcacctgacaaacccagacaaaaaacacgtgtctcactttggctacgcagtctttaggttagtagccgcacatgcgtacgaggaggcgaatctccaatgtggcctgctgaggctgaacgccaaataagtgccctgtgaaagcccttatgggaatcaagtacctcactccggtctgtacttgtgtttctctttatatagaagttgtactaactttatcctaaaatactttctgccgtctctttttaggattcaaacttcgtctctccattttaaaatttatctctttatgattcaaattttattttaaaatagttatcactataaaatttttcccgtttcaccttcaatcacaattccactatcaagcataggagtacatcctattatttaataaagggtattatagttttcagtattaaacgttaatctatcgtaaacaatcttggataagtatcatgagtcgagggagtattttgaattgaatttcatagaaatgatagatgtatgcgttatattttacattttctaaggatttttttacgctatttatatatgttggaataacctactactctatctaaaaaactgatcctagctacaaattttgtattctcaaatgtctattagaattgggttttttataggatggataggggtaagaatgtgaggtttggatggacggacggatgtggctctgtcactgcatgtgtcattgatcaattttgtcgtcaggatttgcgaccgagccataactttttgaatcgccttttgagtctatccaacattgttggagaaattttatgggaattaagttccttgctccctggtacaaaattatagggcgtatcgtaaatctttaagagaaaaaaggtaatttcacaaaatatttggatcattatgtcacaaaattatagattaaaaaattatatcataatctaaagatttaaaatatcgtatcggaaaactacatatgtaacatcatttttattaaaaaaaactacatatgattttttaatctcaatagtgttatggatatcaactctaaaatctgcagttcattaataatctaatcactgaatctgtagttttatgatacaatacaataaatatgtagttttctgtaaatttagcactaaatctatagttttgtgatacacatatttaaatctatagttttacgatagttttgtttaactatatgtagttttatgaaatttacgacgttaagtgttttgataaaatagttcgagtcataagttatttttttctcatctatatcttaaattattgaaaatgattcagcttactcgctagtggtattttctctttagcgtttatgccatattttacactgaatttggtagaattgatatatgcattataacttactagctacttactactactagttatatggataaaatctcttataactaggtagtaatagtatgttgaaacttgaaagcacctaagactaatttgaacatcgatatttaaatttcaagaaaatagtcataaaaacatttttgaactttgatgatggtgttatctatggatatttgtttttctcattttaaaattgaaataatgaaaacagtttacctttgctcacttactgtatttatcctttgtgtttctttttataaaatgtttcctagcattacaatttactactatttacatttttttgtaaaaaactttcactattgacatatgttggaaacatctaggacaaatttaaatatcaatatttgaaatttcataaaatagtcatcaaaatattttggaactttgataatagcgttatctattatctaaaaattaaagcttaaaatgtgacttgtctaaagagaaaaatgttattaagtagagtaaaccatttttactagttcagggataaaataagtgtactaatagtttaggggattaaatgatcccggaagtaaaataaacttttttctatttttaaaaagcctttagcacaatacttcaaaattgattaccttaatgagctaaaacaaaatttccaaatatttagaaaccactggataaaccggccaagttaaaaaagatttgaattgatccttaaaaaattgtcaaaatttgtctgattttttttaaggttttcatcgataatcgatcaattataacaccacggttatcattgaaaccaccggggagtagtattcaccaatcggtcacattttgaaaccctgtttgtttgccacaggggagttatgtctgcatggcgcgtactctgaaccttgtgcttatgcaatggaattaattatcattagggtagctattgtgtttattgaagacacagcgaatcacagatgtgagctacggaatattagcaccccatattcctgtagatatatactgtaacagacaccattagggtaatttgtcgaatttgtgaccgacgtcaatgttatgcatatgtaatacggaggatgttcattatgaaattcccgtcttgttgaagaggataacaatggtacacccaacaccgaacttcttacgtgcggaaaaacgagaaagatgggttgggaactcaattgaacacagccgttagtgcccaattcttgcagatgagagctacaaaatggctaaggtctcccgttcttcagctctcctttggtattatgggccatcccttgtcaaaagctgcaatgctagcttcatcccggatgcatcctaaccctaacaaacaatgtaaacatgtgagatgtctgaaccaatgtagtttggtcgccatggagaggtgttgtaaatgagacacacagccttttatggtgcccttcacattgttgttattagaaaaggtttctcttctgacaatttaatacagtatatgagaacgtttctctaccttcattaatacaacgcgagcaacacttgatggttcccaaaaaaaaaagagatgctagacaccgaaaaaaattagagggatgtcatttgttctactgatcttgttactcgtgccaaatgactatagtttgtaactttgtataaaaggaatgaaagctgatttatatgttcattggatatggtcatgtttgaagcaagagatgatccacctgtctggaatgtggaaaaatctaaaatggtatattttagtgttttctgatatattacatcgaccctctcatgggatatatatagaagtacataggagatagagacttggagtacaatacaagaaagaaagagtagatttatctttaggattctatctctagaactctattttatctctaggatatatcttatctctatatttgaattttactcttatctctaactaacatattcatacttctaacatgcaagatggaggctatcttttgctcagttcaaggaagcgaacataagtagcttgggctaaattcctcatgcttctcaatcctataaactgcaccatttattacgccactgtaatttgcatgagacctattgcagttggtagctaactgtacaaatctttacgagcgtttggcctgaacattcatggacatatatagggggggggggggagggggggtcataaaaaataaggtggccctctgtatgacgattacagtggccatgtgtccatactggcttcgaattgctatttgattctaactgtcaatttttcggctttcttattgaatgctcccatatgtcatttttagatatcttcgaatggaagttaattctggatttattcattctcacccagagtaagtttaataacgtagactataaatgcacgctaaattatctgaagataactctgtagatagatagagtatatatgcaataagcaactcctaacacaagatacgtaatttgctagcatgctatccttcagagctatgaggtcgtgacatgaaacctgtatggtgcattttgacacgtatgtatatagtccagaatttatcggcaggcaagttattatgttgttgaagactcttgaggtacaaaacaatcagaactatgtggttcttggtcatgcactttagtgtactttcggccttgacagtttctgtcgttttttcttgtaaactttatttcttctggatatattcggaggtcctccttcagccttcccggcgaatatagtgttgcaaccattagtgcaattggctgaatcggtgtgatcgacatgaggtcgtcagtgatacatggtttgtaacaatagggaaatcctttacttttttgtctggtcaagatatttttggtacatactataactttaacataagaatgctgtgtaaaccacaaaacttctcactagtggagcgtttaaaaccgagcaacatcataagagaaatgcagtggccaaagactaggaaatactgacattaaacatgctggactcaagagatcattcgagcatcagtcctaaggccagccctaacccaagacactagatatttgtctttttatagtagtgagtcagcaccagtttccaaggtccaacgacgacagcagcactcactatagtgataacgggattttctctcatagtgacggctcctgatccatatttggagaccactcgataaaccagccaagttaaaaaaatcaaactaattaagatttaaactcttgacaaaatttatctaaatttcatcgattttcatcgataacctctcagtcatcattattatcgatgaatacactagggagggttattcgtctactgatcacattgtgaaacctcttgtttgtttgaccgggcaagaatttgtctagtgagctagctgtaaggtggtgacatatgtttgcatgcatggtttgtattgtgaagtatatgcaagtgcaatgaagttaaattagctgtagccggccggtaggctaggtatatattgtgcttattaaggacacattaatgaagcccagatttgaactaagaaatggtgttagcacgacaaattcctatacatactgtcagaaaataccattaggggtagtttgtagattttgtggtggatggtagcgttatgcatctaatatatgtgtgcactaagaaattccgttctcttgttgtgataacaatgttatgtcgaactccagatttcttaccactagttgagtggtgaagaaggacaagagcaaaagtagccgcagactggatcgagtaaacttgatgtgtgcatttgtgcaagagacgaaaagcagtggattccagggtatttccttgcacaccagagatccaaaatggctatccctctcatttttagctctcttttggtattaccgatcatcccttgtaaaaagctctcttcatccggatgtctcctaacccaaaacatgtaaaatgagatatatatatctgcacatatatactccagttttttattgattactgcaccaactagattgatcgccaattcaacatgcatgtagtgtttttttttcttaaagagtcttagagaggtgttggaaaggaggtacatgcgtgcacaatcttcagtcttttatatgtgtcattctagttgttgttaccactactccatctcttctcaatcttaaataaatgaaagctatttatctataacttccattaatacaatggcaacaatgttagctagctaaacctttcataagaaaaatgaaaaaaagaggtagataatagtgtctttgatttgtataaaatacataaatgggctcagtcccaaatgaggcagccaagaagaaaccaaattaaaggagagagaccaactagccaccacgcttacgcccaaatccaatacaaacggtcggatctctttttcttccttcctctagaaacttcctctgcccttgcatatgccattacactagcttgcttgtctagaccactcagtcactcagactatgtttccgttcaaaggcacccactgcagaaggcctcgactcttttgcatatatgcaggcaagacactagtagaggctgaggtggagtttcatgtaattcaatattatgcctcaactattcagctgtttgggaggattgaaggtgtttttttttctaatttcaatgagcagaaggtttagttggatctatgttcttgatacctctcaatcctataaactgagccatggataacataatgcctttttcgagggacctatcttgcagttgatagctgactatgcaaatgcttacaagagtttggcatgaaaatgatggacatatagaggttgggtgctatctgccatagcaacagtggtggcactcaaactatatatggagagttctctagggagccaatattaatataccacttaaagtggccatgtgttaatgctggctttgaattgccatttgattctcattaatttgtcaacttttttattgaatgcccgggattttgtcgacaatcttcatgcagatattaatttccacttatagtttttaggatcgtaggagaatgaacgactttgatccataggatttttttcctatagaggtcccttaccaaaggattcgaacttgttaaattctacaggaatgcatttctatgcctcaatctcatagcattttaaacatgtgctctaacctaattgtttttctttcctttaagaagtccgatacaaattctctctctaatataagtagcatataatataattttttttttattttttctatgagccaaccaaatatatattctgacttttgagtaatttatgcggttttgtttcatgtagtatttaacatgtgatatttcaatcatgcgctttttctatacctacatttttacattcttgcttcctcaacgactccttattcattctcactaagggcatgtttggaagtccagtttccacccaaaactagtttaaagttccggcccgaattattgtactggggaggggatacaaaatggctttgctctgatgggagtgtaatacactaaattttagaccgcttcaatccattacactcaggtaactaagatcgcctcagcaagtcagcaggccacatttttttattataaatgtcgagtcctctctcattggctcctccgtgctgttctccgatttgctcagccatgtgttccacggcgaccctcctctataccctcaccttactccaagccaattcaatccatgctattggcctcatcctagactctctagtgccctagattctcactagcttgcttagtaccacctgtgtcgtgtagtcctagtcctagatctgcattgccaatgtcattgtagcctcacttctcatcaccagcatcatcccatcctcgatccacatgtacaatatcatctcgacatctcttcaaagataggagtcccttcgatttgtgatattgcataattgggccttaggctcaaatgggcagacaagaagaaaccaaaaagagagacccaccacacctaaatccaatccaattatgcggatctcttctcctttttcccaagaatcctccattgcttcctgcgctgcgatgctggcttgcttgccaagccatggcatcgccacagttccattcacgtcagccagccgtgaatggaactgaatcgccacagttccattcaagtgcataaaattgatgcaaattggtcactgaatcggcatacgaagagaatgagatttaatttacaatgttgagatagaaatgcacctaaatgttcatttgaacatatacaattcaatcaggaaagcaaccccaattcattgcacatggtattctagcgtaccgagttggtcgatttactggattgctgtgaagatatgataggtgtaaaaatcaggattagcctcttgacaatatgattaataaccgagtaagttgaaaactttataaaacataaatggtatctcacctttagcagacttgaacctttaagcaaagctagtagaactgcaactcaatcctagcaagtagcaacatgactgccttcctctcatcctctggataaggctagcctacatgaaggccatatttatagcatctctaaccctgtattccaagaaatctatatatattttgaaaccgaattcatactgaaatttgtggtttgagctcgttaggtgtacaccaaatttgagaaacgtggtgtactttgcccagcatccattgggtaagacctttgttttttatttcaatcaacagagctactggttaaatattttcaaattattgaaactttgcaaattcaatcatgatggatactgaatactttctgacgtaaacatgcccttgctgaaaaaaaacaatggctcctacgttcacgtgcacgtaaaccctccacggcttaacgtacgtctcgcgtgcaacgacattatgagcagtgagcatagaatgggtgtggtttcctgacgtaggcgtaattggtggtgcgtaacccattcaccagtccatcctgcgctcacgtacgcgtaaaccgtgcacggcctacgcgtactgggtggatcgagattcaggtggtgtctacatggttcacgcctacccgtggaacgcgggcgtaaaccattccatcctacgctcgaaagctttaaaaaaagggtgcacatcgagcctacacatatctttggggagggagagtattatgtttacgtctgaaataccatatttactctccaaatgtaaggtgtacctagatcgatatatgttcaccatgcagggaagggggagtgatggattgtgctgggctcctggcgtgctgcgtctacacagtgacacaaatacgatgataccatcgtcttattgctcctccccgtcgtcttccctaccacttcttaggggacctgtgtattcatgtgaattatagttaggcctatttagggaagctttcagtagctacagcttcttctagaatgtcatgcaccaaacaatccaaattctcgcatatattctctggcatagtttctccaaagaatctcaagccccctccaatagagccttagccttagaaacttttcacaaatgtgtacactactgtactacatgaattaaactgtttttttttggttgaaatgctccgaaagattaatgcatgcaggatgcctgaaaagttttgaggctccaaatgccagtttggtactctgaactctgcagggtagccttcccgtgtagcctgtaggcaatggtagcaactagcaaggcaccagctttccaaagaggctggaatgcaaatgcaatgggacaaacaatacacgacgtacttaagtatacattactagtatggcatacagcagagagaaagctcgccatctttctacttggcacaatcttattgtactttcccgttttcactttcaccgagtaaattatcatggctaggaggaacacagccttttcatcattaaaagaggcaggaggagcagatcagctctacaactccactccagactcaactcctagaactaaatttagaagttagaactgtaccaaacagacccttagatcttagatctgtaaagtaacgcaactgtgtggatagcctgaattgctcagtagggagtattagtagtagtatttgcagtgaaaaccatacgtgtttacggtgaaaacagcagtgacgggccggcattgaagacgataggtcaggaggcagcggcggatggggcggcgtttgttttcttcttgcattgacgcccattgcctgaaaattccaactccatgttcctgaattcagagacaatttgcacctttcctgcttcatgctcttgacttttggtagtggtacagtttttgattatctggtgaaccttctatttcaattgcatcgtttgtttttatagatcacataagaacataacaggaagatgaatacacataaagttaactgattcttcagaaatatgctgtctctcaatgctccaacgctaccaaatggacaggtgattattatcactgaaaacacattaagtcataagccacaacattttctgatactgcaagtttatcattcttgaacatcatcatgattgatgagtggcacatgaagctcacatcacacacgattataaaccatagacaagcgttggtatcttttcagtggtgtacacacaggatatcttactgtggggtagaatgatctttcatgttggcttctcgtagctgttttggtctctgaactctgatatcttacctctgatcatctccgccacatgaggctgcacaaacatgtgtgtagggtcaagcatgtgcaggatgaacttgtccgaagcgggcattgaagcattcagattaacaatgaactgtgccatcggtacatcgctggaaaaaaaaaggatttatgagttgattgtgcaaactacatagaggtgaagaaaaacgagctaaattttatcgattgtaaaaggaccttaccaggagatgaacaacccctttattgcattaaccatgtttctgctctttggagaacagaatgccacctgatcatttaatcagcaaaccacacagccatgtcagtggagaatcagaagtactggaaaccttccccaacaatcagactctaaaacagtgatgcagtgatcttttaaagcacggtaaaagattgcaagtgaggagataatggagatagaaaccttactgccttctaacaaggataattatgagatgagatcatataatgaatgacaagcatccaacctaaataagttatgcttaaattgcttactgctaccacacaggtacataatacaaaggtgtgagctatgcttgaagaggcaataagtttaaatcatactccactaccgaaagttggtaactaacaaaaatatgcaaaacattgtagtggccagtgattgtgctcccgtgtccaggggcggatccaacttgggaactttttggggaacaaacaaactgatctagaagagaagctagggttaacgaacgaacgcaagcaaattctagtcccgatgggaatgggggagagagagatgaatcagaaagaaagaggatgtggatgctcaccatgatcctctcccctgctctgctcgcccgatggagatcgccggccacgactcgtcccggcggcgcaaggagcggaggagaatgctcacaagtgtcaagacttgcagtagtatgttgagcttgctgtactacaatagttagattggcagttgaacattagtgaagtagtaaggaacatgattgaactgaagagcaaaagagcgaactcttctgaatacaaatatttcacttgaatcaaattattcgtataatgtcatgtgggttttgtacaagaaaccataccggtacagtaggctgtgacggctgacgcgcgacgtggtgctagctggacgggcgggccggcgaggcgattcggcgcgcgccgccgtcggagaagccccggtgccgggcacctctgtgctgggccggaccggcggcggggcgatgcggcttgagcacgggcggcgcgcgacggcggcgtcggcccggcggcgcaaatcgcctgcagggcttcggtctcgcgagaaggggaacgggaaagaaacggaataattaattatttgccactcttacatatggtgataaataatttgccactggatccacatgtcatagacacatgagggcccatatatcataaacagcaagtggcaaataattaattgacacatcttaaaagtggcccaaagttaaatgtcccgaaagaaacagccaatcgtttttttccgtaatggcataggcggtaattttttcccctcaaaagccagtaaaaacaggggtatggactgtttttggatttgtactaagagcaaggttaataatacagttgacctgttggctataaggtttcttatagtattttctcagcctacccatataataactagctctttacaattaatatagggtccacttgtctctcacagaatttcttgaatttcttggttcttttgtctaagccggctataagtttatagcccgcttcttctctctcctcacttttctcctccacctcagcatttagccagcttatagcctaatattatacttgctctaagcagctttagagtaaaagcacttgtggcttttggactatttggttggtttttgatttttgtaaaagcaaaaacacgttgaaaagcccacccaagcccaccctaaa

SEQ ID NO: 8256 - DNA, 58767 bp, Oryza sativa
  unsure (1)..(58767): unsure at all n locations
tggattgaataggttaaccagagatttttatcatcaggggtgcttgtggtgtggccttgacaagaacacctgaacaaccagagattccagtactgttccactagataatgataacaatgctgcagctgttaatgtgtgctaccgctagctcttcccccctttttttttgcaggcctgcagttttaagtctctattgctcactgacaaacactcacttagaacaaatgtctgatgatggggatattcttgttgtataaagtctggtgaggatttgtaggacagaggtgagaaataaaaagtgacctttaaaactaagtataccagcacacattcatgctctttttgtcatctcatttgctgttttctgaattttgaagtacatcgcccttcttttcctcgtcagcttaagctttttcggagcgatctggctggtgtacgcaactcgatattgaaatcagtaccgtgagtcaactaagtatacctgcacacattcatgctctttttgtcatctcagttgctgttttctgaattttgaagtacatcgcgcttcttttcctcatcagcttaagctttttcggagcgaactggttggtgtacgcaactcaatattgaaatcagtatcgcgagtcgtgagacctcacccttggtgtgccgcatttggcatcagcacaggtgagactgacatcatggtacggtggattcctacaactgcaagttgggcaccatggattttattttctgaagcttcctctccttagatgcaacggcagcgtcattgtgcggccggcaagtggtcagtccatgtccatattgttcggtgctcttcaagttcaggaaatggccatgaagttacagaaaatcatatacaaatataactactaattatgccaggggacagcaaaaaacccaattggctttaggtgcaacaaatgcatgaagaaagatttctccttgcatgatcaaaaatcagcacatgacaaatgtgccaactgatcggagcacctgcttgaaagagagctctgataatgtgcatggggcaacaaacaggtttagttcagactgattatcatagacagagaccatcagttcgcctgttacaaccaataggaattcaagaggaaaaaaggaagggcacgtgtcgaacgcagaagctcaaattctaattctgaatttagcaaatgctcataaaacatagctgtttaagccactgtagccagacatttcaactcatggttgcattgaagcttctgatttcaggtggcgcggcagctcgaaagcaatcaaatgctatccatgactggtcagaatcatgtactatttgaagaaggagatgattagaagttctttttttttaagtaaatttcacaaaattacaggtattttgactaaattgtcacaaaactatatatttaaggcgttgtatcacaaaactacagatttagtaccaatgtatcataaaactacagatttaaggttaagtatcataaaaatgcatatttaatattgaagttatcacaaaactacaacttttggagtttaaatccatggcaccattgttacgttggagctatatacattattgctttgtgactaaattggttctaaaccagtagttttgtgacagtttagttactaaacatgtagttttgtgacacttcatcttaaatgtgtagttttgtgataaatttagtgttaaatgtgtagttttgtgataatttgatcatagtatttgtagttttgtgaaatttatgcttttttttccttaaacacacaggagatccctgcatcatcattatattaaggaggacaaggatgattcagaagctcactatcttgattggaatccatgcaatggggcaagagcatattgtgcaaggctgcaagcataaattgtgtggatatatcatcatcgtcatgatcatctgattgctttaaggctggagaaccttaaaggctctgaaagcacttgaattggaagaattgccattttgcactccagcatcaacttctgaacttgaccctgactgaataaacataacaatttcttcttgtcaatatgtacatctgatgcaagaaatcagaaaaaaaaaatcatgccactcttttcacttcacaaaagactcttttattgacaatggcatctcagtttttcagtggggccttctttgcatgtttatgaactggagttataagtaccttgttaagggataatccatgctaattaaaatcacctgaaactgtgcatcagcaggtgacagaaactgaaagcaggaaaaaaatgcagaggccatcatcaatcacggtgtcacatattgcaggggaaagttgacacattaacacccaaaattgttgaagagatgctatgccatctgcaatcatccacatggtaatagagcgctgaaatcgactccacattgtacaagctttagcatgcaggaattctgttcccagacatgacggcttcatagagcaatagtctctgtctgactagaaagtttctgaactttgaaaaggcgaaaatatataagctactactaccagggaggaacacctttcatgttagaaaatgaaggaatatcttcaccatcttccatcattcttcacttctatatgttgcttaggatgctacctgctgcttgcgtactgattcttgttcttttcgttttcatttttatttggttttctaaagcgggttctttttttttaagaactcatgccttttattaaaccaagagattataaacagacataagcggatctaggggtggtcccggtaccactcaaaaaatctagcccaatgcatatatacctatgtgtaaagattttatttaccaaaatacatatcttattaatatattatgatgcatatttgatcaatttatacttctaaccttattatatttgcacacaagcttcctgtgcacactccgtgcacaccaactagcaaatgtcataaaaaattgtaaaaaaaaaattggacatttactcataatagtatttcacatatctaaaaagtctcatattcaaattcattatattttaaccgtaacaaaaaagtgaaaaaaaattgataattttaagggtaaaaatctgtcagaaatgtttctttttggtatggctaaaatataatgaatttgaagataagatttcatacgtaggtgtaatactgttggaagtatgtgcccaattttttctagaatttctatgacatttgctagtttatgtgcacggagtatgcacgggaagcttgtgtgcataggatatattctcatttaaaaaaggtatataagttggaccacatatataaacattctagatacgtcactggaaactgagtacatgagttatgcttgcctattcaagatacaggtttgctagagcacaaacagtttatatcggtatcttttaggtgacaactgtgcattctagaaatcttataggtgcataaattgtgcttcattatcttaaaaaaaaaagatgctacctgctgacataatatatcctggtcatcatcctgtcacgacgttttatcagtaacagtgcacattatctatgctcagctaaaatgcacaaaaatatatgaatttatcgaatttatggatttgccgctgatttctgtttctttgaacgtatgttagggagtcgcattcacgggtctgtgcatgtgcagtggtgtacgagcatatgcgtattgcatggtaactaaatccctgtctagtaaggcctataaagttttggcgtgcaaaaaaatctaataatccaaaaaatatttgtctttcactttgacatttgatcagccagatgctcctatgaaaccatagggatcatttttttttcccttagtaccttagagaaatttacgagtatctgataaacttgaattttgagttggtgggctggcatggcctaataggccctctatgtacagcccggcccaatacattgcagtctttgagataacaacgttttacatttaatatgcaaaacctaagtaagcagccaggctcaaactaagagcatatctaacagagttgttacttttaactctccaaatacttatttgaccaatttgtaaaaaaaaaaataagtggcaaatttacctatcactctagtagactcgccacatcccactctatataccgacggccatacatagaacccacctatcattctcctgccccttctttcttcttcctctcactttctctccaattcactaccatgcggagctccctgccatcagccgctatcccgtcaatccgtgcgccttcagctggccacctccctcatcaagctcctagcggggttcgactctatgacacgcaagcttgatgacagcctccccgttgtcgttgccgagatgcttctcattttcgccggttgtccaccatcgcgggtcacatcctcgctgatttgaaggttgcggggtggcggcccctccatttaattcttatccatgatttgggagatggcggtgtgatgaccagtgacagtggtatgagaagtggcggcgtgatgaccaatgacaggtccaaattcttctgtgttataggaggcggtgatgcaggaggtggtgacacaacagctagcggtaaccggtgacggtggtgggctcacacgggaggcgtcgatgctgttcgagagagggatggggagaggagagagaaggggggtggtgggacccaccatttggccaacgattttggcttgctaaatttggcgagcgaggtgggaaattcggccaacgatttggcttggccagtcacatggaaaatctataagtaaattcctcgtgtatccctaaaaactcactcaatccctttcatacctctaaaatttacctgatcccgtctatacccctgaaatttcaacttatcccttccatgtccctaccgttacatttccttcatttcactattacgtttggttgcaaatgtattttttttgcccttggtactttatgtttgaatataaacttgaaaaagattgaaaattttgtttgagtgtacagtatgtgcgttgtatgaaactaatgagactaaataattagagcagaaaattttgacataaattttgaaaataaaaaaatgcaatgaattaaaatttttatttgaaattttaataggacaatgaatttttttatagggagcattcataaaaaaaatattgtgagcattagtagtcctattttttatgaatgcccctcgttttttatgactttttaaaaaataaatacatattttttatttcattatccaaaaataatttttttataaataatgcattgcacaacaaactcataattataatagtctcatgcgacaaacttttacatttttaataatgtaattcataaatttttatgttcatctaaaggataaaacgatcatttttatagaaattagacggtcaactgacgtgaggggtatggaagggatcaaaatcaaatttttgaggtatataaggaagtaagcaaaattcagggacatagaagggattagctaaattttcagaggtatataagagattttctcaaagtctattggtctacagatacatgaagaaggaaaaacgaagctataaaaatgacctgggttacgaagatagccggaagacctcagggtggagacctctgcattacgaatctgcacaaacaaaaatataaaaacattaacactagtccctctccagaaaaacgacaccaacaacattagcatatgctctgcaatacacgtactactagatttgacatttgcaggagcaaactgaagcaagctgctatgccatcactcactgctgcttgctccgggacaaaggaggccgggaggctgaggaccatctgcaagcatgatgcagatgggtggacgcacagagagattatttcacgaatctgccgttgaatatttgacagcgtacgtttgtactctaatccctgaacattatattagttgtacaggatattttagatttggggctctaacctccgaagaatttggcccggtttagatttcaactttttcgtcacattgaactttcctacacacataagcttctaactttttcgtcacatcgttctaatttttttaaatttctaattttagcgtgaaactaaacacagcctttgaaggagagtgagtgacatgtcgaatgtcaagagatgattctgcgtggtaacagaggactcaactcaactcctcactggtgtccatttacaatttccgtggtcattttttatatcgaatatttctgttcacccatagaaatacttttttttgacgataaaatgtatttttacgacggtttagcacctagctaggcttattccgatgtctgatagtgcctctgcaataggaatcactaacgtgtggacccttaagtaagttgggcccatatgctagctagtcatagtactgcagaggatattgttccataacaaagggaaagaaccacattagtgcatgcctctttgccaaatggtttggtccaattacacgcatatgtgagagaaaattccttctatacccctgaaattttagctaatcttttatatgcctctgaattttgcttacttctttgtatatccccaaatttgattttgatctcttccatatccctcccgtcagttgaccgtctaatttctataaaaataatcattttaccctttggatgaacatagaaattcataaattacattattaaaaaatgtaaaagtttgtcacataagactattatagttatgagtttgttgtacgatacattatttatcacaaaatttatttttagataaataaataaaaaatatgtatttatttgtcaaaagaaagtcataaaaatgaggagcatttgtacaaatataggactaccaatgctcacaataattttttttgagtgaattacactttgggccatgttttattattaaactttcactttggaccacccaatacataatcttttcgctttagattaggtaactttacctttgttgcacaatagactaccctaactcttttcgcttgtgatgtctagcgtctcttttgacaaaagtatgtcatgcatataggtatgaaagtttgctggcatgccgttaacaatttgctcgaagtcatcgaagaaatgaaaatgtgttttggggtggtccattgtgcaacaaaggtaaagttacctagtccaaagtgaaaaaattagataaagggcggtccaaagtgaaactttggcaataaaacatggcccaaagtgaaattaactcctatttttatgaatgctcccgatcaaaaatatccgttgtcctattaaaatttcaaataaaaaatttaatttattgcatttattttattttcaaaatttatgtaaaatttttttgcactaattatttaagtctcattagtttcataaaatgcacatactgtacactcaaacaaaattttcaatcgtttttcaagcttatattcaaacctaaagcatcaagggcaaaaaaaaaaaaggcatttgcaaccaaacgtaatagtgaaatgaaggaaaatataacggtagagatatgaaagagatcaagttgaaattttaaggtatagaagggattggataaattttaaagatatgaaagagattaagtgagtttttaaatgtacacacggaatttactccatatgtaacgacgaccaacttcacgaaatacctagttactggtcgagacatataggatcgataatgacaccatcgtacgtaccgaaaacactggcatttggtgaccttgaaacatggcattaagcatataacctctagtttatccaaatcctgcgtatccatagctcggattaaatatatgtccttcgactatcttaagtcattttggatatccatatggtccaaccatcatcctctctacgctatattatcatcactatggttacactagtgattccttcaccatgaatcattcattgatataaaactgtgttttgagtctggcactaactactcatccggtcctgtcaatttagtggcccggagcaaagagaaagatgggtcctttaatacacctctgataatataatataatgatgtttcaaacaaatataatacataaaaaaatattcttatatcaaataagttgtatatcttcctctcctgaactttctaaatctaaattcctatactctatgggctcctatatccatatcatatacatatgagattgggtcccttggctttaagagccgagccaggtgcggttgcacagctcgacccccccccccccccccagggccgagcctgataactcgacccatgtcgctgttacacatagatttacagctccaaagtcacctgcagtaacgacgacgcctattccgatataatctccatgcgcgatgtggacaaggaatgaaaaccaaacactgtgcctgccagcatcctgcagccgatggcgtcaggatccacgacgcatctttccccttgcttttcgatcggcttaaagctatgctaccacacacagcgatatattcagatatgaaacgaacggtccaagcaagcaagcacagagacatacacacattgagatcgacagggagacgagggtggtgagtcccacgcggtctgcattgcagcaacgacatgccctacaaccaaaggatgtcggtatatatctccatctgtatagtagtatcttgcgatcctataccaagccgaaacaatatcgatcccatatagcatcttaattttcttagtttctcgatcccactatccgttaccacacgatcttacaaaatcttagatattatcctgattctacggttctacaaaatattatttaaaataagatggtttaaaaacaaagtaaataagtatgctgcacaggtttatataaaaatcagttaaatataacaaaactaatatggtttttcttgataaaatatctctatttgcatgacatatattattactataaatttttatatagaatggctatatgtaattaatacaaatattaattaaacttaaaaaaattaatagtatcctaatactgtgatacgatactattttgaacaaaacgatactacctacgatcctgatcctaataaccctgtggtcctcgcctacaactgcacactatagtgcattgcagatgagcagagacgacatttgccatcgccatgctgtgcgtcgacagtgtgcgagtactgtgtgagggagtgcaaattctgcagagatgatgcagcctttggccgtgtcgcctttagcagctagctagtgcccatatattcttcttctacctcgctcatcatcatgcagacaacccagaccaacccaagctaatgaagatatatatattgtgtgtgtgtggactgtggagatgaatatatatatacatggaggcatggtatgattgtactgcgtcaggatctcaatcagtgggcgtaaagtgaataggcaatttggatatttttgtatgcaacccctgatggtgctgatgctactggtaaaagtaaaattttagtcaagatgaatataaggttataatgaggaaagtctttgaaataagttatcatgagaaagacagtaaggttaaacttaagctctgcatatatcatgcatgggaaagtagctgagagtgtcgctgattctaactgaaggtcttatttatttgtgttttctgaaaaaaaagtgtttgagaatgtaaaatattttagttatctgaaaagatatactaatgctaaaaaaatgtggaattgctaaccttcattttacattatttttttagtatttacgggagggaatggggagagatttttggaccatcagattcgagttaagattcttacctggctctttgtcatccagctccgacgagcttctcgtttttttcggtaccagcgacaccccaacttcagtagaggtgatgaagggaaagacgatgcgccggacagggcacatcactgccatctatcttgggtaggaggctggtcgggacggtctcgtcggtgctggtagcatgggggctggttgctctagcgtatcgattatgagtgaggagaaggtgagggagaagataaacgaaggcagtatagctgcacgaatctcaaaatgatctggactgttcaaaaagtgaccgagatgcgcgagggtttttttttcaaatataacataagcactcccttaaaattgttagagacgctaaagtattctcattgtattgacatattcatagaattagtacattagtagatatagctagtgatatgtcgatttgaacttaatttggtgaactctatgcactacacctgcacctttagctcacacaggttagctttccagccaccatattatacatagttttaaatctccgggtatagctgtttgagaagtgtcctaggtatttgctctaatgtacaaattagtcattatagtttcatttagcccgttgtagctgtttgagaaggtgaaccgctaaatgtcttaacatgctatttacaaccataattatatctggtcaacaatcttatatttagcattaacagctaattatacattgacaatacaatggtcatgaaggcaaagcgtagtgcttttcgttggatgaacaattattgaagtcatatattataccatctgtttggacagacagttatcccaactagataaaatatcccgtgtattatagcaataattcgtataaataatttaagcatatatgtcacctatctggttttccctgccatccatgcatcctcccccacctagtagtggttctggtgtccgacgtcaccgaatctagcctggtagtctcttcttccttaacatccatgatgctcaatctagcacatattttatatgggcaaagtgataaggtatagtatatttctcctgtttcttctctccatatatcgcatattctctcttcaaggctgatactacctttcttccaaatgtttgatgttggtcagttcaattttaagctaacaaataaaaaagagtaaattacactcgtagtgtatcaacatgacagataggtgtaatttggtgaaagaacttaaggaatgagtatcctagtacaacaacttgataaatggatgcaatttagtgtaacactttataagtgaatgtatgagtataataacttgcaaggtagatacgattttggtacaataaattaagaagtgattcaataacttaattagttcaagaattttttggtatacatatttaatatttattttaacaatatactaacatggattagtgtaggcatatttaaattttcattccaataactgaaagttaattaaactttatttttcagaaaaatattatatttcgatttagattcgagaagataaaaaaatccataccggtaggcaaattggaagcacaatgtaattcttaaaaattaaattctaatatcggtaggattcctatgtgctgacatattaacatggagaaaaaaaactcacctagcactcgttaaccaagacaacacatgcttagccaagttgctacaccaaaatactaaattgtcaatttcttatattagaatgtacctaactgttatatcgcacccatgtgccaagttatttaaccgtagatacaattgacttaaaaaaataaaaaaattatgccatgtactcctacaaaacacaccgaaacatttttgtccgccctattttcttcttctctcttgttcaccatggctcagtttcaacggagccaccagccaagatggagcgttgtaaaaataactctaacacaccccaaggtcaaaaaggcaaaaaaaacgaccattttgcccccatacaattttacatcatgaaactacgcctttaaacctttttaccctgtataatccccaaaaaaaaaatccctcatctcaatactgacacgataagtggaaggttagcttgagcgacaatactgcctgcaaatcgatcaattactgttccgagtttcgactgtcaatctgacgacgatcaacgatagctcttctttttttcctcaccgtcgtcagaaaaaaggagaggacggggtgtgggcccggccggccggtcacatgtggccatcagatccaataataactttggaatgtattacacctcctctctcatgaaattactaaggccaccactaacaaagcacacgaacatgtgtacggctgacactacggattcaactaatcaaaccgttcaaccgtagtatggattaagaaaatctacatatatttttcagctttgtaaggtgtactagatggccgtgacaacgtgcgagttaaaggcagaaatggtacagcagttaattttgtgacgtgcattcgacccgtagcggatctagaaatattttggaccatgagtagacttcattatagctaatatttactgtagaaattttatttttatttttttctaattatattggattttagtggattagccgccgacgagcccgggcggctgcccggggtcaccgggtggtagatctgcccttgcatttatctgctccctccgtgcaaagacgtagtatttttagttagtttttacacacaaatataagtcatatttaatacctcaaatacaaattaaatgtgtattgctccttttatttgtgccatatggctaaatatttaagttttagtgcttctttgaaacacaagtgttaaagttggtgtcaaatacatgtacaaaatcggttatagtttaggacttggatttgtgcttggtattgtgatagaattataatcggtctatatccgctccatcttaaataaagaggatgcagttcatggctgttttagaaattccaaaattttcacatgaattggttcacattccaaaggagttcctaaaaaaaacctctgaaattccttcattccaaaaatatctcccctttgggctgctgcaatgcaaaataccagcatatagacgccctgcatttgtgggtggaggaagttagaaagtaaaatttagcatttggccacttcattcctaggatgtccgtaaaatagagttgcattatgtcctaaccattttgcctatcatcatagtaccactggtataaagcgatcacttgaaattgaaggcttcaaaatttattgccacttgttggaaaactgaaagttagtaatgacaacaattggatgcacatgtgagtgattgttggatatatggtaactgaaatcaaaacatcaaacacatgatccattctaactttaacttgtgcccctgctctattcccctgtttcatgccaaaagaaaaaaaaatgaaactgaaatgctgcctacaaaaactgaaatatgcaagtaattaaacttatgatataatttgaggtgctactgaacatcaaaatgagcacttacatatgcacaccaaaaaatgaaattaaaacaatgacatgtgcagcactatgatgtgtaccaccataaataaacacaactcaaaaatctatgtatacataaaaacaataagataaattcaggctttgaaatacaaatgactattcatacaatgcattgttttattcatcatttgtatatcaaattttgaggtgttctttttttggtaacacatacaaatacaattatgtgttgcgagacttaaactcaacctaacctaggttgatataggtagtgcacattccattttctctcccattgtctaatggaaaagaaccagtttctcagcttaaagtagctttccacaccacaacatctacaaggcaaagcgatttccccaatggaaaactggtacacaagcatggcacacacactcaactaagcttgtctcttgcaccccccccccccctaaactcctattttaaacaaaacaaacccaaaatcatctggataaacaaaagatcacaaataattaaacaaacacccaaatctaactttacaccatcttttgcctaccttttacctttacctttgcgaaatcatcatcagaacccaaccaaatggagctaagctctgctctcacttgaacacctggtcccatggattgcctatagctgattaattgattataacccataataataaattatagataaatttttcacatatatgctctcggcgacttaaaagttaatattaaaaagaatatatcaaaatctatcaacttcaaaattaaaatttaaaatttgacatcagcttataaatatagggcaaaagatgagagatcgcttatgcttatgcttatcagtcaaaatttaaatttttaacttatatttggagctgattttagggtttttcagtgaagtttatttttcagcatttgtttttagatcgctaagaagaactatataaatttttttcacaaattatgaataagtgaaacgttggggctatgtttgacaaataggatagggaaataattttccacccatcaaaagatatctttaaatcctaaccatttattctcccccttcatttaatcctaacccttcgttcattttactggggcacgaggcctgggattaccctgtccaacctatttattgccacctatccttatctcacctcgctgcattcgctcactcacactcacactcactctctctctctctctctctctctctcgacatgagaggcgccattgctgcggcggtgtgcgccgtgctgctgctgctggtcggcggcaatggcggcgggtggtcggcaatggcggcggccaccatggaggaggacaggatcgtggcgctgcctgggcagccgaacgtgagcttcgcgcagtactccggctacgtcacggtggacgccgccaggaggcgggagctcttctactacttcgccgaggccgagctggatccggccaccaagcccctcgtcctctggctcaatggaggtaaaattaaattaagctaataaatttatgtactgtacatttgtgcagtgtgcatgtagctgcattattggggggaggtgagattgctcgagcattcgagcaagaactgtgcaaggttgataatgtaatgtgggggaaaaaatgtgaaatcgagaaatgatagggagattagtttctgtgtgaatgagcctagagcaaaacatgtttaactttagttaattgagttaaaggaaagattttcttggtttgctgcaaaaatggggggagagagctttgtttttttttttgaattgtatttggtaattaagcttgtcaaatgaggaattctgtaaccagattctcattcaaagggagaattcgttcacaccggaattattggtggttaagattaactttttggtgcccatatgcaatgtgtagggcctggctgttcatcagtgggagtgggagcattctcagagaatgggccattcaggcctagtggcaatgtgctggtgaggaatgagtatagctggaacaaaggtgagaacttgtatgttgtaaaccacaatagagcaaactttttttcttttgtgccctcttttgctttctattgttcctttttttcgccgcgaaaagattgcgaggaacgaagaaaatttgaggcatctgttggatggtttttcagaggccaacatgctgtatttggagagccctgcaggagtgggcttctcctactccactgacccttccttctatggtggtgttggtgatagcaggacaggtgagttctatatatgcatttgccaaattatggctcaattttgcgcagagttagatttaacatttttgaggggcttttgaatttcttaagctagggacaacttgagattcttgcaaggctggtttgccaagtttccgcagtacaagggcagggacctgtacattacaggagagagctatgctggtaatttaaggccactccactgtattgtcttgttgctttgatcaattgtgaattttgttaattcattccctaacttgcactgtaagtgtttttcaggccactatgttccgcaattagcgcagcgcatggtcgaattcaacaagaaggagaagctgttcaatctgaaaggcattgctgtaagcaaatcaccacccccaccaagctacatttcactcaaaactcatgagatctgtcttggaattcctaattacaagatgttgtcatttggttcatcctgatcagctgggcaacccggtcctcgagttcgccaccgacttcaactcgagggccgagttcttctggtcgcacggcctcatctccgactcgacctaccactccttcacgacggtgtgcaactactcgcgctatgtgagcgagtactaccatggctcgcttagctcggcctgtgacactgtgatgacccaggtggccagggagactagccggtttgtcgacaagtacgacgtcaccctggacgtttgcgtctcgtcggtcttgatgcaatccaaatccctcgcccctcaggtgagagtacatggcatgcattttaattactgtgcaaaccgatgagttgcatgcgccaaccagttcagccaagagtttaagctgacaaggaaaagagaggcagttaaggcttgttgttttacatgttttttttttgtttttttggcgttgtaaggttgtcaaaatcgtgatcctgaatcagcaatcatagaatcgtttacatgaaaatcgtaaaattgttgattctacctatatagaatcgtggaatcaggcaccttaactaggatcgtaaagtcgtaaaatcgtatgacggaatcgagattctgacaacctattgtgcgtgttgcgcatttgcttttgcagcgagggagcagggagctggacgtgtgcgtggaggacgagacgatggggtacctgaaccggaaggacgtgcaggaggcgatgcacgcccgcctcgaaggcggcgtgcccaagtggacggtctgcagcaggtgcatttttcctcaaacttttatcagtaatccgcaatatgccgcattgctgctgctgctgctgctgcacttcagcaagctcactcagtagtcagtactgtgttgcattgcaagagaaattaagctaacattcagctctgcaatctgcatttgcctctgcttcagcaagctcactcagtactattgcattgctagagaaagctactccctctgttacaggttataagatcaaactgcttcaagtttgactaagcttataaacaaatatagtaatatttacatcatcaaattagtttttattaaattaataattagatatttattatttttccttattaatgtttttttttccttgaacaacaatgcacgtacatcgatgcagtgttctggagtacaagcagctggacctgcagatcccgaccatcaacatcgtcggcggcctcgtcaagtcgggcgtcccggtgctggtgtacagcggcgaccaggactcggtgatcccgctgacggggagcaggacggtggtgcagcggctggcggggtggctgcggctggggacgacggcggcggggtacagggtgtggttcgaagggcggcaggtgggcgggtggacgcagtcgttcggcggcggcgcgctgtcgttcgccacggtgaggggggcgtcgcacgaggcccccttctcccagcccgagcgctcgctcgtcctcttcgccgccttcctcgccggccgcccccttcccgactccttccagtgacgtcgtcccgaacgacgatgatcacgtctcatgtcaagcgcggaggtgcattgttgttgcgttgcaaatgcgtacgagcgatttcgtgtgcgccaccgctatatatagtactccgtattgttgctgggaatcgaattgtttctcggagaaaatctcatctggaaaatgctgatgtggggtggggaagatgactccatgccgggtttaccttgctctttagttcaaaatagaagtaactaacgtttgttacggagagtactccctccgtccaataaaaaaccaacctagcactagatgtgatgtattctagtactacaaatctagatatatctctgtacatattcattgtactagaatatgtcacatcgaatcctgattcgtttttttatttggacggagagagtatgctataagctcttgcagtttgggaagtgtgtgtttggcgaatgagggaaatttctcccagtctgcatccgctgaacacagcctgagcaggaattctaattttatccttttttttttctctttataatgaaaatcaatccccagcctcggcgtccagtacgtgtattctatatcatatactccctccctccatattttttatgacgtttcggacatcttggtgaaaattaaggaagcagtgatgttaccgttttacccttcccttccatcgctgcttttttcacgccgctgccgcttttcatccctacctctcgctcaggccgccgaggccctgcacggcacaacgctccctcaacgccggcttgctcgtcatctccccctcaccactgcatcggatgaccccggtcgacggtcgtggaagcggggcgaccatggaggacggcagggtgggcaagcgtagaaaagtttgtcactctatggaagaaggctgcacagagtggcggaggtagcggcggatggtcatctgatgcagcggcgccgttcccacaactgcctcggatgagcccccagttgtcttctctgtccccgaggttagtctttctctatcccacatgggcctcagttgaaatgcgatgaatttgaaatcttggtctaagatggtgtttgttggagtagataatgagcagatgacctcttcttttgaatctttcacaatgtcagcaccattagagtcgaatttttctttcgagaaatgttgtcaaatgacaactaagttcgtcaaagaacgtggttcacacttggttgaaagtaaaaacaaagcgtattaatattggatttttttagatccccattacatgctccttagggacaatttatagtattggtagtggtacaagctcatgcatcctaggattaataaatacagggaaatttacatggatacctttatgatagggacattttataaggacaactaaagtctatttggccacgggacccttagtgggccctaacatgagccttacttggtgaacatgcccttttaggctctctgtcctttgattccgatggcgaagatgccctggcttggtggcgaatccctcgtgcttcgcctagcggcttcgcccagggtaatcgccctggtcaccaatcagcacttcgcccccggcgtggttgtttcggcagtctcggtcgaaggctctcgtggcatgcctccaacagaaccactttgacaaaataaggattcacatgtgtttagattccctaatactgctgcttggtgttgctgctatctgctactaaatgatgttcctagctgctggaaaagctgctaattgatgttgtttgctgctgctatatgtgcctgctaaatgctttcatatttgcatttgttttcatatatgcatgatatgattcaaaattcagaagcaatatatttactccctgtttgtaggttagttattgttcacatttattttactcttttatgcaacataaatcttctagaatcctaaatattgttgctcctgcaggattactatctgttagagaattttatactatgtgccacctatactctccttccatcccttgcaattagatagctttttgcatgcaagttctagttgatgtgttcattttcagattaggaattcgttacacctgattccatttaattcacactttgaaattgccatagtttagtctaaggttgcttacagttaaatgatgtataaattggcaaggaattaactaactggttgagatggacagatggtctttatatgtggaggttctcaggtgcattttatttgcatatttgctcattaatagcgtgaatttctgcattttcagggtttctttatgcttctgaaattgaagacaatcgaaagttttgagaaactcccatataacaaaaaattggagtactccctggagtacttctcaaaactgactaaatgttgttgacacacaaattaaagtcagcatttcgctatcgccctggaaatttggaaaccgaatcccttggtcagctccagagagctgaaactgaaatggattctgatgacacccctgaataatcttccttgccaacctactccaagttacaaaaagttactatcaccgacataattccaagttacaaactcacttttcatgtccatggctctcaatccgtcactgttaccccaatcaacaccacgagacagtatcacaacctgaagcttcctaaattgaaacccaaccttgcatgattatgaatctctagcctctgaaaatgctattataattccgaagtccaattcctggaagaaaaaaaaaagaacttctagccgcgctcttcggttcaagttcccaacctcactctctcgtttaccgcgcacacgcttcccaaactgctaaacggtgcgtggtttgtaaaaagtttctatagaaaatttgatttaaaaaaatcatattaatctattttcgaagttttttaagctaataattaattgatcacgtactaatccatcgctccgttttccgtatcagaggtgtcacctaagaacacagccttaagggcctgttttgcacagctccagctccagctctaggagccaaacagtttcagctccatcaaaaaaaaagggagcgaagttggatggagctctctcatgttctgattctacacagtgatttgctctagctctagacggtgtccctgcagctgcaggttcaggtgaggcaaaccgtggaacgacttggagaggccgatcctgacggcccaggacggctggaccagggcccagcgtgaccggcccagcccatctcccctctttgactcctcttctccttctccactccatctttctctcttcggtatcctccacacctcgtcgccgatctcccaccccgcgcggcgccggcgcccgtccgtcctctcctctcctgcctccgccgcatcctcgcctcgcctcgccggtgaggaacccgtcgccgcacatccctctctctctctgtctctctctctctcgtctctctacctgcccggacctgtggaagattttttttcttttctctttggcgttaaacccctcctagatctggagcacttgagagttcctgctgtttcttggatccgtggaggccactactcctcctctcccgccttagcttttgtctcgtggatctgggatgggatgggggtggcttcttcacagccgagatccgtgtgccggatacgacggtgatcgaccgggacggtcagattgcatggttcttgggttcagtttctgtaaccaaatttgcgtggttctcgaaccaaagcttgtcgcggggggattcgcttcccgttcccacagagcgccaatcaaaaccgacgggatttattttaagcttttcccgattccggcttcgcccccgagttgtctcttgctcgcgtggtgttgtactacctccgcatagatgttaatgaatctaggcacacatatatgtctagattcattaacatatatatgaatgtgggtaatgttagaaagtcttataatatgaaacggaagaagtactaaatagcagtctgtttccaagacaatttgtgagtaaatttgcatttcaagtttttgcgccagtgtccggcagatcaggagctgtgtaaatttgcatcctcgcggctcttcaatccggtagctgccagcatttttcatgcgcctatacttgctgtaattctgaatgctagaggagcctcacttgttattgttatagtgttgaattctgaatgctagggcctcattatgtttttattgtagtgctgaaaaaggatctgattttgatacctagctactgaagatgtagtaaactttactggttacatgaagcacagattcagattaatcataagtaaagcaccagacctgttttaagagaatcgttggtaatcgtatttttgaactgctccatgtagaacacacaagattttgaggatgccgagggccacgagcgatgcgaagcttctaattcagtccctgggcaaggcttatgctgccacaccaacaaatctcaaggtattagttggctttttttttatctataagctgtcatcttaaactattggctaattactgatcatatttctgcagatcattgacctctatgtggtctttgcagtcgccactgcccttattcaggtaactcaatcaattaccaggacaccttgaaacatatattatctgcaaaatattttcatgctttcatgttggggatttttttctttgcaaaagcaaacatgagataaaaattaagtaggcaaccaaatgatagcttaacacgagggcggtacacagcagatgggcacgattaccctggaaatttgatgctttcctaatgctatataccgttttgtttgatggaaaacattcctatttgttggtgatagtgatatcgtatcacttattgttgacaaggatgatttgtcaacacagaaatttcttccacttttttatgcagagaaatatgttctagttcatcatctagcttacattttttttcatatatatatgcagctgttatggattactgttgtttgggttgatagacaagcacatgacctgtatttttttaatatgatgttactgtgtaatagagggtcagtcaatattcttaaagcttggtgcaattttttattaagctcctaatttactgagtgaacataagtttctgttcagttcacaagtcccttcttccatcactgttgcaaactagttggtatcagccttgttatgcttacagttccatttgcaaactattgaaatgctctcctctgacaaaacaggttgtttacatgggaatagtggggtcatttcctttcaactctttcctttctggcgtcctctcatgcataggaactgcagtcctcgctggtagggatttcttaaccccttctcaattccggttaccctttttcggttgtacgatacataactgtcaatgtttcgtgcagtttgccttcgtattcaagttaacaaagataacaaggaattcaaggtaactctactttcaccttagtctgttggggccattaattcttgagattctggcgtaacgtcgcatgccaaaacactatctgcaggatcttcctcctgaaagggcgtttgcagatttcgttctgtgcaatctggtgctccacttggtgatcatgaacttccttggttgatgtcctgcccctacaactgatcaaggttttgtagccccagtttatggtcactggtcagaacaccctgatgtttgggagtgtcatagtatgagatattcatatgatctttcacacttcaccgatgtaattcgacaatttttcgagaaactataagttctctacctgccgttcgctgcggcttatctttatatctgtgtatttagtgtttaacaatcttagaacatgtgatcctgttttcttcaagtgaccgaaggttggcaacatgctattcgaccatgctgttaactgttgtttgtcctttgttccaacgttgcctacgcatggattttacaggattttaaaatccctccattccaaaggaagaaatttgattgcactactgcaattcaaaacatttcttgcacttgcgcaatcccagtgacccacatgtaatcagaagaagtggagtatgcattgttctggttgtactcaacgagtgtttgccatccaaattatgtcgctagtattagtagtagcatatgtcgtgcacgctaggcagaaaactgaatactaccatgtgctgccttggtgagtttataaaaatcaccatttcatccaagaacacaaagctatcgtttccctcgcaaaaccaaaacgaagaaaaaaaaaacagaaaacctgaaatatctggcaggaccgactgccaggccaccatgccttcaaatggtaaacgaaatcgaaatgacaaacgagaacagtcattaaaaaacattccaattttccacccttggttgatctggcaacagtcactagtaaagttgcaactgacaattgacaaaccaaacaaaaatcactcttatttcagatcattatatattaatgctgctgggtggccaggatgccgtagcatttacctacacttcaaagtaagttacagccatgtgtaaaaagtattggaagccatctggtgcgaagtaatgtacaggtacaacagtgcagcgtttatcttactgctaccaaaagaataaatacacgtacttgaaggagtaaagcttctgacatccttttaaaaataaaagcaactcaagatctagcatacagtttgtttgctaaatgcatctctgttgattcatttccataacattcctactgcctctgttggaaaaaaagaggaaaagtgaaagcacctaaatgaagggagaatttatgccatctagttttaccatcatgagcgccccagctgagagaagagaaaaggccataattccagaacgacgatattatccttcaattagacactcagagcaggtgccagtggttccggaacaccactaccaccgttaagaactatcaccttgccctctgaatccacatcaacaatagcagagtcaccttccttgacctcgccagccaacatcttctccgccaagctgtcctccagaagcctcataatagcacgccgcagaggcctggcaccatagcttgggttgtaaccttcgtcgacaactctatcccggaacttctctgtcacctggaggtcgatgtcctttgccttgagcctgtcaaacacttctttgagcataatatcagcaatctccttaacctccagcttggtaagctgccggaacacaatcatctcgtccaatctgtttaagaactcaggtcggaagtactgcttcagctcttcagtcaccaagctcttaatcctattgtagctggtgtctttctcatcatagtcaaggtcaaatccaatcttccgtcctcccttctcaatgacactgcttccaacatttgatgtcatgatcaacagtgtgttcttgaaatcaacagtccgacccttgctgtcagttagtcttccatcttctaagatctgaagcatcatgttgaagacatcaggatgtgccttttcaatctcatcgaagagaacaacagtgtatggtcggcggcgaactgcttctgtcagttgaccaccctcagtgtaaccaacataacctggaggtgatccaatgagcttggagactgtatgcctctccatgaactcactcatgtctagtctgatcatggcctcttctgagccaaagtagtaggctgcaagagcctttgctaactctgatttaccgacaccagttggtccagagaagatgaagctagcaataggccgatttgggttcttgaggccaacacgagcacggcggatggcacggctaatagctttgacagcctcatcctgaccaatgatacgcgtatggagtgtctcctccatcttaaggagacggtcagactcatcagatgagactttctccacaggtattccagtccaagaggacacgatatgctgaatatctgcctcagtaacaaggggaccgacttcaccggattcagtctctgctttaaccatttccttgctcttgtcaataatggctgtaatttgggccttcaattccatttcccgatctcttaattccccagcctgtcaagatataacaatgatgagatagcatgaaacaaaatttggaagcaatagagttgattcaaaattgatgctaagtacctacattctagttgcacaagaatgaaggaataaaaggatggcttatagctatgatttagagtcactgggcaactttacaacacaaagtgcaaaaagccaaatcaactcaataggtttacaagtaaatagcagtgccagtaatatttactataaaagatcatttaagaactttatatgatttctgcaagaagtctatataccttttcaaaatcttggccacgtacagcctcgttcttgtctttggttacctgtcgaagctctttgtccagctccttggcttcatcagggagctgcaacataaaggaatcatgtctttagacagaaataatacagtgaatgagactgcaacatagaataatacaatgtagtacctgtgcatgcctgagcctaacacgagatcctgcttcatcaatcaagtcaatagccttatcaggcaggaagcgatcactgaagaaagaaagtaaaataagtttattagattgaaaatcaaatgattatatgtcaactgctgagaatttaaatcccatccaaaagttctgcaaaattaggggcatgtttggtgcacaccctaacattgccacacatgcgtgccaaaggtgtggctaacaaatcaatggcaacaattaggcaaggttttgcaaaaaaagagaaaaaaaaggagtgcatgatatttggatcctagggttaaaaaattgtggcatagcgcaaatgtggcaatgaaacaaacaatagcctcatgatagtttggcaaagtgtggtagtgaaccaaacacccactagatatttttatttgcaaacttataaccatatatcctttctagtccagaaatctgaaatggatccaagtcaatctttatgttgttcagcttcaaatagatcactgatatttaatttgcttccaggaagggatcctaaacagcatcatgcacagaatataaaatatattttatcttccaaggcattttgacagtctaacagataaagggtgaaagtcagtaagtactatcgtagtactcaagagttcacaggacactactcctggaccattaaacaatgcgcttacctgtgcaagcacctagttaccatttcagaaataagtatatgcttctcttcagaaaaaaaaaacagatatgtaaaagactaaacatccctatgcacaagagaaatatagtacggttaaaaatgatgccaattaacaagaataggtatgaattgatatagccacagtaaaggccaaaaattaataaagatgaaacatattagctaagaatgtgctgcatagcaaacctgatatactggtatgacaattgtgctgcagcaattaaagaatcatctgtgtatcgcagcttatgatgcagttcatatcgctcacgaagtcctcttaagatttgtattgtttcatcaacagttggctctggaaccttaactggttgaaaccgtcgctctaaagctggatctttctcaatatgtttcctgtactcatcaagtgttgtggcaccaatgcactgaagacagaagcataagaaatgtggtgaattaggggcaaaaacaggtaacaatcatatattgttcatggataacatgcaaagtggacaaattagtctctggagtcaagaggctttgaggcattctccggattaaaactataaatatgataaaaacataatcatggaagcaacagattcaaaattaggcacatatacctgcagttcacctctagcaagagctggtttcaagatgttggcagcatcaattgcaccttcagcagcacctgctccaattagcgtgtgcacttcatcaataaagagaataatgtcatcattttgtttgatttcctccataagtttcttcagtctttcttcgaactctccacggtacttggtaccagcaacaaggagccccatgtcaagagtaataacctaaccgagtaaaataccaatcagtattctgaaacaatactatgataattagaaagagaagcttcacaccactcaaaatcttataaattgtgcaagtctcattcaaatcagacgatagccttgagtcctcactggtcaggacacaataccaatgcaacaacattagttgcatcagtacacgatatcgagtgaaaagttgaattcacaattacatctggacaatgtactagagaaagctatccagaaagctagtattattcgtaaatgcaaacttatactataattacttgtctagttaatgaaattagcgagtttacccaaaagggtgataaaccctggaaaaagtgtcagcatgatggtactcatttgcatgcatatatgcaaaacaatggtgatgcacaggtgacaggatggtctaagctaaccttctttccttcaattgtttctggaacgtcaccattggaaatacgttgtgcaagcccctcagcaatagcagtctttccaacaccaggttctccaattaggcaagggttgttctttgtccgccttcccaaaatttgagttacacgctcaatttgatcctgcctgccaacaactgggtctagtttaccctgcagatgaaaatgattagtttcttgtctttgcttatttatctacgcaatagagaatgcacaaacaagtctgataaaatacctcttctgccagcttagtcaaattagtgccatactcttcgagtgtaggcatcttctggccactgcttccgccaccaactccagcaccaacagcttctgtgctttcaccaaccattcttatgacctgaacatcatatcaaatgtcattccctgcataattttaactgaaagtagattggctaagatttaaggaacataatagtaaagctatttacctgggtacgaatgttgtttggatcagcaccaagactttccagtacccgtgctgctacaccttcaccctcacgaagtagccccagaagtaagtgctcagatcctatatagttatgccctgaacaataaaaaatgatgaatattagacaaaagaccatgcatatttttctaaataactagtctcacaaggcatagattcaaaactcaaatgtgaatactttcttgaccttagcatcaagtcaacaacaatgccattgttaccttttcactttttttggcatacttgttgtacagtataagtgtaataatatgcatattaataatttagtaaacagtgccagatctgatgcatattaataagacctctagcatcattctaaaccagtaattattcataggagaaagaaagcatatttgtacatgattagcgattaacccaccacatgcagattctcaaccaatttagcactattattttgcatacttaatgtgaagtacgaaaattgagagcaggataatagcaatatgaaaccaaagcacatgctggtttgattggaaactagaggtatgtaagcaatatttcaggacaaaaaatgctataaggaaagaattaaagtgtccaattataaccaaatgaaactagctgaatctttgaacaaagagaggttatacctagctggcgagcttcttcaagtgacagttccaagacacgctttgcacgaggcgtgaatgggatctcaacagccacaaacccgctaccacgtccaatgatcttctcaacttccacacgggcatccttaaggttgatacccatagacttgagaacctttgccgcgattcctgtgccctcaccgataaggcccagtagaatttgctccgtcccaacaaagttgtggcccaggcgcctcgcttcttcctgtgcaagcatgatcaccttgattgccttctccgtgaagcgctcaaacatggcgcggaccacccctcttgaccccaaccctcgggggcgtgaaatctggctcgcgacaatagagccgaagtcacgcttaatcaccgacctcgagtccaggaaattcgtctgccgcaggccctggaaaccccccagggtgagggtccgtgttggcatggtacgcatcatcgtggccctcgcgcgcacgcggaaccgcgcggtgccgctcctcctgtatatggtcggagcaatcgcggactggactagcgacccctccataccgacctaccccaaaaggaaaaccccgagccacctgcccaccaatccaatccctgcaaaatcaccaaaatcgatcaaggtcaaacacataaccaaaatgaaactaagagaacaacactttctcccacggcctacatggcggtgagaatgattcacaagccatccgcgcatcgccgcaacgagaaaacctaacgttcccttccccccacaacggaagaagacctcacgtccaaaactccaaatcattatatacataataagaaaaaacaaaaatcggagcacacgtcgcctcgaaatggctccgctgccatttctccgacgagaccacagctctccccctccgcatcacgcgcggattcgattcgaggcacctcccatccacccggccgtccgggccggcggacgcctcccgttacccacccccctacatcgaccacgcgcccgcggcggccaccccatcccacatgctcgccggagtcaacccgagaaaccacccacccccaccccacccaaacagataaggccggcacccacaagcccggaccgcggccggaggaagagagagagagagagagagaacgcgagggctcacctggccggacctcaaccgcggcggcgacgagggggcggccaccaaccctagcagcgcggggggagggggggacggggacgcggaggcggcggaggaggaggaggaggagatgggagaggaggaaggggagacgcacccacgcgaggggaggagataagaagaggagagagaggagaggagagagccgcctcgactgacctgacccctccccacctctgcacgttatctccaaatataccggctttcccttttttttttcttttcctccttttatctttaccttttattttttacttttacttttgtttttttttctttactctatgcgggcctacgaccaaggcccgttggcccgttcatttgtgcggtgggccggcccacctcgtcaactaactatttcaacaaggaataagttcaccggaggtccctcaacttaacagcgagatttttttgagatcccttaaccacaaaaccagaaatcttcacccctaaactatacaagactgttcactcaaggtccctaggcagtatatatgggcggtttcgctgacgtggcaacctagtcagcaaaaaaaaattaaaaagtacgtgggacccacatgttagctgtacctttttttttcttctcttttcttctccttctcttctcttttctatcttctctccttctcttattcagtgagggaggccggcggcaggcggagcagcgcgcagatgcgggtggcgcagcagagggcgagcgcggtagcggagcggcgggtgtgagcgcgagcgcggcgacgggcgagagcggccgcgggcagagaagcagagggcgagtgcggcagcgaagaggcgatgggcgagcgcggcgacgggtggagcagcagagcggtggtgggcgagcacggaggcgcatccaccccaccccagccaaccaaagcacgccctttgccctcggccgtaagcctcaccgccaagtcgctgtcctccccgtcgccatcgaccggcaacgacgacttcgcggcgctcctcgacacggagctcgagctcacctccgtcgctgactcggcctccgccagagacccctccgccactagcgacgactacaaggaagacccctcccagccttccctccttcctcctcgagctccctcgcgccggcgccaccgccagggacgggaagccgacagtgatggccgtcgtagtcagctcgcttgccgcggcaacgctggtcccggcgctaaccggctgatgcgtctgcggatcgatgccctggctcaagagcttgcgcttgatgtgcgtgttccacctgcagaaccaatcaatcagcaccaagaacacaagaagagctaaccggagcagatgacaacacgttgaaatttgttttgcttacttgttgccaagaagggcgtggagcttgatggtgagctcgtcgtcgtcgtcggtgaagttgccgcgcttgaggtcggggctgaggtagttcatccagtggaggcagcagctctttcggcagcggagcagccccaccgccttggggagggagagagggtcgatggggagagcgcgccgcttgtcggcaggcggcggcggggcccgtggtcgagcacccggcgcgttagaacatctccaccaccgagctcgccgtcgcgccggccgccacctctcctcctctcccgccgccgctatcacgtcgaccgtctctctctccctctcccgctgccggccacctctctccccctctgtcactgcgcctactcaagacttgagagaactcggagagaagagaagagaaaaagaaaaaaaaaagaaatgcggaacccacaccattgtctcacttacatgtagaccccacatatttattttattttattttattgctgactatgatgccacgttagcaaaaccacccatatatactacctagggaccttgagtgaacggtttcgtataatttaggggtggagatttctggttttgtggttaagggacctcaaaaaatctcgatgtaaagttgagggacagccggtgaacttattcctttcaacaaaactgtacaatcctgtccagcaatgtgtcatatccaatcacaatccctcatattttaagataaaataattacttctataaattaaagttattattatagagaactgcaactgataatccctccgtttcatatcgtttcatattgtaagactttctagcattgtctatattcatataaatgttaatgaatctcgacaatatctatatgatatatgaatgtgaataatgctagaaagtcttatattctgaaatggagaaagtattatcggaatattgcaagctttggttgtcttgtaaaattaggcctaacatgtactacatatatttgtagtactcatggtttgtcaagttggacccacatgtcatatgtacatagcgcataaaaagttacagttttctgataaatgttttttttctattgttgcaattttgtgaaaaatataaagttaacgttgtggttaagtgatagttttgtttaaataattgcagttttctctgaaatttactgttgcttgttttaactccatgcgggcctaggaccaaagcccatggcccattcaattgtgcggtgggccggccatatcgtcaccgactcggaggcccactccgagcgcgaggcgaaccgcctccaacctgcgcggctcaaataccgaccatctcccaacccaacccaaacccttgtacaaatccaaacgaggcgaggcgaaccttcgagaagcttcgagaaggttgtggttgaggtcgaggaggggaggggggggagatggcggcgggaggtggtgggggaggaggaggaggaggaggggaggggttcgaggagcgggtgaagcggctgttcgggtcgaggctgttcgacgacgtgccggggtcgtccttcccggcggcgtcgtggtcggtggcggccggggacgtggagcggcggcggtgggcgaagccgtcggaggcccgcgacgaggaggaggcgagggagggggccgacgccgccgaccgcggggacacgccctgcgcctccgcgttctacgacgacaacgggtgcctccgcgcggggacgcggcggcggcggcggagtaagcaggaggagttcgagggcgacctcgatgaagaagacgaggaggaggaggaggaggagaaggagaggggtggcggcggcggcaagcagcagcaggaggaggacgaggaggagggggttagggtttccatcggcctcgacccgactctggatcgagaggtgagagggttaaaaatcactttggctcttcttgtttatttgtttattttattcattaatccacacgattagtagttcaactttaccatttcattagtctagactagattagggcgtggattaggaggggatcaactgcttgttttgttatgttcatatagtctatgagttcacacaattgaaacatttcaactgtaggtttgttcatcggttctcttagccacgttcatttctaatggagaattagagatgattgggggggtattgtagccatggcctgatcttttattcatgctaaattttgcctgtgctgttgttgcgctggggttgtgtcaagtgaaactctgcagctgaatctgatataacaaataatatagtcgtcgtttcaaagggaacacctttttattttcttcactacttaagttctaatatgagctgtaaagaaagttactacatccatacatttagtcagtatgtggcctgacttaatggagcgctaaattgctcaaaccagattctggatgagaattttctttttgccggttacagtttgttattgtggagtgttatatctaacaagatttttatccttcaggaagaagaggacaagtatgacagagaggcatttggtagagaggatgcttttgaccgtgtatacatgaatgaaatcatggatgatggcattaacatgagcatcaacactgtggtgcctgacatccttgatgattccgttgaggagatccaccgcttctcaagggatcccagagcagatatgggtgcggcatccgcaagactcaaggagtacgatagttcagctaaaggtggcacgtgttctctagctcagccaaatgaattcccaagtggcaggatacaagcaatgaaaaccgatgatgctaacgtgaaacctatactgaagcggaaggaggagcaaggcgattcaaagccaaggaaacgtgtcaagtttgctgctgatgttaaggaccaatcggcagagctgcctgaacaggatgaagattctcccatggttcctcaatccatggatttggtcatagggaaggactcatccactccatctgagtctcctggggttcctgactatgttaagaaccctgcaaagtatacacgttacactctggacactccagaatgtaacgatgaaactaacaggagagcttttgccgacctgcatgatatattaaggagaatggaaccagagcctgaggcaccaccagttgagatacctacttcagttacgttcatcccacggaagaagacaatcgatgcaatgacagtagatgagggtcccaaatccaatgatgcaaactcatctctcattggtctggcggcaggtgcctctgatgaaactgagcaatgcgaaatggatgaagatgatcctaaagcattgttaccgccacaggtccaaaccaacacgaagatgaactcccgtcgttacagatcaagtagaactgatgatgagtaaaattgacggtacccttgtctcttcagtttaatgttgtaatacaatctacaaatttgaggttccaatgttggagtagttgctatgcaagttgaggagatatgttgatgtacttttgctttgatcttctgatctgagctaaccagttataattctactgtggtacttattgtttaattaatcttgtactgggagctactgtggtcctgtggatgttgatgtaaacttttactggtaagctgactttactgaatcatctctttctttctcatgtcaaaaatagtggtttctatcgctatcagttcttcactatacattcagaaaacaactttaacagttacagagaaacctaatgagactgcaggtatgcacttgcaggtgacctcacttcctcagaaccaagatccatcttaaaacacaatgttaggtcatcgtatgtacagataaaaaagatcgtttaaatgctgttggctcatacatctcccaagagaaaaaaacagctcattttcttcttcagaaccaatggcaagagagagaaactgaattgcaaaagaaccctatatcaatctgtacattctgaatataaccccatgcattttccttctttttcttctttcagggagtaatgaattatttaccgagctcaagacatctacagtggcggctacatcttatcagcgattctgtatagggcatcagccaccttgccaagcacaccaagtaggctgctcacttggtccttcctctgctccctgtccagttggcagttgatgttctgcgcctccagctgggctgcaaccatccggctgctccggtctaggatttcgatcagctgcccctgcagatcaggagcttctcctgaggcgtcgtcgctgcgctgcctcttgtgcgcgccctgagctggtgagtcctcgacaatttgttccggttgcttggctctggacgtccccgctgtcaagaaatttagatggttagataaatgcagtttttctgactttgttgcatgaatgtgcaaagttctagcatcaaaggggctttcaatgtttcaattcaagataaacacaatttccctttttataaaagaaaaaaaaaggctactataacttttgtttcttctcatgaggtgatcctgaagtttaatactcctgctgtgtatcctactgctgttgatttatgtttttgttgcatattagactatacaagtatctctgaaacacacaagtaaaaactagcgaggaacaggtcgctgatcatgtttattcagtactgtatcaagtagggaagatagcataatgtaatatggaaaggtgaagtgaacaggataaatgcagtgaaataattatacttcttccattcatttctttatcacaatacttgaaaagaagctttccaccttgctgggcaaaagttaatgatggaatatccactgccctcatacaatttctgaaaaaagggtcactatgcgctgaatgatacaatcagttcgctggtactaataacaaaaggctcctagtctgcatcttttgcattttgggcatttattctgaaccagcactgcgtgaaactgagtgtttctcggaatgtcgcaaacctgctaaaatttgatgcttcacatgtatgttaataaattcaacagacaaactttacgatcgaatctgttgactgccaatttattcattttgttgtcaaatgaagacaagccacaattgctgcctgtgattaattagtagaaatatgtttgtgctttcacccaaggtccttgggtcctagattgcttcatatattcgggactgtattgtaagcaaagtcagatacagttctctcatagaacaatttgacaagggcacaacacacgcgtttaaggtataatttgatttgatcttttagggatgataattaccattgagttctctttttgtgttcaggctccctacaattctgttattagttaatttctattttcatatctaaactatacgcagtgacacaatgtttaaatattgctgccaagaattatctgatcaaagcaatggaacagtaaaaaattgtggaagatcaggggatgctgaagcacatgcaaaacgtgagcggggaaaaaaaaggggagaactgcaaggtagaaatccggttatttatcagtaccttgctctgaggcatcttgcctaggtggatcactcttcttctctgcaaccaacaaaccacaggagcaaaaacagtaatcagccaaccaaaaacaaacctttgccaggtgaaaataaacatattgatcactttttttttaaaaaaaaacagaagaaacagaatatccattaggttagcaacaaagaccaaaaacacaactacttgcaaattccaactcttcagagttcagaccaccacaaagaactgaacaagaaattttctgaaaaaggaagatgggcatcaagccatcaagtgattgaactcacagggaaattcgatgcataacatgaactgttaccataaaaaaaagaacagttgttttgcaatcgaaacgtcaatttttataggcaactaacccacccatcacacaccccaaattcagttctttgaagtacacaaattcgcagccttcttcttcttctttttgtcaaccaagaacacaggaaagcctcaatttttacgtgcaagaatggagcagccgcgctcaccggatgtcaggacgggcaccgccggcgccggagccggaggtggggccggggcagcggccggggtggtcgccggcggggtcgcctcgtcgtcgtcctcctcttcctccgacgacgagaagagcccatcatccccgccgccgccgccgccgccggccgcggcgcggccgctgtcgaacaccgccgccttctcctcctccccctccttccccgccgccgccgccgccgacgcattaccgccgccgcggccctcgaggatgtcgtacacctcccggtcgaagaaccccggcagccgccgctcccgccgcgcgtcgttgcgcatcgcccagaacgacaccttcttccccatccccgccgccgccgacgacgacgacggcgacgacagcgagcgctcccactccctgatcttcttgtagtcgccggcgaggttgctccaccgcttccggcactgcacggggccccgctccagcccgtgccgccggcagtacttcgccaccgacggccacttggtcggctccgcggcggcgccgncgncgncgncgncccgnccnctnccccctccctcgcccctccaccacccgcttcccctctatcagcaccagtatctcctgcctcgtccacctcggcagccgcggcgccctccccgacacctcgccgccgccagacatcgcgccgccgggagacctcgtcgaggagagagaggaaggaggggaggggcaggaagcaacagggataggaagaagaagaagaagaagaagaagaagaggaggaagaaagggtgtggcttaacacattaggagggagtggccttaattatgactagaacaacacaagattatgcctttagttaagccttaattaagaggattagtgggtggtctctctctctctttctctctacttgtctttctcctcttcccaaagagggaggaaaaggaaagagtggttgagggaggattaacaaggggaggcttaattagtcactagggtgtgtgtgtgtgattagaggaggactaaactagtttaggagagagtattaactaactattaatattaagtagtgggtgtggatgggggagggggctccaatgagagtagccacctactgttttcagttctcagcaagagggaagaagatagagcactgttgtgatatgatatgcatcactttttctacccccttgatgtgcttgttaattctaaataaggaggggaataggaatattggcatttggtgtggactaggaaaaaactttagtggtgagcaagagcaagcacagtttgacacttttttggtgctttctgtccatgatatctttgcaaggaaaatccttttcttttcaagaaagaaataaaaaaatcttttacatgcaaaaggagaagaaaaaaacactggagaatagcacagctgaatcatctttctgtttattttcttctggaaattcacattggcttttgcttgctgtgtgacagggacctattaagggcaggcactggagcagaaaggagggatctttggtcggcaatggccgtatgggcatggtgtttgagacgcggaaggcactactgtgtatgaaggcaactggccatgtagagtttcagttaaggcacttcgtttcttgcacaactggggattgtggccaaccaggtatgtgtgcattgccgctcctgggtcgcattcctgtccaggtctgtgtcagccaccccatccaggtcccaaccatgaattggattaaccggataaggcctctttgaaacgcgggatctttttctatgtttctatgaaattcatgcacgtgttgcaaattaggtcctaaaatgttgtaattatcgcaccacacggtttagagtctagtttttttttttggaaaaaacataatgatcattttgccaagttcttttgtaggatatttcccgtattctatatcattttacactcagactatattggtgagaaatctagaaagacatgtctccctaaattatcattatttgtttcatgtgagaaaaatatcttctttttctacactaacatcaagatgtccaacttggttcatggtttttgccaaccttccaccattgagagtacatgcatgtaaatttgatgaatgacacatgaaaaacttaggtagtcacagactcacagttgttgcatggtggagcatgataactgataagaccctatttaggattatttatcttcaccaccgaggattgtataattcgaccttcattgcaaaacatttaagtctaggaaatcttcaatacaaagtatttctagtgaaaaggttatgataatagaattcacgctttcgcttttcttgtgaagaacttctaatatcttgtgcttatgctcgatgggaaaatagaaatcatatcgtatgagaatcatgaagggaactactatgatatattgttcaaacttagatcggacgaataggtttttatgcacacgcaggatcatttctttttttcttttttttttcaatcagggacctgccaatatgaactgacaccgaaaggcttaagggcaaggaaatgctcaactggaggagattattgttgctaactagtcatcgttcgaacttaaacagaataatgataacacaagcataattatcagtagatgatggtatcgcatcattggatatgaacaacggggaggggagttttaatttctttttgtgtgttcctatcaaaaaaattggttttgctgagctctcttgcttcgattttgccccatcaaatcgatttcaagccaggccccggtttttgcaggcaagattgtgtgaaggacactctctcaaaaaagcaatgatttaatgaggatgggacggaggggcaagaaacgtctatttccaccttttggccctccaatatatatttcaacaaatatatcctttgcttaaggtacttttgacaattttttttagtgattggtcttataaattttgcatgtctttttagtttttagtggttggttgtaggtcaagatgtgctacagtgatgtaagatactccctctcttattaatttgatgttgttttatttttagatccttgagttggcattgataattcactcaagtaatttcacatcacttgaatttatagcacccatagattttgataagtcatccatattcgactttcatagtttaggatattgtttcaccatacaaactctaaaatgtcaaatagtagaaaagaagtccccatgtggattgcttgctggtacaacacaaggttcaccatatttaatttggttgcaaatattctctaaaaaggaccatgaagttgatatattgtcccatataaatttacctacatgtcctattagataggatggattgagatcagacgggagggaggaacgtggtgcgcggtatctagatgatataggtctgactagcatgaggactcccaacatttgttacttcttctagtgtaactttcatgtcaacctctctgttgggaccctaacttctcctttgtgatggccaaaggggtcactgccctttcagccacaagaagagattgcaacccctgtggtgtggataggtggatggatgcttacatttcccattggaaggaccatgactggtgactggatagatggggttgagattggcctctcatgcaatgccctataggattctggtagggcctcaatctttgagaggatatgttgttgattggtggtgcctccctactctcctagtgtttttttttggcgctgctatatattttgataattcgctgatgggtaaggttttttcaaagttgtggataggccaatgactttctagttaggaggttgtttaacctcccttccctactcatggctacttcaaccactgtttgatggatgctagagatcttagcaattttcagaatatattagaaagtgttaaagtcaagcctacatatttatttatcaaattttatataataggtgtcatacatacatagatatgttttagccacattggataacattgggtagtcttcattttccccttatgtattagcaggaaaaaaatattttagcgtttggtacaatctccaatatgacccatcactccatcaccttctgttgttgtggatgtgtagctgtgtaaaaaaaagtataaattattaagtattaaaaaatattttatgacaaatctagctataccatttccaggagaccaaatctaaacatacaccctgcatcaaaggggctttccttgatatgtgtacttgttcttgtattgtcatgatgtggtgaactgtcatttctctacaatttcttcttattcccttaggcatggctagcatttactaaaggctagctagttgtaacacagaaaattgtattacctgaagaaagcaatatcacacaaaaggttttgtaggaaataaaaacagttgggtgtgttagtgcgtactgtggtgtgtccactgtggaggcatttgattcctagctctcctccataattaggatataaatcctaggtcatggggggatcaccctctctgtaccccacaaccccacaacaaaagtgccttgcattaccatagtcatcgacaacatcagggagatttggcatatcaattgtagggtcaacttacacaatcttctttcaatatgttctctcgaattttgtacaaaattgtcaattaggaattttgcagataagaagggatgacggtgggtgaggacgtgtctaaagagcaattgtagccccctttcgaaaagctaaattattttgtggttcctaagaaaattttattggagaacgaatttggaaacacaaaccaaacaagccaggtatatgaaaaatatttgttttcacagaaatatatgcagaactattacttcctccacttctggtcataaaaacatatcgtggtggacatcaatgtttatgtaaaatggttcattgacaactaatttatgtagtactaatatatatatttgtaaaaacccaacaatactacaaaagtagctttcgagacatatatatgcatatattctttatatttctgatccaaaaatatatttcaaaacaattaattctcatatgccaaacataactagtacatgttttgtgacataggaatccctagtacatatttttgtgacacaggaatccctagtacagatgtggccacatgacacagatagcacataacttttagtatgtgtcccaacaactaccagagatgcatgctctgcccatcaccgtggaaatgacaatcaaaatcctaataccacactaacacatacttatgttttccattgcaattggtgcacaactcccttttctctaggccaaagagaaagaagaaacagcataggccaactaaacaataacagtatcccttcgtctttttcttcctttcatggatgggtatattgttgcctccctttcaaagtgcaggaaagcaatcctatccatttgcactcatatgtgaaattaaaatagaaattggcaccactgctgtggtgcaagaaaaagccatataccggctctctgacgacgacatgacactgcccttgtgtaaggctgatggcttgctgatggtcatattgctagtgtcctaataacaatgattatatgtgtgaagttgttaaccagttattagtactaaaacttgcaaaagaagctgggtgtacatgatacaaaattcagatggggctcacatgatcaaagacagacagctagggaggaaaggattagagaaggtcttgcactctaggggcaatcaggctgaaataataatatgatgttgatgatgataggtacacctgaggcctacagttaaagggcttaaatgaaatatatgcttatgggtgtgcccttatttcttttccatgattctttccgagtggctttcggttgcaatgatcccttcttttcttatatatgtcttaaagaattgtgttattctctacccataaaaggaaatttccttgggggttattttgactgatcttgaaaaaaaaagttcatttatacataaatctgcaaagcgacaagtggatttattgggaacaaagtgtagcaaccagggtttaccaaccccaaaaccggcgatccaaaaccagcggtcggcagtttccatccggtaaaatctggtcaaatttcataaaaagattaatttcagtttgatcttttctcaatttgattgaagaaccgagtgggttgtattattaagccagtctgggaaatcgattttgcgaagatggaactggtttttgtcggttttgtaaaccctggtaacgactaataacaccatgttcggcttataatcatcccttaattccccaccacttaatatgagccctcaaaaaacattctggggcacttagaacaaactttggacattcacttatgacaagaacacttatcattaggtttttcttttttcttccactgactgaagctaagaacaaaatctaagcacacatggacaagcagcgaccaaagttctgcacgttgtgacagggcttcactttgttatactctatgcttttaaccagagcatgctacaatcgcagtgtgctttcttgttcgatcgttaatttcctgatgcagatttgcagagttcttgctggtctcaccgtctcgtttctggcttcttttcaccattccctgttcatcttcatcttcaggaatcaggacagacagctaactacaaaaacttctgcagtgcttgaagttgatgttttttttagctttaccagattgtttttcaggtaatcatagatacatgaactaaattaagtaagcgtcagctgatcagcttatggcctcgtggagaaggctatgtttctttcagcttgggattattataatctagattattaaatcagattactataagctagattgttataatctatagtagaataagcggttagttgtttctttcctagattattagagcatagattattgggtttgtaagtctaaagagggagtggggtggcatgatgggtaatttttcatccaataatctggaaaaagctcacctaaggccctgtttgattcagcttaagattactgtaatttagattatagaactacattactataagctggattataataagccgacatagaataaaatgctagctatttgtttctctagattatcatctgtttgttagttgttagccacccaataatctaaaaaagcacctttagagtggcttatcagattatagtaatctggcttatagattataataatctatgacaataagctatttgtttgtttcagcttactcctaataatccagattgtaataatcccaagctgaatcaaatagggtctaaatgagcttatcagattataataagctgggctctagattataataagctaattcaataagttgtttgtttctttcagctttaccagattgtttttcaggtaatcatagatacataaactaaattaagtaagcgtcagctgatccagaagtagagaagatttagctgagtaacagagcaagatactggagtgataccagattcagaaccgaaactctacaccactaaaaagcaaaggatttttttttttaaaaaaagaaggaacaactaagtgccaaagtgatgatggttaactcaagtactccctccatactcacaaagaaagtcgtttaagatagcgatacggtcttcaaaacacaaatttgacttcttgtttctataaaaatatttattgaaaagtgatatatgtatacttttatgaaagtattttttaagacaaatctatacatataatttttatattttcaaactcaacaacttgagagttatttataatttatattctcaaggtttgacttaaacattatcctaaacgactttctttatgagtacggagggagtaccagcaaactgtcagttcaaagcacaagtagcaacagtattgaagctctggaattcaaagtttgttgctagctgcgagctgtaactttcgaccagatcactgttgccaagccatgcatggacccacatatctattatacattaattttgataatttgatcctttgcaaaaactaattttacaaataaaccaccgccaaaacttatttcaaaagtgatattttttttcagcgccaaatcgtgtggcgctgaatttagacacctcagcgccacgtcacctggcactgaatgccgtgccaccgtggatggaaagctgagtcaacgtgacaacgtacattcagcgccacgctatttagcgctgaggtgtctaagtttagcgccatacaatttaatgctgaacaaaagggtcatttttaaaataagttttggcggcggtttatttgtaaaattagtttttgcaaagggtcaaattgtcaaaattaatgtctattataacgattgcagggtgctgatcctaacatgttattgggccacgtggcttcctataaatgaagcttcacctctctgtaaatctgccgcatgtctccttgctctcctcctgctacacctcccgcatcatttcatcgagaacctacgcgcaaatgctgattagcacccgttatcctcacggttgtagagtttttatgaggtcgggttcacttttaggaaactgtgagattagcttttccacggggtgaggcccacgtctcttggacgatgcatgatgcatgatttaaaataatgttaaaaaaacaaatactcaatgactcaattggtacaaccacggtgcacatacatttccgtacgcctttttcacagaagttaaaaaatgataatgtggaagtgaaatacatttccatgcacaatactccctccatacccataaagaaagttgtttagcacaatgcttaagtcaaaccttggaaatataaatcattaataactcaagttgttgagtttgaaaatgtaaaaattatatgtatagatttgtcttgaaaaatactttcataaaagtatacatatatcactttttaataaatatttttatagaaacaagaagttaaaatctgtgttttggagactgtgtcactgtcctaaacgacttcctttatgagtttggatggagtatatattatactgataccaaatgaactctcagataaatttatatcaccaaaaaaataatcatttaaacatatagtagtgcatacaaacattcagaaatgtaatacaaatatgatcttcaagataagtacattcaaattccagagtattgcatagaaatgatttcttcaagaaaaaaaatggtgtacttcgagttttgaaattcgttgtaccacgagtactagttgcttgggttcaaatttagatttaaattgcaacacttatgaattgctcaaaaggcaaatatatgtacgacgttgccagaaaacacagaatacatttatctctacagcatcatacatagatgcattaagtgtgttctatgtacattttgcacaaggaaaaaatgttgaatgcacagtagtatacacgtgcattcaaaatgtaatgcgttatttctcacaagaaagaaatgctactacaaaaattcatttgaactgcaccatagtatacacctgcattaaaaattagtacattattttcttatagaagaaaaaaaatgccctcataatacatttgaactgcacaacatttatagacagatacatttgaattgtgttattaaaaaaatggattttatcatttttatagacatacggaggaagggcagagccaccgcctgactagcccaagtggccgcggaggctcactgacaaaaactccattaaatttataagttattgaatgaattgatgatgaaatttatataacaaatactagaagcgaagtttgctcgggctcaaaaatatttctcgctccgccattgtgaggagagataaaatgggaatactagtttcattactttggttcattggaatttgtgcgtatatattcgacttccaacttatgtccatgaattcaatgttttgccgctttgaataaatatatgaataaaagggtaaagtttcacaatttcaggcattaaatagataaaaaaaataggtttacttatcagatcatatcatttactccctacattccatattaattattatataaatttttcaccaagaccaagaaaaggtattaactttcctatatttcatttagtgtgagtatgtggtagggaaaaatcaagaaacatgcacactttgggcttgtttagatctcctggcaaaagttttcaccctgttacatcgaatgtttggacacatacatggagtgtttaatataaacgaaaaaaataactaattacatagattgcatgtaaattgcgagacgaatcttttaagcctaattgctccatgatttgacaatatggtgctacaataaacatttgctaatgacggattaattaggcttaataaatttgtctcgcagtttatagccgcaatctgtaatttgttttgttattagtctacgtttaatacttcaaatatgtatccgtatatctgatgtgacacgccaaaactttacacccatggatctaaacaccccctttaactcctgctgggccccatacataagaaattttcatgcttaaatgcaataatattacaagtcaaacgaaggggctatgattaaatgtaataatattacatgtcaaacgaaggagctatagttacatgatggtcaatttgtaaattttaatttgtgttaagtgatgatcaatatgaaacggatggagtatttcatactggctggtctattttctagtgtaaatgaatgtatgagatttatccacgtcaccgtaagtaaaacatctattttattttgtacggtagttttcatttttcactacatgaagttgtggacggacataattccttcgtggaaagtttgctcttttaagaacgctagctaagtagtactagtttctcttcaaatagaggaattcggctcgatttgaagatccagttttgcaatgccatcgagtggtttttcccaaaaggtgcaaggaacagccactgcttcacattttgtcagaaactggtcttggtttatgaactcaaaagggtcttgagcgaccaaaaccagcgagatgctcatgaagaaaagccactgctttcatcgaaagaagtctgagcacacaagttttcagcattacagtgttttgaacaaactagcagagccaatcccaaccagagaaaaaaattcttcagaaacgggaagtagacctctggactttattcaagattcgtccaaattgaccgactcatcgcatattgtaagtgattcggtgatctaataaccccttaattagcatcaaaatcatgagtttaatactcttactatggacatggaagtagtcactgagccccagagtagaagctaaggccctgatcgaaagtgctggctgcagcagctgcagccagtcagccccaatccaaaccaaagagcggcagctgtgaatggcttgcagcagccagcacaaccgatcaagccctaaatgttatgtttgggaagcttctagattcttccagaagctccaactccctccaaacactattgcaccttcttccagaaacgctcgagctctcctatccagaatgaactaaaagctaagagctgggtttcttcttcatattcttagaagttgactaccaaccaactgtttctcagaattgctccccaaacagaatcaaaacagaatcaaaggcttgtagcgtggagcgaaattcgaaggtggaaaaaaaaatcagtgtaaaatcctctcagggctaatcactatgagcgtcattcggtttgtaggatagaagtataggaaaggatagaagtataggaaaaattaaaggaaagttttctttcctacaagatgtatagaagaaacataagaatttttgtcatctactcaaacctcctggaaaaatttctatggattgatgtgtgcaaacatttatattcctctacttttcctattcatatggattcaaattcctccgaaccgaataataagtcattattatgcttggcgcctctgtttcgcgcagaaaaaaaaaaaaggaaaaatccaattcgtcgtgggccagttgagccgggcccggcccgttaaggcctcgcggttcggaagcccatcatctcatccggttcgttatttttatttttctcagggaaaaaaaatccgaaagaagagaaaaaaaaatcccatctcagtccgccatggacgcggagatggacctcctcgccgacgacgacggcggcgaggccgagaggctggaggccgcggaggcgcaggccgacctcctccgcgatcgcctccgcctcgccgtcatcagcatcgccacctccgaaggttaggcccgctttctttggttcttgggaatgagggggggggggggggattggggagggaggatcttcgcgaatgcttcaactgaatgaaaccatggcgccgccgtgcgatttcttgccaggaaagaaggcggggatggaggtctccgaccccgtcgtcgcctgcatcgccgatctggcctacaagaccgtaggtacgtataaatatgagtaaatatctcccaaaaccctagactttttcttgtgttcggcggcttgttcgtgccaactgtatcctgtttcatgatttgttttcactctaaattgttttgtatgtgtgtctgtactccatcttcaatgatctgcattcatgtccatgtgcataggtttgctcagatgtctcctgtaaaccattccaattctatcaactacagtgcttaggctgtgttcgtttgtgtgagatagggtgagaaaacaccacgttttccgcgcgcacgcttcccaaactactaaacaatgcattttttgcaaaatttttctatagtaaagttgctttaaaaaatcatattaatccatttttgaaatttaaaatagtttatactcaattaatcatgtgctaatggctcatctcgttttgcgtatcttcccaatcttctccatcccctatctctcaaactcaccgtgtagagagttattggtttttaacattttcagcttgttctctttaacagtagtatcagtttcttttgttcttgatagttgcgacagtggagctttgttaaataggagtaggtgctcgttgccgaaatgcatgtgcagagaagatgaaattagggtgaaatggtgaaatttatgcgtgatttgctctgaatgactggaaatctggatctccatagctaaagacctttattagggcatcttcatcaataaccaaaagggaattccattgcttctgttgtcttatcattcacctgcttctggacatattctacattctaaacaactcctaattcgagtaacctagaatgtattcatagtattttctctttgaatatggggaagttaggtattagttcaatgcatccggagtcaaatgtggtttatatagatccagctatttgagatatattctggatatgtgagatatgaataaattgaggaggccctttcctgcttggagattgtttcctgtcaccgtacgggggtatattttctgggcctaatatacttgccagcattaactttaccgaaaagacctaaaagctctgaaactcaaggaaataaagtgaactctttaaagaaactctgcaatatgtcgatgaatgcgctatattcagttgaagcagaataaaacagattgtcctgttgacatccatggcttttaatcaggtagttccaaactgttggcaacatacataacaggtaactcagttgcagcaagtttcattaaagatcaaccccatcctgtccataaacatcagaatcacatctttttagtgacaccacatgaagatagaattatagaaagcaatggttaaccacccaatcttgtaccccaggcctcttcagaaaagtacatttcttgccagttgccagaaaagagtgattttgtgatgacagtaaagcaggggcagcaggttaatgaagcagtagattcaaaagtaacatctctgaaaataaagcacatataagctctactgaacttctagatgatatagatggttatgggtcttgttagatctttgattttttttaatcatggtaattctaattaacatctcttccgcaatgtgcagagcagctggctaaggatgttgagttgtttgcacagcatgctggtcgtaaatccatcaagatggaagatgttatactcacaggtacattacgataccgtgctcttctgatcccaaaagaaaacatttttattttgcttcgtaaaatacttgtttgcatcttacttgctgtgattgttgcgacgtaattccagcacatagaaatgagcatctgatgggcctcctgcggacattttctcaagaactgaagggtaaggagccttccagcgagaggaagagaaagaaatcttcgaagaaggacgacaacgtgatgcaaatctgatttaagtcatgagataaatcttcttcccatagaacaaagtggtaggttcaagcaggaaactctgcaagtaactcaggctacccactgatcctgtatttcacacatttagatgtggtatgacacaatgttgtctgtggaaagtggagatccttcacacctgtaaattcactgaggctgttgtgtcaagtagtaaatggcaaaattcagagtttggttcttacacgggatcatgtgctgtcacactttctgataatcctatgcctcctgctgatgtttgctcaactgaaatgtgcacagaaaagaaaggataaataacaaaaaacttccgtgtaagtttagaactagtcactaatcagttctgtgacaatttgtgatgtttggttaaccagggaaaagaaaaaactgatggccttgaagctgtataagatgaacctgtcaaactttgatgcggtaaaactctcactgaagggattctacagatatcgtggtattatgtcagaataagttcacttaaggtcccttaacttgtcaccgaatctgaaattcatccctgaaccgcaataccagatataacacttccctcaactctcaaaaccagtgcaaataaggtcccaaggcagttttccaggtgatgtcgtcggcactccgtgatgactaagtcgttcaggctatccgggcgggccgagcagtggttctaggagagcgtcccctccccatcgccgccgctgttcgccgatggcctcgaccccatgttcgtcaccacatacgtcgtgcacctagacagccgcaccgtcttcatgctggaggcaggagcggcgtgcgacgaggagaggggcggatgccgccggcagtaggcccgtgggggtgggagtagaggaggccgtgccatccttatctccgccgacgagaggaggaaggagaggggagagagatgaagacgggagatggggagaggaaggggttgagaatgacagctggggcccacgtgggccccaccatcaattattattattattatcgaattgccacataagcgccacgtcagttaaaggccaagccaaattagccagtaggtgccacgtcagctaaaaccgccatctaaatcaccataggacctatattgcactggtttgataattgagggacccattgtatcttgttttttagttaaaggatgaaaatcggattcgttgacaagttaagggaccttatatgaacttattcctattgtgtctgaacctgaacagatggcccattgtgaaaccaacacattgggtctaaaggccaacatggagcccataagcagccatcaagcagggcccataagcccatgacactgctcactttgagcccatatcaggcccatttctatcatatctttctgactgtcttcagagttcagaattcctcaagctgcagcaacaaatgggcgcgctaccaggttccaaccagtcaaaataacccttttttttctctgcaaacttcagaattagtataagcatgcagtgtgccggtcttctctatctatattaatataaaagatggtatcaccaccaccatccaactaccatgcggaacccatgaactgaggtgcttgtcttgtttcttactttccacatgccatagatcccgtcgaaagaaaaacatgataatagaatattatgaacatttttatctttatggaatgacaataaaattagcataaatgtattagacaattgggaaaaagaaccgttgcaactcacgagtattatgctagaataattataagggaaattcagactgatattttccagggagggtttcatttgagcaagcgttcttggtaagttatacagagaactaattccagcaatgcaaatttcagaacaaagtttgtttgaatactgcacacattattggacaaaaaaaatgcaaagtcaggttgaccatttgaaattcgcacaatttttttttgtgaggaatcttgtactagtacaaattattgggatgcaaactgcaaagtcaggttgtccctttgaatagtgtacacatcaatccctttcaaaataaataaattttttatatattaatctgaatggaggttatgtctagactcgtgtataaaccttaatttattttgaaacatagggagtacacatactggataattctgagagcaccaacatacacgaatttgtgcctgtaacgtctctctgcagcggcaaacagcaaactactctactcaattctggtcaaagattctgagtctttgatctgccaacctctccaaccacacacataaatactctatgattaaattaggctttgtgtcactgttaacaagatatctggtcgtctgacccaacttgctaatcaggttgattttgtctgttttttcaagtcttagccacagtcagatggagagttgtcatcgtgccatcggttgattatttcattggtctcttctgtgttgttggaggaacgtgatgaaaagaaaagaaaccccaaattaatattatgtttgaccaacacggtccccatatttaaattttagacgatccattcgaatttgataatgttttaagcgatgttgtgtagaaggcgacgaccgaatcgggtgtcacgtaattttcatcctaattaatttagattcatttgaatcgaacagatagactaatgacaaagctctcattattgttgcccctccctccaaagtttgtaaaatatgtgtaaatatatgatagagttagagttaaattctgtcctaagctctcttaaatagggaggcagacctgttgtaactgcgtgacaactaacataggtgagcgggaacggctaccggtgacattcgaccgaagattgttgtatagctctgataccacttgttgtaaaacgagctccgaaattgacaatggtagctaaatgcggaatagctgatttaaaatcccgagcaacaacaggtcaaattcgttgatggattcaatgagttgtttggcagtacaaggtatatctaggatatgcgggttggcatgatgggatataaggaaatttgcgtcactgaagaggaagagcaaacattattatggtaattttttcaggtgattcgaggcgatggtgattttctaatattatcatggattcggtctaaagaagctggaagcacggatgttgaatttgttagctcggttcataagacgaaaggaagaaaatgttctctttgtgtccggtgagtttaatttatttatttggtgatgacattagttatttggctatggattaggtcaagttaaattaaaaatggaagataaaggttaacatgatattcaatagtctgggatgtaccagctaggaaggaatcaattttgctttgtaagatgtttgcgatgatagaagagaaggtagagcactttgcaggtagagtcgagagaaaaaggtcatggggatagtggagactcttgattacggtgagcatagtgaaggcttgtcgtgagcaatagaaagaaactaacgcaagtccagatacacggtggttcgtcaaggaacaaatcatgttgccatggcatattcgtcaagatgaagattgttagaatttatgttgaacatgtatacaaagtcggctgcagtttagatattggagttgtaataggcgtaggagagagttggagttatactttgtcttaagcactctcttaaatagagagacagacatgttgtaatcgtatgacgacttagcataagtgagagaaaatggctgccgacaacatccaactaagggtcgttataactatgatgcgctgtaattatgttggatcaggagaagtattcataataagtgctccaaagatgtaaattatgactgaactccattattaaatatcatgtctcgatgttgtcgttagttttgtatatgctatgatgttcttctgagtttagccaccgatgtaagttgtgaagctggttttataacatatacaactcgtctactcctttggattactatatacttgtcgctgttaaccagccttgactgttaaccagccttgatttaattataatcactataaacttttaaattatcgaatttttgttgagcaaaagttgtatggttatatttaacatatatatgtacaacctacttcaacgatattcatactttgcaagcacttacaaacttatgaaaaataagaacagtcaaagtgaacatatataatagtctctgatgacaaatactccctccgtttcacaatgtaagtcattttagcattttccacatttatattgatgttaatggatctagacatatatatatatatatatatatatatatatatatatatatatatatatatatatatatatatatattcattaacatttatatgaatgtgagaaatgttagaatgatttatattgtaaaacggaggaagtatttaagaacgagggaactaatatagcacaggagatcaagacgaactccgcatcttgcaccacaaagaagggaataacaatgcaattaatcatacaaatctttgttgctttcatcgtcacacacatgctgacatgccatcggccttgcactacgacagatgagctgagaggttgtttgattggcatattcatattgctaaagctgatcatacttctattagctaccatgcctaacattaagtggtcaacaaaattaaaaccacatgaaggagcaagcttgtcacgcttttgtatgccaacaggatggatctacagtgtaaataccgtgtcagttgacattgatgactttgataaaatctacggttaaattgtttgtctatatattataacactacgatctaagtataactaggtgaaaccccgcgcattgctgcgaaaattcagtatgataacaataaaaagaaaacgtgtaagatagctagataatatcagattaagtaaattaatgtggtttatgataatttaaatttaaatagtatgtagaatagtgattcaaacacaaaaagtaaggtggtatgactttatggaagaagaaaagtagggagatagtttggaccgtagattaatcatctaaaggctaaaaacaattaatgtgatatgacttaattagagggaaaaaaaggagaaatataatttggaccataaattaatcatttaagcactaactaagtgaggatgaactatataagtatataggatatcataaaacataataaagatatacattgaaacattatgtgaattatgttggatgataatttaacatgtttgtatttgaaaagctcttgaattataaaaactataaagatatagcatgtttgcataatgtttaaatgtgatgattgttagtggatgatgatgtggcatcttgttagtgaatgataatgtggcatctttgcatgttaagcttaaggagttagtgggggataactttatagtaagataggattagcatattatgatatcgataggcacgttatgacaccaacgaaccaattttttttttatccgccactgtgcaaataacaaacacctaatttgcataaaacctgtttaacttaagttatgacatggttaggtaaattgcaaaaagtgaaccacacaatttcaagcttgctgaatgatgagtgcatgcatacacatagcatgtatgcgaatgacacgtgggccacccttcgccaggaaaaccacccaatcacagagcaacacgtacccctgctgattcctagtacctgcataacctctgtagagagagagagagagagagagagagaggacaaaagatgagaaggcaagtcataaaaagcaacgacgagctcctgctatacttctcagctgcctctgccttgtgctgtgtgcatcgtgcagctaagcacaagaagcaaacaagcagctagcacaaagtgtgattgatcttttgcagtttgctacgctacgtaacgtaccgagtagatcaaggagaaagaaagaaagaaaagcttctttaatttggtcgtggatcccagtaaagttcagtagatcgagaggtctggataaggatgtcggaaaagataagagatgaactactcctatatacaactaccaagtgtcactggttaattgtatactccctccgtcttgaaatatagctatttttagcacagtgttttgtcccaaaataaaactatttcttcacataccttatcctctcaaccaatcacaatcacaaccaagctggcagtagattgcattgcattggctgcaatctccaggtcagccagagcatgcatatctctctcaagattgaatagccagcaattagtccacgctctaatttgcataaatcactactataaaagtgatttttctatacgagaccccttaattcttacaaacggactataactagtggcatctgcaaaaatcgagggtcatttttgcatgcggcccgcgcatagaaaaatcgattttcccatacgggcctctttaagacggcccatgcggctcacttaagcgcccgtatgaaaaaatcgatttttccatacaggccacttaaggaggtgtatgcaaaaataaaatttgaaaaatttgaaactagtgtatctcactcatatgaactacaaattagatgattcttttttctaaatgtttctaaaatcatgctctatcattgtgttctt

SEQ ID NO: 8257 - DNA, 725 bp, Oryza sativa
ctttccggccagagccaactcggcctgctgtttgttgccccagaggaggacaacatggagacgatcgtcgcgcaggatgcgcttgtaatcacgtggaactcgtcgccagacaccgcatatcttgcccgtggcattctgatagacactgagagtgcccgccaaggtggtcttcagttgatgctccttcaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttaaataaatacattagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacattcgtatctgaaagatggagggaatacaaatagagaataagatgatgctgggcgataaggtacgaccttaaatggaatttagatagcaacaaatgcttcaaagcaaccga

SEQ ID NO: 8258 - DNA, 18870 bp, Oryza sativa
ttagttccaaagtttttttttccaaacttcctactttccatcacatcaaacctttcatacacacaacttttcagtcacatcgtctcctatttcaatcaaattctaaactttgggccgaactaaacacaaccttagttccaaactttttattcaaacttccaactttttttatcacatcaaaacttttatacacacataaacttccaacttttccgtcacatcgttctaatttcaaccaaactttcaattctggtgtgaactaaacgtaccctttatgtgtgtaagaatgttttgatgtgatggaaaagttaaaagtttgaagaaaaatttagtatctacaccaggcctacctaaatagtggccatcattcagtacatcgccgtctacacgtctagttgcattgtgatcaagtcaactaactctgtcccatattacttgtcttatatgatactaactctgtcccatattacttgtctttttgagttttttttatcaatgtttgatcattcgtctcattcaaaaaattttggaattattatttattttgtttgtcatttgctttattatcaaaagtactttacatatgacttatctttttttatatttgtactaatttttcaaataaaatgaatggtcaaacattacaaataaaaagtcgaaaaggtcatctattatgagacggagggagtacaagagcttctacgaaagcagtaagctaggtattattataggctaatagctgtggataacccttacggcggcgtgcaaagtaaggtggtcaggtcaagcttctcgcctggtcaggtctccatgcatgcatgcctgacgtacaaaatacaccatgtgtactatcctagtcatgtctatgtcgtatttatacgtatgtgttcatttcagtatatatatccaaaactagctagctagttgtgtgtatatatatcgatcagcttccaacaaaggcctacatgatgatacgatgcctcttccggtcataaattcaagtatgtttacagcaagatttaatcatatactccctccgtccctaaatatttaacgccattgactttttaaaatatgtttgaccgttcatcttattaaaaaatttaagtaattattaattcttttcctatcatttgattcattattaaatatacttttatgtatatatagttttacatatttcacaaaagttcttgaataagacgaacggtcaaacatatttaaaaaagtcaacggcgtcaaatatttagggaatgagggagtacacttttgatattttgatccggcattaacttcttaaatgcttgcgcatatattttctttaaaagtgttatcatagcatcataaatttaatatatagaatttttaacttatatcaaatatataatgttgatggttaaacttttaaaagtttaactaattaagtcttgtcttaaacatcgaatatttgtgattagagggagcacatatttgggagcaaatgtgtctactccaagtaatgtttttacaaaagaaaattagcaagatagctgcctatgcgatcaaaatgagaatacaaactccacattaattgtctatgtctatctataagataattttaccatccttaaaaagataaaagatacctagaggtttcatatttttttagtgtaaaatttagtacctctaggtactaagtaccttaagttacttaaaaagtttggtgtaaaatttagatatctgatagtattttttaaggactataaaattcctcctatctatatataaacttacacacatgtccacagttgttcgatgatgtaaacttgcatgtatcctaaataagccctgtgttttttatctctattaagctaaattaagccacacaatacaattaaattatctctctgctaaactgacaatcaagttggttgttcagtacctagcttgtcgcttaggagaccgattgatctgaatatatcgaacaaattaagctacagtcagtcagtcgacaggttcttgtcgttccaagtcatgatcgatcagttgctagcttttggcgagtctgaaagaaataaatcctggtcttctggttgtactacaaactttgacactgcaaactctgatgcgtacagctaactaatgctatctatatagagagctaatttagtctatttactccgattaatgctaatatgccgtgtcaacaaaacaagagatactacctcccattcaaaacaagcccgtacttatataaagctttcaggtgcaataatgtcgattagttcaatatcttacgaaatttcagcgattcagagtggttgatgtctcgccggtcaagatgcttttgcgtacataatatgctgatctagatcagttacgttagtcaatttggcatcagctttgaaaagaaattaaacatgtagtttcatgacttgagtaagctagcattcatttatttattattatactatagttatgtaaggagaagccacaaaatttaatgtgcaagtcattgcaaccacagagtcgtccaaaaaccatcagatgttggtcacagtaaataacttgtggtaccaatattgggtgcttttgattcaaaggattagaattgacaaaccatggcaattggcaaacaaataccactaaggtgattttcatgaacactctttctagatatatacggttttggttctgttgtagcaggaggtatactccaatgaccactttgcaggagatctagatatgtgcaaattgaaatttgtcatttctttaactttttaggaatctgttgttttatttatctctcagctccattattgcgaaacatgatttttttttacgaacgtgcaaaaaaaattacatgtcaatatattagaagaagaaagcaaagtttagttacacaatgcaaaaggttatgaggacgtagccaggggacaaggaaaaaaaacccaaaaaagtgcaaacaaaaaggttagctattgagaaggaaaaaacttctattgcgagggagggtgaggttggggaaacctcaatgccagcagtgctagcagcagataatcgcagacggtctttttggaggatggactcaagaactactaaccgaagagcatggaacatgtataataatgtacctttgatccaacggccggtttatccattatctgaaaaataccgctaaaagaggccaatacgaacaggtaacctgataacggtgctccataaatcaactagcttttgagtcatagaaagccactagaaatagtggcgcgctacgctgcgccggtcgataatgtcattgaacaattaatatataattgctctaaggtccaagagaactacaaactaaacattgaattaagcataacagccacaacacgtcacagaggcttactaattaccatcaacctgtatacaaaacaaaaggttgtaaatttgttttattagttacgaaataatttcagcacattttacactggtacactccagcaatgaaatgcactcacccaacatctaaactactcttccccactgatggaaagtatattagatatactttgtgttgcatatattactgctgaaaactccctcccaagtagtcctacaacagtaaaagaaagaagattagtctatgcttgctgatgacaatggtttgaaggttgacaaattaagcaatgaattttacaatcccataggaaagtatactacagttatcctacattcagtcaaaattacaacaccttttgggagctctgttatctctctgtcatatcaagttatcaatagtagggtgaaaggaacaaccacgcagttgcgatgccaaaataacttttcttgctcaaattttgaggtgctagtgctagtaaaagtgttttccgcatttaagagaagaaaatggataggcatatggttggattggaaaactttagctatggggtaatttactctacatatttgagaaaactaattaagtaacaaatttttatttcgatgctgaatttgaaaaatagaacatatcagtcggctagttcgtacaattgcttccatgtaggaaaatacaatatgtcaaacaatagtgaagtattatcaaaacagctttaagttcagttaaccaataaatttgaaagtagcaacagtaccaaaacacatatgtcctgacagtataagttggcgatctgccttagtatggatttgtgccctcacacgtgctctttgcaaacacctagaacattgtccctctttaaaaagcacattatgcatatcctccttgcagccaagtttagaaaataaattgctgattcaatattaagatgcaaaattgggatcaggggatattcatagattgatccagatttttatttaatgatggataaagatggtaccagtcagtagctgcatgatgtaggagacggtgatggccccagcagctgagttgatgaactcggcagactgtttgtcgaagtaatgaatgacgacttgaactatgtaactgaacaaaatggtattcatgcaaatggggaatgatggagtgagggtgaagtagaagaaacggggttggaagggaagagtgggcataggtgttcaccttgaaaggagagacggtagatcagcttgtctaaacaacagcaacgcctgatgatggagacggatacgccttggatggttcaggagttgggatccggaaggctcaaatgattcacatgagatggggaaacaccacatctcaagctcaagctcgcagaccgtcgagatgatgctatgtactccctccgtttcacatctatctagattcattaacattaatatgaatgtgggaaatgctagaatgacttacattgtgaaacggaggaagtattgatgatgcccctatggcaatcgatgtgggacgaactgccatcgatgggccgacgacgatggaggaaaaaacctgcgagggcgcgagaagagtgggaagaagagaaggggagggaaagaaaggggcacgcacgccatgccctcactccgttgcgcgaggcggagagccggcagcgtgcgccgatgcgtcgctgtctgcccacgagagggctacggcagcgtggcggcggatgaggccatatgcgagcgggccgcgagcgctgctagggttttggctgtgtggggatatgttgggaagatcttgaccgtctgttgtcctctcgtcgatctgatggtggtggaagagccggcaccgtaggccaggtggacgactggatcgatcccaatgcggcatcgaacagcgccatggtaggtgaaactcgaacgtgattaaccgaaagaacggggttcgaacgcgattaaccggaacaaccgggtgtttttttggaaaaaaaccgatgacgtggcgccctaattttccagcactcccacgacgtttagagagattaatatgtgttaggctctgtttggatattttggcttattgataaattattttcttaacgttgcaaatgataatatcgttgtgttctaaaactctggaataattagtacatgaacgatagtcatataaaattatatgatatataatgatataatccttttttatttttaaattgtgttggcacacatcaaaacctcttagattttagcaatgacctccatgaaagctatcacactctggatgtgtttagttcacgctaaaattgaaagtttagttaaaattggaacgatgtgacagaaaagttgaaagtttatgtgtgtagaaaaattttgatgtgatgtaaaagttaaaagtttgaagaaaaagtttgaaactaaagacctctgtacgtagcatatctagcaagaaagagtatgttggtgctagcagtcaatgctagagctagcaaggcccaattatcgtttgaaacacacacgaataatcttgacccaatgaacacgctgcgttaatgatccacacggaacgatcgcaatcggggtttaaagggacgcaatgtatatagtacgtttgactagaaaaaatatgctactccctcagtttcataatataaggggagtttttgtttacattgtttgaccattcgttttattaaaaaaaattaaaattattatttatttttttgacttattttattatccaaagtattttaagcacaattttttgttttttatatttgcacaaatttttttgaataagacaagttatcaaacagtataaataaaaattcaaaattcctcgtattatgagatggagggagtactactcctgtacgttcacgagaggttaacacacatgctccctcgaatcgaagctagtaataacccagcagagaaagtgattgtgattgacggcgatgcttgatttctgctgaccttgtagctgatcgatcagcctctaaatttgaccggccgccggcgtgcacacggtgatgtgcctgtcgccggcggcgtctgatatgcgtttgttttcctgtgtctgtctgtggccgagtttagttttaattttttttaaacttttaacttttttatcatatcaaaacttttctatacacataaactttcaatttttctattatatcattttaatttcaaccaaacttctaattttagactgttgacacgcaaaaactgagctataccaacactgggcagttcaactgctcactaattcctctgcatttatttttttttttgggggggggggtgtggggggtaggacgagtacagggcaaattaaacagagtgcatggggtcataagtccataactttttcctagcagatgtcactacagttcacattggagtacagagctcttctatcataataaaagaaaatggagaaatacgaatgcatttacacattaatcgatagagtttttctccaagagatttgaaggcttgtccggatcgaagggtttacgtgaattttttctacgactcatgattcctttggattatctattgttcatgagtttggtttgtaggaatcacccaaaaggaattttcaaggaatattgtagcattctaataaaaacacaggagtttcaaagaattccaaacatccactctaaccactttttttttcattattagctgccacaggatggaatcatatattctaatcctctattttctattcttgcgtcttaatatccaatcctaaaaaaaatcctctgttttctaattctcatttctcacgtgcaaccctatcatgtttctacttttttttcttttctgttcctgtgttttttctaacatgtgttctgaatgagccctgagtggacaagtaattttctttgttttctcttcacaacttgtatgaaaggaaatttttctttaggtttcctgtaccttattcttacaaattgaatgacacttataagaattaatccttataaatccaaatcatttgcttttcccttagaccgaagaagctccaagttgtgagttgcagaggaggatagcttagaaagaaggtggcttgggttatttgccaactgagtgtactaaattatttctgttttgccattttaactagccaagtcagcaatatggatgagaaatgatctttctgttctcatcttgccctgttcttttctccaacaaaagttggataaacttttggatactcatagcacgctttttaaactactaaatagtgcgttttgtgcgaaaactttctatgtgaaagttgttctaaaatatacaattaatcgatttttcaagtttataataattaaaactcaattaatcacacgttattaccacctcgttttgcgtaaaatatttaatcttcatattcaggagattcaaacaccaccacgtttagtgcataattaattaagtattagttaaaataatttttaaagtaactttaatataattttttttataaaaaatgcaccgtttagcagtttaaaaagcgtgccgtggaaaatgtttaacactgttgttgacttttttaaatatttttgaccgttcgtcttatttaaaaacttttatgaaatgtgtaaaactatatgtatacataaaaatatatttaacaataaatcaaatgatacgaaaagaattaataattacttaaatttttgaataagacgaacggtcaaacaatttaaaaaaagtcaatgacgtcaaatattttgggatggagggagtatattggtaccggataggagacaactatatatacgctgtgagggacacatatatgcggtttacctccatctccggcggcgtctcgatcatcgaccaccggcgggatggatggaatcgacagagagatcgacccggtttttcaacggcgaatacggccgacgacgacttgttcccatccatccatcgggatacggcggacgcgttgaattccggggccgattgtttgaccctcaaactcgatcgcccccacacacaccacatgcacactctcgtcttaggtagtgtttgaatccagggacttactatcttcgtcctaaaataagtgtagccgtgaatatccgtgcccaacatttgaccgtccgtcttatttgaaaaatttatgaaaaatttaaaaatatttagtcacacatgaagtactattcatgttttatcatctaatagcaataaaaatactaatcataaaaaattttcaagtaagacgaacgatcaaacgttgaacgtgaatagtgtaaaactgcacttattttgagacggagggagtaactttagtatatgtatttagacactaatttagaatattaaatataaattgcttacaaaactaattacataaatgaaagctaatttgcgagataatttttttaagcctaattaatccataaatagagaatgtttactgtagtatcacataggctaatcataaattaattagactcaatagattcatctcacgaattagtctaagattatggatgggttttattaatagtttacgtttaatatttataattagtgtcaaatatccgatgcgatagggacttaaaaataaattttagtcctatctaaacaggatcttagttctttcagcttaattaattactggtttggactttctctgcgagcttgattaattagtgtgtccgtggacatcgatcatatgtgagttaaaattaacttggtcgtcgtactttggatcaaagatgatcggggataattacggtccaatcaacgcgtgtttctttcgtttatttaacgttgggttacgtaccatggaggagatcacgtcagtaaattgatatactacttatcatgcatggtctggatgtggttaattattcaaaccacttttaacttatcctcttgatgaaactctaggtagctagcactagctacgatgcttaattaatcccatcctctctcactagcttggcgaacatttgagataaaggagggtgagatgtggacacatgcacgcaacaaaatacttacggcatccgtctcaaaataaatacaattatacatttaaattttagagtaaattacatcgtcggtacacaaacttatcaggtgggtgcaatctagtgcacaaacttataaaatactcgttttggtgcacaaacttgtgtggtgcgtgcaggggaagtcaaaaagacactatatgactaatcctattgatttaggggctgattaggatgctatgtaaacacacacacacacacacacatatatatatatatatatatatatatatatatatatatatgagaaggttaccactagacatacacatattcaataaaatatagaatataatttagtgatagtagaaaaacattaaaaatatcaagcactgatataagggttagaaacatataaaattcatcatctcaatgatgaaggataaagtagagactaaatttataaatattgcatgtcttatgcatactcgctacaggtatacacgtcgcatcctaatcaacatcaacttcataaaattgacattgccaagttattttgatcctcgttcgcacgaactagacaagttcatgtactgaaacaagcattttttacaagtttatatactaaattacacccacctaacaagcttgtatactatcaatgcaattttatctcatcaataacatctgagtcctcatattactctcaatcaaccttataacttcctaccatcctcatttaatatgggacacctaagctgtaactatttttctctcccactcctaaaattgcacttatattgcaattttttttactaacagttttttttaaaaagttaataagcttagtactagctagcttacacagagttaagctttactatatcatgaactacatatctatataccatatatatgcccctacaaagagaccatagaaaagtaaacaaaatcgatcaaaaaccgatggccggccggcaagcacgtcagggtatattaggaccatgcatgcttcgtacgtacgtatagtacatgcctacatggtagtaatatatatgcacgatccactggtggagaaaccatttatacttccagttggtaacttcttttagtcccggtttttcaacccggactacgaatccgggactaaagaccggttgaaataaccgggactaaagatctatctttagtcccggttggtgccgggactaaaggtctcttttttttcattattttttagctagagtttaatccctatattttctcccaaatcaagtgggatacatatccccaaatcaaacctcaaatcaaaataacatcccaaaacattcacatcacaaatcttaagttacttatacacacaaatcaaatacatcacaaatcttaaaaaaattacacacaaaccaaatacatcacagattatacatctcagatcatgcaacaaatcacaaaattatacatcttagtgaatcacaaattgtaaaaaaaaaaagatgccggcagcggctgccgcctgccgctgctcgccactgggcccgtgcgcggcccagccagccgcctgctgcgtgggaagggaggagggggaggaggaggaggagggagatcgatctgagagggaagaggggaggaggagagggagatcgatctgagcggatgggaagggaggacggggggaggagagggctggggatgggaggaggcggagggggaggaggagagggagatcgatctgagaagataagtgcgaggcggttgtggaggagaggatagggaagaaggattatatattaagcgttgaattttagtcccggttggtgttatcaaccgggactaaagatctagaagttgataacaccaaccgggagtaaagttaggatcttaaccaatcgggactaaagatcccggaggacctgacaaggcctgacagatttagaaccaaccgggactcaagatcaaatatgcccactgtagccaccaacctcatctttagtcccggtttttagtggaaccgggactattgtggatttcggccaactgaccaaagatggtttctccaccagtgatccatcgatatatacaaattttcggctaccgatcgagacggaacaaattaagagtataaatcccataacagctatttgaattacttctttcattttaaaatatagcaacggcccagtgacagagaaaaaaatatgaatttctctaatttccacctgattgtattgatctctaaatcctactatatattgttcttaattacaatctagggagagagtatagtgttttgagagaaggggccttaattatatccagtttggctagctggttacattggctcatggaatcttgtgtgtatggcatatatttttcatgtttggcagtgatcattcacactccaatataggttcacctggacgccacaagattttgtactactctatcactattacatactatagaaaggtccctatagattgcagatggaccaaactaatcatgcctgaaaaaaatcgaccttgatttttgtacgcaactctttgagaggcctgcatgcaaaaatctattttcacatgagaacctcttaaaaagcaacagtatgcaaaaataaatatattttctaatatagatctcttaaaagtctgtctagaattctgacttacctcatcttttttccaactcatcatccttatctcctctcctcctctctcacctcctctcatattaattcttcctctcctccactcctctctctctctctctcaatggtcggcggcgggtggctacagcgaactcgagtagtagcggctagtggcggcgcccggccaccctgggagacagcggtagtggcgaggctgtcccctacccggatccacgcggatccatcagcggcggtgagaggagcccaacggtggactggatttttatttttacgtgcggacgacatatgcatttgcacgcgtatgcaagtacgtcacccgtatggaaagatagatatttttgcagatattttcggacagacagacggctcaaccgcacaaaaaatagtttttagccgtttggaaaaatgcttttttaagtagtgtgtacttcaatatatattttaatatggtaggatatctagtccaataataatatattacaagaaaaattatagtcaaattttaattcaaaagaacatgacaaagtcaaacactgtatacataaaaataggcaaggaaatatatatttcccacccaataaaaaccaaacaatccaatccataacaaccgctgcgtttttagacttaagcacgctccctgaaatgctagcctgctaattcttgtaaggaagaaaaaaggcacgcagatgttgaagctaagctatagctatagcctgttaatcataattaaacttgagttgctatcctccgaaaaaaaatattagagttgctgaatgcctctagcatagttaagaatatatagtggcctaaattaatggttggagtgtccaacttgaactgtttgatacctgagccgaaaaactatagctctttccatattaggcacatgcttagttaaagccttcgagttgtgtgcattacgtcacatgcaaacaatgcaggccaattaattgcacgtgaaaattcgaccgaatgaatcgtgcaacgttgaaatcctattctcaagcatacacaaaagaacttcaatctctacgaaccgacgatactttagttgataaggtttcttggcagaatttgttcattggcagctcaagttctagagtgagtacaagtactcatatttatgattatttatttttttttagtaatgagcgatgtactaatcagctacaagacacaagtaattttatcaattttaagttatatcaattatttgtataagtacatgtaagcccctactcatgagccaaatgatgatcagtggtttgcaggtcacctcgggctcggttcgtttcacaaacgagctacgaaagaggcttgagcttagctcatttggctttcaagctgagctgagccgagttggtcaaacgggcctaagctttttatccacctatgttcgtgtgtaacttttagtactagtatatttatgttaccgctattcattccaccacagatctaatggttgaaaatggttacaccacatgtcaagtcacaagtagggagataaaacattttgggtagtaaaataggatcccatctcgctcatgacgattagtccttttacttagtcatatagcccattgccccacatgtccttggttttgctctcgcggggatgagaagacattgaattaggttaggcggtgaagaaaatctatggaaggagactcctaccaagaaatctccttgctggtagtctcaagaggtgaacacggagcttaaaaaaaacattgctaaaggcattataagagagatgatggttcttagagttgaagaatcaaggaaagaaacgagatataggaaaaggctaaccaatggagaaagatgatatagagttagcgatagagaaggctatgaaagggaggcaccgatacaccagccactagaaacgaacaaggaaagggaagagtattggagaaggtgttatcacaaaagtagaattgagatccctctaccttctgtctttaaacgcactgtgttttaatcactgacatatgggtcagtgatttattaggcttacacgtcagtgacaaaattaaagtcgcgtgacttcaaaactagaggagcttgatcctcatagagtgataccttggaaatacccagagctacctcctccaaaagcaaaaccccaaaaacatttttttaaaaaaacacgtatacagccaaaatacgttacacggtggcctagccagtatataagttgaattgaagccttgaaggtatataggcaactggttagacttttttttccctttgcccataataaagccatctctcataaagccatcgacctcatctcctcctcctcctctctctgtctctctctggctgttcttatcagtttacgttgtcctcatcgtcgccggcgccgccctccaaagcttcatagatagctcgatcgatcgatcccgtcgtcgtcgatcgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgccttcgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgccatggtcaccgcgctagcccacgtcatccgcgccgcccccgacctgcacctcccccaccacccatcctcctccgcctccgccgccgcccacccgcagcaggcttcttccttctacccgaccgccgccgccgccgcctcctcgccgtccgaccagctcgccgccgccgccgctgccgaagagcaaggtaccagctgatccattcaccgcacaagtaaattcctctctctcaccgcgccgcgtgccacgccccgattgcgaaagcatggcacgcgcgagcgcgccataatttggaagcttcgcatccgccaacgccaacgcccacgccgccgtcttcctcgtcctacgttaatccccatggctctagctagctaattaccgggttaagtagcttcgaagcttgcaatgcatgcttaattagcggtaattgatccataattaattaattagttgaaccaaacgagggttaataagttaattaactcccaaatcgttgcctatttcgtgccggaagatacgctaaattaatagcgccatgtgagtattttatgcacacaccgtattacgttatccctgacgatcgaagggggagtccgaattagtcacggattaattagcaagttgcagtattattattattattatgggattaattagtgggaattaattagcttagtgtgttttggtgggtgcagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccggcggcgggggcatgccccccgccgcggcagcagcagacggtcgtgccgtacccggacctcatgcggtacgcgcagctgctgcagggcggcgtcggcggcagttacatgccgttcggcggcgccgcgacgatgtcgtcgtcgacggtgtcgtcctcgtcggcgccgcagatactcgacttctcgacgcagcagctcatccgggccggcccgccgtcaccaatgccatcgtcgggctccggctcggcgaccgcggcggcgtcgtccacgacgtcggcgtcgtcgcccggtgcatggccgtacggcggctcggagcgcaagaagaaggattcgtcgtcgtgacgtcactggatggatcgatcgatgcatgaatatgccatgcatttgagaggaagaggtcaagtttttttttaagcaatggaaatggattacatcttcggcctcggcacgtggacagaaagagatcaagtgatatggatcgagaagaatgtttagctgatctgctctttactctgcacgatcgaggagatgaaaatgcatgcaatatgcatggaggggtaagtgttaagtggttaattggtgatttttgcgggttaattaattacatggacattaatttttcttttgatcaccttttgtttattttttctctgaaaactatcttcttttgttcatttttattttcttggaggtacttaattaattagctaggttaattagctggtgatttttagtttgttgtttccctccttttgttcaagtgtgaactaattgtgcaaaattagtccaagtaaagcaaagagagaggattcttatttaattattggttaaacattacccttttttaagatgaaacatgatgtctttttttaaaaaaaaaatctgaatgattaccacctctttgtctacatctttggattgtagtggaagcttcttcttcactggtgatctctttggcagacattggaaatgtccaaaggataccataaatggatttcagtatacctttaggaataacattttgttgtttggtagcatgcatgatgggtatcaatcaaatttaacaacctttggaaaaaaataagggggaatcttctccatcagcttctcttattaaaagatttgacttttttgtttagatacttttatcatggttgcaatattggcatctgttctatcgatttatcatctacttaatcctccaatctcattctccgctgtaatgatatttaagcatgtgtcatagtggtatggatgcctttaatgcatgtagcatatttcaaactcagaacaagatgtacttttagaaaaattaaagttggaaccgtaacaagaatctagagaaaaccagaaaaacgctgcagtttggtgaggacattttacttttgcaatgatgctttgaggtgatgaagattatccacatacctaataattattcagttgtaagaaattaaaatagcatgaagtcatccatttctttttttttcaaacgcttttgtacataagcaacatacatattccatccccaaagcactatagccacatatatatatatctacatatgtcttatatcataaaaatgcttatagctagcttcaggtttttaatgacatgaacatgcatatgccacgtagatcttgagttaattatagtcagaggtgtggcgtaatgatctcaaagtttctagtgtaaatcataaaatatgtagatttgtgatttggtgccatgtgtcgagatttattcgatcaacttgccggcatgtgatgatacgaaataaggagagaacctctatcatgcaagtatcatccccatcccgtgcatctagaagctaatatatatgggcgatgcatgcaccaattcaatgccaaatcaaatgcattcaactgcatttttttgtatttacgcatttttatataccagtacatctgtccacccatctatccagctacatatatgagtgacaaaaattacaaccacactagcatttgtagatacatgtgtgtctttttctctatagctagcttgtgatgagaaccaaagagacagatccatgtacaagtgtcttgatgtaacagagatcatcattatacatgatttgtttccattaggtacgtatctctttcttaattttctctactattggttgcatgaaacttattatatatataactattccaattaactaggtttatttaatttatacctgtcttttagtttgttcacactgggtgtgattgatggtgctgtggtgtgtttgccctttttctctcctttactttcatgatgggaacaagtatcaaaatttgacacgcacattttttttttctttttgccaaatgctactgctacctggcagctagcggccgatcgaactcgagcagaaagtgccagcagcaagcaagctagctttcgtgttaggcatgactcatgcctgttttgattttcaacacatatcatttatcgaaacagagaaaaaaaaattaaagaaaacgagtaccatgcatgcctaattatctctagtactagctttttaggcgcactattgtatattgtgtactatgaaagtatcgtgttgttgagatggatggtcttacacgtgtgcgccatgcttgattacttgtgtgtgattggcacctaacttgtgtgtgatcgatcgtgtcatcgtcctttgatagagaggataagacgcttctctcatcatcatctcagctggtctagctctctgcctaactagccaagagtacctaacttaattggagaatgttctctcttaattgtattggcatgtttcaaagtcacttgagaattaggttagagtgattttcaagtgaaatttagaaacatatcgaagtatatatgtatgcaacattagttaatataagaagtttcaagtgtaatttaattggatacaatttagtgctcccttcactttaaatttatgatgctcttaattttttaaccatacattttatcatttatcatttattttgatataaagcataaccatatttttatatttatatacaacttttcttttaaaataaaacgaatggcgaaatatatgtaaaaagtaacaatgttatatatttaaaagtaggggtaatatatgtacataacgttccgggtcagaataatatgaagtttttgggtgctctaggcacaaattttgacaatttgaccctttg

SEQ ID NO: 8259 - DNA, 13879 bp, Oryza sativa
aggcctctcgtttcatacaagctaaatgagattgcaattcaatatatgggtttgcagccatgcacaactcagtaactgatctttaacggataactcatttattctagtatttttagagtttgctattttactactcacattcttataattacatattagaggcaaacgatcgcgagtacactcacgtacacatttacccatggatatatatatgtcctatataaattatacacacacacacacacacaaaatcttcaccaccaaatccactcacctgatatgtaccacatcatatggatttaaattatttaattataagataaatttaaatatccatgctaagcctgtgactgtgtgactcaactacaatgaacggattttaccacaaacaactcaaaaggacgaagctattatcctcgattaactttggtgctaactgctaattaacgttagttctgatcaagcacgtacgccaaatattaattggcagaaatatatgcatgtgtttgatttaatagacacggtatatatacaactgtcacttttttcgtcctgtcattttctttcgaggaaccacatattttgacctctaccgatcttttttcccttggcatgcatgtgtcgatctcgcttcgcttttttgacagaatatgcatatatgcatagaattttaataggagagatatctcgtctcgctttgccactacacctttttctttttttcattattgtccgatccgtgtgcctcttaatttctgatcttttttttcctcgaaatgcagtacatacacagatactagtataaacgtgtgcatccttatttatatgaacacacatacatcctacctctgtacgaacgtagatatctactcgcatgaaaaataattacaagggctactatgtgtatcgcgtaaaattatatatctagtattgaagaaattaatattatacttctagagttctactatacttccttcgttcaaaaaaaaaaaaaaaaggtcaaactagaaagggacgtgaaaaaccattgagacggagggagtatgcatgtacggggaaaaaagatatacacgtacttatggagtttgtaatcggtgaccggtaattagatcaagatttctttcatttctttaattaatttccaggaacacacatgcaggctgcgtagacgtacactacttttccttgagagtatagatacgttagcttctccagtagtggaatatatttgtactaacgtataacactactatacgtaaccattagtgctagtaatacgtagtactcccttccctccgtttttagatatttaacatcattgatcttttaacacatgttttaaatacttttgtaaaatatgtaaaactacatgtatacatataagtatatttaataataaatcaaatgataaaaaaagaattaataattacttaaaatttttaaataaaataaacggttaaatatttaaaaaaattaacggcataaaatatttagaaacgagggagtattaattatacttgtatgtatacgcaggaattgtatacagtgtggacgcatgcagccgactactactacatacgtatccgagcgagtgacagacggacacctagcttcgaggtgggccaagctatatgcacgggcccaccggccaagcaggcctgcggatacgtggggcccgtttatcctcacaggtgggcccggagtgacaggcacgtgaagccgtgtgccgccccacgtgcgcgtgcggccggaaacgcgtacacgacatgacgcgtgttgcagtgcagtgcgcgccacagcggatttcttcgatttttcttcctctcttttctatttttattgaaaggccgatgggtttaaaacatggccccattcatcctataatataaaggattattctcttttagaaaagattaaggataaaaagaaaagactacaatacccctattgaatgtgattttgattgtagtgagtgggtagttgaaggttaaaataggtataaatttgaattagaattgatggatgtgacaagaagtatagcaaaatctcttatattataggactagtagtaaagataaaatcccttatattataggatgaaggaagtagttgaactttgcatgccgatgtttgacgatgtgcatgatggacagtgcacagtacttcagtggagaactcatgtaagttatttattttactttttcaactttatctttctctttttaccttcctaaactgctaaatgtgttttttaaaaagattcctatagaaaaggtttttcaaaaattatattaacccattttcttatttttattgagctaatacttcattaatcatgtattaatgcatacattgttttccgtgccagaaaagaggagttcccaaccccttctcccaaatacaaccttattgtactgaataacattctgttaaaggtattattagctcacattattagcgtgatatacagtagtgtatcgggttgtattgtaaagatattagtattattgtggacatatatttcgatggtttaaaggaggttggttacgaaagagttttgtgttttagcccttgcttttttttaatcttgtccttaaattttaatattcatttttacagaccaaatatgcaattcaaatcctatatccataaagcaattcataaacatgtttctggctggtccatcgaacaaaatatgcatttatttttttcccctattcttcactctttcttctccttttctacccataaaatctctgatcccttttcctagctaagtcgcgggctgcatacgagtatggcaacaaactatttgttacttgtaacgaccaggcacatctccctttcttacacaccaacgacatcctactctctcctgaacagccaacatgggacgacctcaacatgcacatgttgcctctccatcacgaatcattgccaccttagtcaagctcgctagatttggcaaaattgtcgctctagtcatcgaccttttacccatgtggtcttgatcgatgtcattgttctcctatctagtggttgtggcggtggtcatggaactctattggtcattgatagtagtgtctcgccaaccgttctattttttcttgtgcggacgaatagttgcatacaacctcttcttcgcctttcactatcttgactggttgatttttttttcttccaacttaattaataattggacctagaagtcacaacgacacagctgatccacactttcttccctcaggttgtctaaacctatgtgataggcaatgacacttgtggccccatcgtttgtctttttccctaataagccaaaacggcttattagggaataaaaataaatttgtaggtaaaacttttatatatatgtttttggtgacttaaaagccaatgtaaaaaaaactatgttgaaaatatttcaaaatttagcttgtaaaacttttaaaattaagtttgtaaatttaaaatttagctttttctttggttgattaggccatccgatgggagcctccacttgttttgaaaatgctttctaaggcaccgtttggcattactatggttctggtaatcttgtttgccaggtgcatcaatttttatacatttcagcatgtatcatttatatataatcactgttggaaacgtggatattattatggcctggttaacataattaataaaataaactgcggagataataaatttaaattttcacgtacaacgacttatacaaaaacagataagcacgcacatcatgtttatcaaccataatctgaatctaaatcctatccatgagctccgatcctgtgcactagctagctagccggagtaacgtatatagacttcaattccctggttatttctgatatcaataataatcatacgcgcaaccgaaggtatatgtgtgtgtgtgtgtgtatatatatatatatatatatatatatgtatatatatatatatgtatatatatatatatatgtatatatatatatatgtatatatgtatatatatgtatatatatatatgtatatatgtatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcatatatatatatatatatatatatatatatatatatgcgcaaaatttggactgtaggctttcaattttatttcaccattttgtttgatccggtggcaaagcaaattaagcatgaccacgtggatccaacgtccgcctatagctagctctttgctttttctttacgaaccaaaatttgtacgttcgaaatgaaaggttcaccccggagcccggacggccggccggccggccggatgcagcatatggattcctggagaaaatgacctttgtggctttgccattcagaatgacacaaactagcctagctagctataaaaaaaaaacgaggtgattctttacacggaacttaggtcagatctgtgcagttatcgtagggcatgtttagattctctggcaaaatttttcaccctgtcatatcgaatatttggacacatgtctcctagcaaaatttttcaccctgtcatatcgcgtatgattttcaccctgtagtattaaacatgcatggagtgtaaattgcgagaaaaatcttttaagcatgatttcttcatgatttgacaatgtgatactatagtaaacatttgctaataatggattaattaggcttaataaattcgtctcgcggtttataggcgaaatctgtaatttgatttgttattagtctatgtttaatactttaaatgtgtgttcgtatatccgatatgacacgctaaaattttacacccctaaatctaaacacagctgtagttagggcatgctttgctgatttccggaccaattttaacatttgaggatgtttggttcatggttgaagttaattgttatattttgtcacacatgtagtaagataagtttaaccatattagatatgtttttaattagttataataggtggcaagatttttattttctttttaagtgtaggtcatggctggtttgaagtgtgctatgattttgattatatcagctttgatacacttgacaaagaaagtatggttaatataatgatataatttgggcaagctttggttcatgaaccacatgtgtttttttttctagacggctaggaatagaagtgcaaaattcttaccttaccattattcttcatcgcttcggttataagtgtatcttcgagttattacatccggtcataacgaggcttctttgctttttaaaccacaacttaggttgtgtttagttcatgttaaaattgaaagtttggttaaaattgaaacgatgtgacggaaaagttggaaatttgtgtgtgtagaaaagtttcgatgtgatgaaaaagttgaaagtttaaagaaaaactttgaaactaaacacggccttatcacagtttaccacgtctaagatagcggtctatcagtcaaatgccggcggccgcgcggtcgcctctagctgtgtagctcccttcaaagatttcggctcgtcgccggccggcggccgggggcatcatcctgtcctcatgcatctaggtagcattttcgcctttgattgattctatatattttgccaacccgttcgtttctgatgaataatttagtacatgaaacctagctataatagctacgtgtaattggattctggttcaaagcttccggctgggtgtgtgtgtggcaaaccattagtttgcgtgaaaaatggtccttgtcaacgtttgcggctgcccccatcgcccaacgattcatactcgaagagtacttcgttttgacatttgacatgacgacatttgaaacataattaaccacaatctttaattggtagtacagtactactcgttccatcctaaaatataagagattttaaaaggatgagacacatttcctagtaaaacgaatctggataaaaagtatgtctagatttatagtgttagaaaactgtttcgtccatctaaaattttttatattttgagttggaaggagtattaattagttctcctacatcgttcgatcataacgtacgtgtgcctttggtttatatgtgtgtgcgttttaattgctccataagctgaaaaaacaagaaaattccccaagtagacccggcccatatatatatataatgtcgttaaatgtaacagacacttcgttcagggtttataccaaacatctagtagaataatctcttctggcattctcgatctcctctagcacgaattttgtaaccttttctagctactccctccatttcacaatgtaagttattttagcatttatcacatttatattgatattaatgaatctagacatatatatctatctagatttattaacaataatatcaatgtgggaaatactaaaataacttacattgtgaaacggaggaaataattgctaattttagcttctcggcaatggctgaaccagattgttcgacgaaccactaagcagatactttcttcaattgacaaggatatgtcatgtgtgctttattcctccttgcctgcgtctgtctttgtctcaccaagagggacgatgtatctaactatggattttatgccagaatttccacgaatttttgcgtagagtatattttaacatagtagaattatatttgctaaatatatataatcctctcgctttctgtttctatcaaaatagccattttttgatatgactatatcagttgatagggagcgtatcctatgcacacaggccctcgcgtgtacacaccgtgtataccaactaaaaattatcataaaaaaattctaggaaaattcatacatatactttcaatagtattacatctacgtgcaaagtcgcatcttcaaattcattctacatagagaataacaaaaaagataaaattctgacaaaattgcaaccttaaaactgttaaattttttatttttttgttacggctaaaatataatgaatttgacgttaagattttaaccttaggtgtaatacaattgaaagtatgtgtatgattttttctagattttttggtgacattttttagttggtgtgcacgtgtgtacacgtgagggcctgtgtgcataggatatgttgcccagttgatatacaccattattaattattggatacatcatcatgattggcaacaaatatctcggactttttcttcgattaacgttgtataagttttaggctttagaacaatcaaagaagaagttcatgtacccgtaaacttttaaagaaagtctacctagcatcttaaaactttaaaaaacggatatctaacgacccctaaactttatcatttatataatttatctctgaagtggttttacatggtgaaaaaaagtttgatttatctccatctcaattaatcctgcaacctccaagttaacctccttgcttctttcattaatttaactagtcatcaacccgtgcgttggacgggctactaatactcatactatagatgtgaaaattttaacatttcgttaaacatgttatagttatgtttgaaaattgaaattatagccgcttgtattaaaagaagaatcatccacgtcagacaataattttgaattttagaactaaattgataaaacactaaattaagagtccaagatggtaccagtcttatatttattaattatgagcttcctaactattaaaattagagtccatgctattttcaattatgtgtgatttatttaacaccgaatctcaacacgatgtagggtaccctggtaatatgatttcattaaaccaactggcggaactttctaattaacatggaagctcctaaaaagtacccaattaattaatataggtataaataatatattgctatgtagataaaacatttggcctcgtatttgggaggccctcatcatatctaaggatatattggacgtacggcaggatttcattcctttcaatcaaaactatagtgggtaagccgaatggacattggaagaaaacctttttatgaacttgttgcacctcaaatagctggggaaaaaaatacaagacgagaaatatggctactttttcactttaccaccaccatctggtgcatccaacggtagtgcaagatgagagagacagagagagaatgagatatgtaggaacatttcgaggttcctctttgtagaactaactccacatcagccttttcaaaagatcgttcctttagttagcacagggttccttttaggattattcttgttccattcagttccaatgctgtgtgtgttgcatttctaaagctgctccatttgtttttatatacttgtgttctgtttgtttctttctttctcaaaagttataattgacatggaagggaaagcttcagtttcgttgaaattgggtgagctagtagctagtgcatcgtagtttgcaaacatgaatgagtacatattgggaatgtgtcctggtaacatttgtgctttgtttacaaattttgttgcatggtgttgaggctagtgtggatcatgcaaactagttatatactcatgttccaaattataacaatttttaagttttggacatgtgcattaaaggagagtgataaaaaggctatactataccattaatatgtcctgacattggtaaagaaaatgaagcaggggtggttaacattgcaggtgtattttgggtaccaaacaataaaattaaaggtgcacttttgaagctagaagttattatacatttggataaattttgaattctagaaattgttatatattgagacgaatgaaatagttagaatagttttcttaaagacaattattcaatttgatcttagctttactgcgagccaaaaacagctgctcaccacaatgataaaattgttaataataaacaactaccatatatctactctattcaaactctcttcgtgtgttccaactaaatccacttctataattcagcctgtcaccctcatggcggtcgagcatgataagatgcgcaacagtgatatattcttagactctcttactctaatatcaaatgcaatagttattcccgtcggtttcaaaccgtcaagaaaaatccattttctgatagtgagttatgatcgcgtttgcgtagatttaaacctgagtgggtggagacatgcataggaatcactccacatccataccaaaggtgcttctcctcctcctgctacactgcactttacccatattagcaacatgacaaggattcaaaacatattctcaataagctaaaaaaacacaaagaaccaaaggaagctagctactgatcagccaattagaatatgtctctaccttcttttgcatgagctttttttaggtaggcgccgattgggtaccaaaggcagcttaacactatagcttacacatgcatgcatgagaattgagaaactatctatctagagcacttgtcgtattagttgacatcacacatgcatctactatatatatatatctatctatctatctatctatgcatgcatgcaccttaattaaaaaacacactttgcataagcatgttaatggaatcttcttttgcttatattgcctttgcgccgcattggctcgtgtgatgagtgaatctattctctaatctgcctaagtacgtgtacgtgtccctctcggtgctcttgtgtatgcatgccaccatcattgcggctgtttgttttccatgaactgattaaaaaaataggttagcgccgatcgtccaatatttatattctttccttgtcgagtaatgttaattgattttttttaatatataacgccgttgattttttaaagaaatgttgaccattcgtcctatttattcttttaaatatgaaaaaagttgtacttaatataaagaaagataaatcaagtcacaataaagtaaatgttaattatatatatatatttaataagaaaaatgaccaaccgtttcttaaaaagtctaatggcgtcttatattgaaaaacgtagggagtatatatatatgcatagacgtagcaaaagatctacctagctttcatggaataatcaaaccacataggagataggagtagatagattggtgatagcaatggctgagggtagtggtgtgtgaagtgggacacagttatatggcaattttgagttcagtcctaaaatattaattgtccatcacatctgcatattgcttgacctagtctaaagtacaattggcaacaaattgtatatgaaaatcttatctacacatggtgtcgccaataaattggtagtcacattttagctaaattttggtaaaagaatggattcatggaatatgtgcatgctcgagggatgaaataattggtacgtgacactaacaactgcggtagtgaatcgccgcaaaacaactatcccttcttttaaaaaatataaacatagctatgtgttttataaaaaaaaataaggtttggataagaaatgataatataagactttcaaataagaaaataggtgaagaagaagttaagttactatgttataaaacaaattttaaacgccagatagtggaacggatggagtatatatctcacaaaggtaatgtgtggtaacgaacttaaaaaaccactcggaccccccaatttttttttcaggagaatgaaaaaactaaaggtaaaatttatgtaaaaaaatgaaagtaattttatttttcttattgcatatagctagaagataaatatgcacaatacaccaagtcacacatacataagtttatacatgcatatttagacagtatacccatacgcatggtgataatataagaatcgttgcctaactttgcccaagttgagagccatcggataccggcccgattgacaactcgacgtacgtcctcgaccttaatatctctctctgtgtgtgttaggtataaggatatgattacattttatacaaatattgcgtttgttaccgtgggttaggaactcattccctctgcatgaaaaaagaacggtttattagcacgtgattaattaaaaaaggatcaatatgattttttaaacaagtttcgtatagaaactttttataaaaaaaaacacaccgtttagcagtttgaaaagcgtgcgcacgtaacacaagggagaggtggaacactaaccaaagaacacagcctaatctacttatgtacttccccagtagcccacttctgtagtgttcaagcaatgtgtgctaatgggcttttatttggctacgtttatctttaatgggccaccttttctgtggaccttcctgagcaacatacatgtctacttggctgcactggagtgtgtgcaaatgtggctttaatttggtgagaaggccaaggtattttgggtgaattaaagttttgtttacaagataaaacctcccacgttgctgcgaaaaaatattgattgtagccgacgttagaaatgaattcaatatggatttgttttatagttagatgtcgtgatcttatatgctttgtataatttgtacttttatcactcatccaagaaagaatataaacaatttaaagatagattgatcattcaaaggataaaactaagatgatgtagctttacgagcgaagagaaaggaagacaatagatcatagagattaatcattcaaggattacaaataaataattaaggtggtatatatgggtagaagaaagaaagcacatgcattattgcgggaattgagacataaaaagtttgaatttgtaaagttcatcagatcccttatttatctatgatgatcactaacacgtggatcctagtcccacaagtcattgatatttgagaggatgagagacaaaaatatggtcaattttcatgggcaacacaaggattgtagaaaaaaaaactctacaaggacttttaaattaaaagggattgccataaatttagagtaggcctataagagttaatatgacatcatcttcaatcacgtggaagcaactatagctcagtatgttagaaaatggtggaaaaaacttcatctggaaacaaaatatcaatttaaacgaccatgccaggatgaagccgaggcataatttgaggattggagatgtcggtcacgagaccaatgtatagtgagaactcaattcaatggtggcttgttttgttaaacagttgtgtggatgtgtggtcggtatcatgtcaggtagtcaactgcaagagcaaacaaggagaaccccccagttgtcccttgttcacaaatcacactaatatatgtataaatttgattttttttttgggtcgcccctcgcatatttattagaattataagattatttgatgttcacactaacgtatacacaaatttgactgttaatatagtttgaagtatttcaaaacattttattgtttatatatgtttacatgagcactaatacaatataatatagaaataaccatttaaaaggtgacttaataaatactagtaatatgcccgtactaacgctacagttatattttgtaatgaaaatcaagatatactcaggcaatatcaaaaagaattattatactgttgctaattagatactaacgagaaaactcaaattgcaacttttttgcatgtttgaaaacaatctaattccttatgcgcttaggaatacaaactaaacatattgcgtagaagtaatacaaaccaaacttcatattacaagcaaaagcatttttattattttataaactatattgatcacaggagacaaatttgagctggatagaaagttacaattatgcagagtttatcttctaaagactcacaagtcattgtctaactcatctgatcataaagaacaagaaccctatctggaccagccttcatgtcttcacaaagcatgttagagagtgtaagagcaattttccccactatgcatcatgaaaattgaaatttgtcctttatagtttagacttgttaatctgtttgaccatatgaattagtttacagaacatgctgtaaatttaaactgcagatgtataggctatacagatattccaacaaatcccatatatcctgaattttttcaagtgcaatcctataaaccaaatactcagagagttgttagtctatcaaaaatgtgctactctgtttatctaaaaattccgtgtcaaacatcagcaccaccagatcaccatcgcccatgaaaaacacaacgttcatcatcagtctctcagctacactcccggtctcgaggacccacaccaacacgtacggatatccaaatacgaatctagctcatacaagtaccacccagatttagtaccaagaagctcaaacagttctcttgcatccacaattgattgccaagaagctaaacgcatactgaaatacaggtcaaataagacaatgagatagtcagaccttcttcccatggtcattagttttccaccttccactttatctccaccaatgctattggcaaggggaaatcctaaaaagagcataacattattaaatttaacattccaaggggaaaagggcaagatattttacaagcatgactgtttgcgaacacctaaacagtatgtgaatagataatggttaattactg

SEQ ID NO: 8260 - DNA, 7842 bp, Oryza sativa
  unsure (1)..(7842): unsure at all n locations
atagatgaactccatgaaattgatactgtgctacagattcctaagaaaccaacaaatcaatccatctcaccaaaaaaatagccagattttcaatcgatcaatcaatttatcattcatgcatattgtgacccagggtccatcgttttcgatccaacccattcagttggaccacacctacactatcctcgcttcacacaaaaaaaaaaaccagagtcaatctcgggcattgtatccttatatgctggtgctcctcaagctagctaggcgaggtgggactaaacttgcaactgctgctgctgttcggcactgctcagtcgccatgggctaggcccaaggacagctgagctgctgctgcatgcacggtagctagcttgcctagttggctcaaggaacaaagtggcccatcttctgttatgtcatctcttttttaaaaatttttctaattaatccagcgcatcacatgtaccttgccagaatgataaccaaggaatggatgaatggtttaaacaagtagtcaagataaaaactaagtattttcttcgcttcatcactcgacaatatttaattcaaagctgaaaaaataaatagaaaagagagttaattcgatctctttcaaagctgacaataaggttttaggttgcttggagctcgacctccttggcggcaactccgtcccgcctagagcgcgcctcttaattagcaaatggattcaaaagagatagcaggttttatgcacatgggattaatgttaaaaaaaacaaaatgctaacatccatattatttgatccacttggtttgggaatattgtttatgaagatgtcctggactgatggattaatgtaaaaaaactaaaatgctaacagattactatgtggccgttctcctatattttcctttgtcacatgtatcagctatttgaaatatattgatttggaaaaaaatgactttcttaaggatttggatgtattcatggtcaattcatgtaacctatattttcctgtcactattgaaaatgctaacaattttaaatgtctattcacccttaattaaacatatgctatgtaaacaaacctgagtgaaatataaaatatatttcttcaaattgaaggaggatgcgtacctttgagcttgacttttgggggatattgtctgagaagaaggcatatcacgggctgtcagtgagcaacaagagacttgaatcaggaaattcagtccacagaaatcaatgcaacaaactctaattactttgtcaactacagtacaacagtaactacctcatcctgatgaacagatgaaggcatgagcagagaagagaatatgaatttattcagatattaaacatctgattttttttcataagttcactaattaactgaaaaagtgttcctttaggcaatacatcgataagtgcttgcacattactaatgcacgatatgtacatattcaggtgtcatgaataaaaatgtaaaccacatttgacattttaaaggaaaaaataacactgcacaaatctaacattttaaggaagttatcactgcacaaatcagaagttatcactgcacaattccagcactgaggtaaattctcattctgtatataaccttcggtacacatcacagaataatcacagaataatgtatacaactaaaagtaaaagaagctctgaatattggcatcatgattcagataattaaatgtcttcttttaacttggatgtcaattcagatggtgttctcttaaaagagcacacaacatgtctatcaatttaattggtttcctgggctatgttgctgaccaagcaatgaagttaaaaaaaattagcattgtatgagttcgatcagaattcatttgttgcagcattccaacgctgctaatttaagcgctttctctgaattttcagatataaacatcccaatcatgagagaagtaaatgatttcacaatgcagatgataatcaagttaaaccatttgcattatataaaaagatgcagatgctaatgaagtttattaaaccatgatatcgtcattgatagtttagtagtgggatatgcatacacacataagaaacatgaaagttgcattattaatcacatccactgatataatgattttgcatttctacattaaaatgcaaaatcgcgatggttacctaattactttgttggccggcaggttcgatgacctgcgatggcgaggagtcctaggggtggcgcgactgagagtggacgacaagaatcgatgactacttgacttgcgacgcggtggggtggaatccggtggcaacgtgcgagggatcaacaaactgatggcggcacggtggagagggcgccggtggcagcgcgcgagggatcgaagacgacttgactggtggcgctgtggagagggcgccggttgcggcgcaaaagagatttggtggtgaggagatcagaggaggcgaggcgagggcgatgaccccggtgtaacgttggtcaccggcgatgagttgagacgacggttgcgctccgggagagagggagtgatgggagagaaggagcggagattgcgcgtggagggatggatggggcgcacggagatgatcgatcggcggcggcaacggctgcactcgggagagagggagcgcaaattgtgcgtgaggaaacggatgggaagcagcgatttcgatcgaggggtgcgatttgggggcgtggatgacgggagattgggagaggggacgaagcggtgtgaggagatggtgggagtgatttgggacgttggattcgagcgagacaatcctgaccgatcaatgaggaatgaggatgtacatcagttggtgaattatagggtagataataaatactacattcgtttcatatcataagttgttttgacttttttctagttaaactttttaaaatttgaccaagtttataaaataaaaacaaacatattatcaaaatatatttaatgttacatttagaaaacttatttggtgttgtagatattgctaaatttttgtataaacttacagaagattgactgaaaaaaaattcaaaacgacttataatatgatatggagggaatagcatcaatttaaaattgaatgcatcgagtcattcaatatatggatgacgtacatatcgtcatgtcgtttcatcattctagccggtggattgcaaccttatttaatttcttagataaaaaaaatcagataattaaccaagctaactcattacttgatacgggaagtaacccgatcttctcgacgtaggatccagatataccgtgaaacctcacgaactgggtgaacaacacgctgcccgtgcaacacacctttaaccacgaatatgcaaaatcactagtagatgcttaataaaactatctaacccttaatcccagcggaaagcaagcatgatcttaattaggatcatcatattcccctatatgtggttgtgccaaatcataggaagaacgggtggcaagaccctcacatagttgtagctaaaagctaacttttattcataatgtcgagtcctcctctataatagatgcacacctattgcttatattgcaaccctaagacctctaaacaataaacaaactcattacatgacttggacacgaagaaagaaacttctcctgcagcaattgttgattagtttggtagattgcagataaaccacgaacaatttgaaggtgggactaaaaccttgatgcgggccaataaattagctctccaacaagtactcaattttccaaaacggagtccgtatgcgaaatccacgaccgtttttatcagattgtctaggctatccaaactgaatacaaaccttgttatcttcaaatttctcatttggaaataattcaatccatatagaggagataattgccgacttatggagaatattggaatagacgaaaaccatctaataataccatagaatccacaaactctccaaacatagcaattctcgcgcgtcacttttacagaattgataacctttagtaaaattggatgttccaatcaaaagtagtgggcctccttgggaaagtggcgtgttacgtgttgcttacaatacaatgctattcttgtccttcacgattttatggaggaggtggattcctacaccaaagaacaagtgtagctgaaccctagcaacaaaaattccatgttcttagcggtcaacaacaacttttgtggcgttggtgttggtggtggcagcggaaacacacaaggaataggtgaactgagaccacttagaagttaaaatttgtgccatagctgttgtgttccaatttaaacaccaattgactgttgtattaccaatagctagcatctattttgtcacttaactcttttttatgcgaggaactgaggctcatatttagaactagctagtggatacgttataatatggcattaaactcatttattaagaagcattgatctcattgacactttgattcaatggcttacgtagtttgatgacacaactatatacatgagagttttttttatagtaattaatttaaattagtgggatgtaactatacatgcatagatatgacacctagctaaagttccatattcccctttctctcaaaataaaaatcagtggtgtattttgatccattggaatacatacttttaaggtgaaaaaataactcaaaagttggagggatgaggttgggagcgtaatggttgactttaatacatgcttaacttagctttgagcttatatgcatttatactagtactacgttgataaagtagtttacatttgactttaagtttggtttccaaaggctcattaactgctcattaactgctagacttagagtaggtaataatatactccctccgtcctaaaataaatcaacttataggtttgaattttgtcccaaaataaaccaacttctaccttcttagctaccaccggttcacaaatcaagaatttttatcctttaaatacccctcacctacatatccatcaatacaactttcttactaattagggacattttggtcatttgcctttctccttaatttcatcttgggaagctagggtttgaaattttgtgggacggagggagtagttaactactactctcttcgcccacaagagtcagacctatttcatattttactttcaaataagttgttcctatttatagtatttatgcatacaaaacttaaatagatagataaattaaatgtttgatcaaaacccgaggagtcatattaatacttattggttgcatgtgtgcaagataaattaatttgtgcttgttctcagggataaaagtaataggtgtaacttttgtgtaaggaggtagtagtttcaaaattttacacatcatctatacccaacctaatatctcactcttacaatagttagttgtagatatgtactgtatcattaatatctaacacaagtatctctctcacatagtttattgaagttcgtagtacaactggctagaaatatgtagcccgtttttcttctctcttctccacataaatacaaatatgatgtgataatttgtatggtccgcttaaatcatctcgttgaattcgctcgctcttactccctctgtttaaaaagaatcaacctaggagcttctaggacaatgtatatacaccctatgtctagatacattattctaggaggtcacgtccccttccaagtaattcttttcgagacggatataagagtaaggctgtgtttagttcagcgtaaagtttggattttttgttgaaattggagatgatgtgactgaaaagttgtgtgtgtatgacatgttgatgtgatggaaagggactgaggtttggattcaaactttggatctaaacacagccttagggccctttgaatcgcaggattgagaaaacataggaataggaaaaacgtaggattttgattggaatgtaagtataaaacagaggattgcaaaacgcaggaaaaacacaggaatgaccgtttgattgaaccacaggaaaaacataggaattggatgagagatatagactcaaaggaaagttagcaagaggttgaagctcttgctaaatttcctccaaaatccgattgtccattccataggaattttaaaggattagataggatttaatcctttgttttaaaggacttcatagaaaatttttctataggattaaaatcctctaaaatttatgtttttcctccaaagttacaatctgttccaattcctttaaccttttctcccccagttctatagtgcccgattgtcaacccaatccgtttgtacgcacggaaccacacggcaaaaccaggaaggaaagctgcccgcgcccactgagaggtgggccccacacgtcggcgtcacgtcaccccctcgacctcgcatccccaaccccctccacatctcatgctcctctcctccgcctcacgcgcactcgccggcgcaaaaccccgctcgcctgaacccttcgccgccgccgccgcggtcttactccgccgccagctcgccgcaggcatggcggccgcgccggcgtcgtccgcgtccgcggcggggaaccgcgaggcgttccgcgtggcggtgaccaacacgctggagcgccgcctcttctacgtcccgtccttcaagatctacggcggcgtcgcgggcctctacgactacggccctcccggctgcgccgtcaaggccaacgtcctcgccttctggcgccaggttatccccccccacccccccactactacccgtgcttcttcttcttctcttcggtgtagtagtagtagtagattgggggagtggccaattttcggggtggggttcgagggggcaaaaggcgcggctgctttttcaggtttcggttcggaatcgccgcagttgagctgcgcggggagcgagcttactagagtgcttagttttggccatgctggccgtggccttcgcgagaggtcgggcctttgttttgcaacttgcgagactagtgaggtgttgtggctaagatgtgccgtgttgggattgttttttttttttttgttatagcagttttactacttgtggtgtgatgatgtgatgttggtatgtggtggttttgctaaaattagcttctactacctcttggggaaagatggccactagaagctccggagcgaagcctctccttccttgattgtgaatgggagggattagtctttttttgcttataggttaggaataattggtctggtatccttcatgtgtagatgtgtcggtcgacccggtatttggtatgcttcctcaatgtgggagattacgcggctgttgtatcttcttctttctttgttatatcgttgtaaacgattttgcgaagtatgtgggtacagtgacatatcaatagaaactagtgtaactgtaaatgttattagtggagaatggttagtgcccggtgttactcggatatatgtgaaataattcccctatcatcactgtcggtaacaggaaatttttttttagtactagattctccatagatgtacatctcagcatgtgccaaaggcatcattctagtacgtattatctttgttacattctgagaatgtagtatttatgcatacatcattgacttaccgtctactttggtaccttcttagcatttcgtgttggaggaggggatgcttgaggtggactgcccatgtgtgactcctgaagttgtcttgaaggcctctggccatgtcgacaaatttacagatctgatggttaaagatgaaaagactggcacctgctatcgtgctgatcatttgctcaaggacttctgcaaggatnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8261 - DNA, 1160 bp, Oryza sativa
taactcgttttcaagtatttattaagataagattactgatccaaataaaacatgaatattaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcacaatttcttagaaatgtcgtcattcaaagggacttggcttaaattattaggccctttttgacaattgacacaaatataatttgtttaaaaaaactagctatttctagttccagaaatctttatatctaaatatgccaatgtatttgtagcaattgaatgagttattctgtttgtgttttataaaaaatatacaatttcaattcattataatttaactttacaaactctagttttaaactgatttgttttacatttttatggtcttattttgaggctgcgatattatacgatacttcttacttagatttcccaaggaacatacggactttactaattattttatataaaattttcggtaaaattcctcaattccaaatgatatataacactgctaaatctgatatctcccatataaaagtgaaaaatataaagtgctcttttcgtggtaaattggtgaagcttatgcctttgatttgttttagttttcttatatttaatataatcagccttgttaggaaaaaacaaatgttttcgaaacataaaaagtattttttactactatctcaattttaaattaattattggtttagttttgtcttaagtccaaatatgtttatctttgaacatcaactaatttatggaaaatcgtaataatttaccacacatgttgacagagctcggggctcctcaccgggagac

SEQ ID NO: 8262 - DNA, 15771 bp, Oryza sativa
ggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggaggacggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggtcagcgagcgtaattaacgcacacacgatacgatctatctcgactgccacaaccgcatatctaccttatgcgccgtaagcgggcgaatggaatttagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttccttttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagcgagaggcaggctgggctgccgcgccgcttcatgccggaatccgccaccggccgtgagatagtaatgctgggtgagggacgcccggcgccagactacccggggcggtccgtcttctttctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccaccagggggtcagatgggattgggcccccgaggacttcaagatactgatccaacgggtgctaaatctcaactccgtggaggcgtccctcatcccccacggtatcctccccctctgcagcgacccagatcgcgtctccatcttgaccattatgacggcggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaacacctcccccatctcctccccgagggggcggggcggcgcgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacccatcttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggctcgtcaggctgaagaagccacccgggaggaaaccgcccgggctcgccaggcagaggcgatggcgtcttccgaggcggtttacgacaagaccgccggcgcgtcgctcgggcccactccctcgggtgacgctcaggcgacaacctccggggcggcttgcgacagggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcgtcgccaccaccgcgatgattgaggcgcaggactccctccgccttcaacacgggagctgggaggcggagctaaagaaaaagctcgacgccgcccagggggtcctcgacgccgccgctgcccgagagcagcgagcaacggaggctgaagcggcgtcccggcggcgcgaagaggcccttgaagcccgtgccatggcgctggaggatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcagcaggctgctaacctcgagacgcgagaaaaggagctggatgcgaggaagcgcagcggcggggcggctacgggcgaaagcgacttagtcgcccgcctcgcagctgccgaactcaacgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggcgaggacgacggtggcgacggggccagcgacccgggcgcattggaatgagcccccaggcccccgccaatctccaattttttctttttctttcttctttttgtatagatcaacttaatctgcaatcaaaaatgatgaaaaatttctatgttaactttgttttgttatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgcttggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagagagcttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcggagcaccggtactccttacagacctggttaacgaccagctgggaatcgcctaacaccaggagacggcggatccccagtccggctgccaccctgagtccggcaaggagtccctcatactctgccatattattggtcgctcgaaagtcaaggcggaccagatatctaaggacgtctcctgtcggggaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggccgtatccccggggcgttcttcgttcaagtggcctttcggggtgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttctcgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcacaggatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcctcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagttcgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaggcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcatgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccagaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaaattcatggtaaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggccctcacgtccatgtcgaggtgacaccctggacgaagaggcaccctccgttgcgcggggagcacgccgatcactacatcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcactccctggggcgtgctgccgtcgccgtagacgaggaggcgacgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcacactcggagagaggtcatgcgcctttgcttgctcggccattaggctgaacaagggaaacttggcccacacggaagagtatgagagctcagaaaacacacgctgagccccctacctggcgcgccagatgacggagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacacatgtgaattatatattatgaaaatattattcaagttaaatctggaaacataaaccttattgtgttaactatattagtttttagatttttagaaatattgatagtcaaagaccaaagtttgacttaggactacaaaactagaatgaacaaataacttaaaatggagggagtatagataatataatttttaataaggtaccctggagagctatcatattttttacatgtagtaccaaaaaatttacagccccggcatatttataaacgaaaaataatttgtgaataaaacttttttatatgtgtttttaatgatctaaaaacaaaggctgaaaaataaacttcaatgaagaaacaccaaaatcagttctaaatttaatgttgaaatttcaaattttagctgataaatataagcacaagtgaaaagatgaggcccctcgtgtaaaatttaggtatctcgagttaatttcttaaggactaaaaaattcaactaaaaataaacaagtttgtgggagtaatcaaggcttacccctgaagatacattgcgtacaagatcatcatatcatacgatccgtcaaaggcgtggaacacatacttccggcgaggccgtactctggccatggcggcgttgaagacgtcgatgcagtatccggtgatgttctgtctcttggtgtccgggttattctcacgtcgacgaaagcctggaacccggtcttccgcggcacggcgatcctcagaacctcgcctgatgacgatgacgatgatgaccttctccccgccaatcgccggcggtcgagacgacgaccagtcggagcgccggcgttgtagcggcggccatggggcggcgagccgcctgcgcgccgtgctgatgagaatatggcggtgaggatgccggtgagcgccgccttggctgaagtgtgatcggcgccgaacggcggcgccgtcgccgttgcatggtggggtggatgatgtgacggcggaggagagccgccggagatggggaaggcgaggatgggtacgcggtggcggcggcgaaggcgggcaaccacggccgtatgcgcttccgtggtgacgatgatggcctgcacctgtgcgttcttgataaggtcttcggctgcatacacaaattaacacaacccatgcacgtacctctagcataagttaatcacccacaaataagttaatcaaagtagagatcgagttagtagctagagaagaggtaacgggatgtaagaggtaattcttaagacggtattatatattttctagcgtaaaatttggtatatacattcagatactggtatcacgagatatcagtgtaaagttttggtatattttattgagttttgtgaaatttctctatatatatgataccttaatttacatgatcaaattaaattttgaattaactacatagtagcataatataacataacagtttggaatttaattaggtcccttaattagtactatctctgtcccagaatacttgtcgcttttagtttttgtttgtaactttttatctttcgtcttattcaaaaatttatagaattattatttattttgtttgtaatttaaagtactttaaagtatgacttctacatttttatatatgcactaatttttaaaataagacgagtggttaaacattacaagaaactactaatttggaacggaggtagtacatgatgagattcatttatgtgcatcctttatgggacggcagatccccatgcaatgcaacggcagattaattctcgcacacctttgagtgataaattagttggtgtgtgcgtgaaaatgcagtgattatatatatacacacacactgacattgagctatagctgttacagcagtggagaaatttcgtcgaaattttcggtttcgagctgaacacgatgacgggcttggttggtatagctccaactcctaaatttagctataggagttaggtctgaagtggagttgtaaagttacctaaacccagctctataactctagtttatttggtgagaaagctccactcagcttcacttccaattttgatggagctgaaactgtttgactgagttggagctgtaccaaacagacccaacgtttcaccggttcattttcttttacatggggaaagaatgtatgatggcgttttacaattgtttttttcgctggagacatatcactagattttattagttcttcgtatttcgatcaagtcagattgaatttatatatatatatacgtacgatcttatctgttactaaaatgatatgacaatgtttgcataacgtagcaactaggggacctgatattatatgcgtgttgcgttgcacgggtgacagctgggaactagaggaaattaaattaaggttcctagtcgaacaattttttttaaataacccattttcctatattgttggtatttaacggaaattaactcatataaaacaagacatacataaaaccacacaaaaccatcccacacaagttaagaatttagagtctagccaagtgtaatacacgtcctggtgctcaataaccacgagcacggctattcgaatagatttgttttactcacactgcattggatgtacactttacccgcactccgcgactgcccaacacatgagtctcgtcccaacacatgagacgcgtcacggcaaaacttttcgataacctcgcattggcagtacccgctccatgaacttacatcctcatgcactctaggcgtctatatttctagcagtgagaggagttctggcgctcccggggaagaagtctcacacacacgttaagttctctctcacactctcatggcagtcctaccaatggcgacaccgatgtagggcacacctcgcggccctacctcaacggctgccccaccgtagcgcatctgcctcacttaggggtgaaccatctatgcagggatactgcctccgctcggctatctaatccgctaggcctatacccattcaagaggtacggttatacgggggtcgtttcatgcttaacttcatggcttgatccttaattgacggggacggtagtagccttttccagataccacccaaatcctccgtccgcccagttgaaaacagttgtttagttttatttcatcttttacaaatcatgtcatcaatatcatggcaatgtggcgctcatgtctttatatgccgcatctcaattaccttcccaaaggtaattacctaagcatatagcatttgataaatataagtatgcatgattctagaatagcatttctaagcatttatcataattgactagggacttcatacgtaaacatggttacgaaggaataaggggtaaacaataatcaaggcatggcataatcacatgtaggatgttcatcattgcatgcaattttatttatagacaaaataatttcgcaattggatcaacatgttcaaggaatagtgatgacttgcttgctcaggatagtccttattcttgatataattcttgatcaaccttctcctcctagaagctgcatacgttgtctcacgattaaccgata

SEQ ID NO: 8263 - DNA, 3331 bp, Oryza sativa
ggctacacatgcatctatctaaataaaatggtcatatactagaggttttgttgtcagatggatttaggatcaatcaaataagtacagtgaatcatttgtattattgttttattgatggaggctttactttaattgttaacatattttatttatcacaataaattataaaaggttaacaattatccatgctttgtatgttagagttgtttaggttaatcatattatggttacagattatcccatcacgtagatttacaatgaataatcctaatttacaattgaacttagattatattaggtcaagatctataattagtatttatccactataattagtatttatccactacaaatgtttgtcatagactccttggtttaatatatgcaaaaggtagattattgttcttatgtatgattttaaatggattgtacagtatatgtgatttaagtgggttgacaagtgattttcctgtttgagtaattattggatgctaaccaactcaaccttatttgggtggttctatcataacaactctgttcctattcctcataaacaaattaaagactcatctatgtgtattcatgtttgatttacctaattataaggctaactttatttaaataactgataattcatgggtttaattatatttggacatagattaataaatggcactattattttcctatacatccattaatttgaaacattgattataattatttatgtggttgctacagtgacaaaacatgttaaagaccaatattattacatctactctactttacaatatcaatcctatttactagcatatttttaagttgaccaataatctaatcttttgatattaattattttataattatatatatactttattaaatagtgaattatataccattggaaagcttatgattttagatgaatttaggttcaagtttcactataatctgagttaaaatgagtgagttatgctagttcaaagttcctaattcaactaattgcgaaatggcactgttcctaatagttttatttttattccaacctaattattaacttactacgactgacaggtgggccactctatcctctcttttctcttctctttttctacctctctgctccctctctctcactctcgcggctcggctggaaccggtgggcggcgcggcgcaacgacgagcggtgggggagggggagactcaccggaccggcggcgtggtcggcggcgacgcggcgtcggggtcgatggcgaggcgcgtcggctgcttccgaagaggcggcgacgctggggatggaaaagagaggggaaagggaggggaggtggtgagggtggtgtgggaagcaacgggcggccgcgggggggggggggggttatataggcggagggggcgggcagtgcttaatgacaacggcgacgcggcgcggcggcgtggggcgggactcgatgcagctcggcatggggctcggcgctgcagtggcagcggggcgcgaggcggtatggcagcggcgcggcagtggcgatggcgacggcgcgcggcgcacagcagagcgacggcgacggtgacacgacggcgtgtggcggaaagggacgctaggaggcgtggcagcggagcgcgcagggcgacagcgacagtaagcggcgcggcagggcgacgacgacgacgacaagacggcgcgaggcggcgcggggcgcgaggggcggccggaaaaggcgcgcggcgacgatacgtcgacggcgatggatggcgatggcggcttggggctcaaggccagctagggcgtcgcagcagtggggaggaagagggctagggtggcaaggatccaaatcgaacacctaggggctaatgaacagtgctagccgactattttttttattttagagggtattttgccattaggaaaaatatactattgccaccatttttgtcacaatgtaaaatacaccatgtttaagttattaaaatttaatatagcacatatttttatttttattatatacttttctaatttctccattttccattcttttagggttttgcttaatttataatttgaggaaattttgccaattaaatgtgtatttaatcaaaagtatttgagtgacaatattaagtgttcaaatgtgaattttctccaaatttaatattgtccaatatttaatattatcctagatttttataatttcctatattttgggattttggtatttatctgttttcacacatattggtttatctttttagattggttttaccacaacatggatttctacaattcaatatttgtgattcaatacaaattatgtaatatcgaattgattattcccagtaaaactattttatagatagagctcgacttatttgaatggatatcatttcatgtgtatacagatatcatgacactcatcgcatggttcaagtatttaatatttaatccataaattaaattacttcttttgtctgactttgatttcttgtgcgtaaatatttatagggttcatgataaatatattattattataattattacttagttgtatagctttagtttaattttccattgtgacagtttatagtttggcaagcaatagtaaccataacaaccagcatgatgcaaaagttttaaaaagttcaaaattttagtgttttttattgtcgggaattttcaggatgttacactccgacaaggggagggcggcggcggcggcggcgaggcgaggcgcagggccggcggggcgccaattttttttgttcatccagtgcattttcgcaggcggacgattgtgccgtcaccattgttggtataaaggcggtccttccccccgcctggaaaaactacttttggtcgcctgcaaaaatattttttgtagtaggctcttctcgccgccgccgccgccgaccgccagatttggccctgtcatgcaattcggccgaggaggtcgttgccatatccgctgtcctccttggcggcggcggcggcctggcgcgctcgcgtatgatcgcctgagcgtgcctctcaccttcttggcgagatgtcgccggcgcaggttcgtcttcgtcgcgatgcactcgctgcccgggaagcggatgctgtatatggtggagaaggcgatggactggagctcgcgctgcgcgacgaacacctccttcccttccctgtagctgcgcacactactagagaaaccatctttggtcggtcgtctaaaatccacaatagtcccggttcctatttaaaccgggactaaagatcatttttagtcccggttaaaaactttttgatctgtagtcccggttggtaacaccaaccaggactaaagatcatttttag

SEQ ID NO: 8264 - DNA, 1715 bp, Oryza sativa
caataggtctatctggcgcatataacattgaaattggcctactttggacaaagagcgcatgtagaaattagttcttggttctttgcagatcctccagaaatacctgagagacattaggtatataactcactatagagatgttcgtcttataattaacactactatgatataacactaccacttaatactaactcgtagcagtgaaagatcttgaaggaaataccggtgacttgattaatgcggaattgacaaactgatttggtacacttggaacaagatcgagttgtgattttggcaggaactgcagtgacaaaaccatcgtgtttggaatgctcataggaatggaaacaaactccaggccggaattgcgggccatacagagaatgcgagaaagccctcagtgagctgggcagagccgatttgtatagcgcatcaacaaaaaaattaatcattcacgaaagaagaaaagggtgatccaggcaggggctaagccaggatttagagatagggggtgctggcacaagccttaagaactcaccggcgcctcggtaggcaatggtgtgaatcttggtggctcaaatcctgcagagtggcagattggcctcacctagtcgccttttgttcgctctaaaatacatagtcgcccctcgtataattatattttgaattttgtggctatttgtcatttgcactaatatatacataaaatgattgttgatatgattttggatttatttcaacacattcttctagattcatatataaaagtgaacttattttagaatggtgggtgtatgtctgagtccgaatgtaccttaatatagaataaaaagaaccatttttaaactaggtcactaaatagcaccaactttactcaatacttagaatgacacaacatcatttatattcatgctttttagttttggagacttgcaaccacatcgcgttatgttaattaactcaagtaattacttaaagataaaacctattagacacctagatataggctcaacttgcaactgattaatgaactaattgtatggattagatggctaatcacgcggggtttgcatgcaacgcatagggatgaggggtgccaggcccaccccggcacccccggtggcttcaccactggatccaggaagcaccaagggtgtggtggtggagtcgtgggtgcatgacttgcatgactccacccaccagggttcaaattctggtgcccataaatattagacacatgtaggtaaacattcaacaggatttcagtgatattatgaatgtgccgttggttttcgtctcttagcccatattttagcggacgtattcgcggggtgctgtgtaatcttatgaaaaaaaaaagcagaagaaaaaggtggcccatgacggcactcaccgttggcggtgagagcgatttgggggcggcggaggacgatgccgaccagtgcagcaccggggcccgggggaggaggacggggagggagggcgtacgtgacccatgagtagaggaggcgggctgctgccccaagggcggcggcgagccgcgcgacggcgcgaggggcctgcggcctgggtcgcgaaggggagaggggggattttggcggcggctacacctggtgcgatgagcgacgagatcgacatgttactctacctccgccctaaaaatatgggctgccttgtctttctcctaaaatttccggcctttttggataagctag

SEQ ID NO: 8265 - DNA, 471 bp, Oryza sativa
caatagtagaagtataaagtcagccactatataaacatatgttagtaaaacaagcacaaaccagggacaccaaggctcaaaaatttcgctccaggttctccattcaccagtcaccacggctctcgtcttgacgggacggggcgaggcgtgcgtcaaaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggaggacggacaccttaccctcgggcccgacgtcccgaaggtgccaggccacgtgggcgattccatt

SEQ ID NO: 8266 - DNA, 1395 bp, Oryza sativa
aatcaattgtcttttttaagaccaggggtatactttaatggctccaaaaattcatggattttgaaacgataccaatgcatgtgaattacaaggaggaaaagtgattatatttcacgtttgaacacgttgcgtgttacaacgagaggatgaaaggaggacgagtccgaatttaagaagagagtagagatatacaactgtactttgtatatggcattgctatcaatacttagttataatttcgtcttaccatgatttgacgacttacattttattgtaattttctcaattaatatgagaatttctaactttcgggcaaatcttggtaggtgaagtcaagaacgaacgattccaccgccatatttgtggtgtttcgccgtgttaaaactaattcataactcatctttttttattatataatttgcacatacatttgtttgaagtattaaggacaaaaccattttattttattaataatttcaagaatcaaaattactccctctttcatattagtcgttttgatttttttttcaactttttaaagttagtttgatcgtgttataaaaaaaagggaaaattggttctatagcatcgaaagattgcgattttggttttatagcattgaaagtcacaagttcactttgggagcactaaaagtttgctccgttagtgtatatagcatttacatcgggcttccgttactgcacagggatgcctgtctgcttccgtcaatcttccactcgaccgccggcggccccgccgtcgctgccatgccctcgtgctggagcagccaacgccgccgtcgactccttgagctattccacacggtcccgcccctaacagccaccaatcacattatcacaccttaaatttcccgtgtagctgcctggaatatcgccgtccccttaaatctgtcatcgagcaatccgccggcggcagtggtatagaacagacacgctcgaatgatgtgtatgtggtctggtcatctgggccaacgacaacaacaagaagacctctggctagattgactccgatcacaacccaattgaatcaattttttttatgtgcatgtgtagatcgtaagagtaactagtactagtatttctctagtcctgaactcctgatatgctccctgctcagcaagcagcagtcgagggggcctgaagctgcgcatcttgttgccgcttgggatagaaatttagaatgagaggcatcatggcttgtgatttctgtggagaagatgaagggggcatgaactgatttgtctcagcctgaccgagacacccgagacgaaggggcaccgtcgtcgtcagtttaacagaagttagcctcaagtatgacagaaatgctatatgcactaatggagcgaactttcggtgctaataaagtgaatcggtg

SEQ ID NO: 8267 - DNA, 993 bp, Oryza sativa
gtgaaatgggaggcactgtgaagactaaaagattatggtggaatggggttcttggatactaaggtcatgaacatatgtttcctaagtaagtggattcttaaattagaaaatgggtgtcctgacatgtgctttgagatacttaggaagtctcttcatccggtagattggtgatgagtggggagtcatctggcaccggatgtgcagcaagaaattccgccaaggcttggcccttaattgctttctgcggtacaaaagtgatatcatattccatcatgagcagggcccatttactcgatgcctggggaatcgacgtcatcggcctcatcgatccaccttcttcaagggggcatcgcttcatcctcgttgcaacaggaagaagtatttgagtaatgacagtttctttgagagctcagctataccgttgtctcaattttggaaagggatgcactattttaagaaatggctggaaaggttgattgagaaaaagttttacaatggggtttccgtgttcttttggaaaggtgtgtggtgtgggacaaactctctgagggttcagttgatttgtatgagattagttaccagcagggggctagtgtgagtgatgtttttgatgagggaattggaagtatgagtgatgtttttgataagggaattttagaaggaacctgaatgagcagaaagatagagatttatctcggaatatggatccgattgtttggcctcataataagaaaaaccttttcaccaccaaatcaatgtatagaatcctgacttttggtggggtgaaagatgccgggatgtgtgagatctgaaagagtaggctgcctcttaagattaagcattttctttatctggtgggtaggggtagacttccctgtgcaaatcagttagttaagagaaaatggagaggggagactgaattttgtaagttgtatgacaaaactgaaaccactgctcatattatttttggtaatcctttagcactttttacat

SEQ ID NO: 8268 - DNA, 1681 bp, Oryza sativa
tgaacattaaacgacaagacatgtaacagtaatgcgtagttattattggactataagggaatgaattcgtcagccgagacgcaatacatcacaaatttgcaccccgtagcaatacatcacaaatttgcaccgcattacaggggacgcgcctgttcggtgctaaaaactccatcgagtcaaaccatgcagtcccaatgatttggtcatcaccaaaaataaataaccttagcctgtagtaagaaaactgactgctcgatctactcgtattcgtatacaagaacagttctatatacttatgttgttacgataggtttcattaagtctctcattggatggcgtaatcagtcaaagaaaaagctaaattttaaattttcaaatttaattttaagattgtttttaagatattttctacgcagtttctttttcagtattagcttttaagtcaccaagatttacgtataaatttaattttattccctaataagccgttttgatttattaagtaataagccaaatgatgggaccttaattcttttctgaaaacttatgcttgtccagctcctaaacattacaatttttttttattttctgaaaactttttccatcaacttttatcagagaactttttaaactaatgtattcaactttctaacatttaattcatttattcgtactttcgaataactatcatgaacttattagtttcatatcgaccgtacgtatgtcaactataaagaacgcatgtacagtatagttaggagtaggtagatatagtacagccttgagtacttctgaatagtataactgaataactgagactttctcttgacagtttgtacttgatctatatatataatatacttgggaaacactctgaatttctgactggtttcatatatacaccaaacacacacatataaagtaattaaaaactgtcaactagctagctatcttaacagtgtattggtcgcgtaggagtatatatcctagctctagtttctacttaattatttaattaattagttcctgtatacatgtactactgcttatatatacacatgcagtacgttcgtctcgagatgtccatgcactgcgagcacttgttaattagctagctcgactaagctcttgcttaatttgcagtacattaatttgttgcacgtacgtaatacggcaatggaggagcaccgtcggttggctatggcggcggcgttcgtcatcctgctcacggtttggagttcgccggcgatggcaatggcggcggcggcggcgacggaggtgcacagcttgggccttaattgcaatggtaatgctaatatgagtgaagaaatatgatctaaacttatttgtatttttcaactttactagtacacattgcatatcgctgcatgcacgaattcaatatagttttatattatccccggatacttcggtgagcatttctatggaagtacgaattacactttgaattatttatataactacgttaaaattctatcccaatatatcgagataagtagctaaaaattttagggacaatttgcttatttgatcccattctagatattaactactaatctgactctatttttttttaactttgcctatttaaccatattttttaaaatcgaagctaccgtctgactaagttctccctacaccattagggtttcacttaaaa

SEQ ID NO: 8269 - DNA, 18674 bp, Oryza sativa
atcagcaaaccttagttcggtactcttatccatcccaaacccatagacctgacacttctaataagttgattttcatccctgacatttccttaaaatagaatagaagaaatttgagcaccaggatgttatgatcaccagctttaacaaaaagaatggtatcatcagtatactgcaagtgtgtaatacccccatcaattaaatcaggaactaacccctcaaaagttccactttccttagctttatccaaaatagccgtcaatgcatcccctactaaattaaatagaatgggtgacaagggaccccctatcttaaacctctgtagttcttaaaaaaaaggaccttactctccatttatatttacagacatcttccctccctgggttatctttttgatccacccaatcatacaagaatcaaagtttttcttctgcataacttcatacaaaaagtcacatttgactttgtcatatgttttttcaaagtcaattttgaaaatgataccagcatcccccctcatcttcagagtgtgcatttcctcatgcaaaataacacaacactccagaatattcctcctagggataaaagcagtttgtgaccagctaatcaccttatcagccacctctattaatctccgtgttacagctttagtaatgatcttgagaatgacattctataagcaaatgggcctatattgcttgatggtattagcatctttgatttttggtagaagagaaataactccataattaaccctatccacatctaaagcccccatgtggagatcatctaacatttcctttataagatatttgaattgtggccacatttgtttataaaaacccacaggaaacccatcaggtcccggagctatattagatttcatacttctaatcacagcttctacctcattcatagtgaaaggtctgacaatagttgttttctcctcatcagatagtctcagcttcttggcccaaacattatcatgcaagtgaacctccctgtagtgatctctgccaaaaagttttttttgtagtaatcatagatgtgttgttgaatctgcctcaaatctgtgatgacctcttccccctactgcaaagaaaaatggctctttcttttcctccaattagcagccatgtggaagaaagaagtgttggaatccccctcaaaatccaattcttaccacattttctttgccaccaaattttctcctggacgtctaattccttttcgaactcatatctttcctctattcaaattcaaacacctccttctcatattcaaacaactcctctcatataatctatgatctctgtcaatttctgttctaattattcaaacaactcctcttatatgatcctatttatttaccccgatacagcaaatgaacatgaaacatcctcctaaaataggaaaagagtgaataaaacacagtagcaccaaatgtgcacacatgaattatctaccattagtccataactagtagaaatatttaacagaagttagagtacaccattagtccataactagtagaaatatttaacagtagttagagtacagaagcaacaactagttgagtacactcacatcaagtgaaataatgcgatataagactagataatatgtatcaagtgaaatcacgctatagcatctagtttcagtgcaccacaagataaaagcagagactcttgccaatggcttaaatttgccacaataaagcctccgacgttgttgaagaagtatacattaccgtcacaagatgagatgtaaagagccttggggatttcaaattgatcaacgagaccaagcttttcccatgtttcacgcttcatgaatgcatcgcagcagatatgcgggtaccgtctctccagttgagtttttacattgaagcactgcccgtctctccagttgattagtgagttgcatcagtctgttgatagtacctttctcaaccaagtggactgaagcatgactatgcatagataatagcctattggaaatttttcggcagattttgcatagtagaaaagcttccttgagaaattgagggtgcaaattggccatgagcaggtattgttggacgtgcagaaggcataacttgcacggatggtgatgttgcttaagcagcagaggtaggaatttgcctagaagtagcgcttgctagagtaactgatgggttagcttgcacaaatgacaagattgcctgggcaggagtaggaagttggccagcaccagaagcagagcttgcttgagggactggtggttgccgcagtagtaagccatgggacgagtagcatttcttcaaagccatgggacgagtagcatttcttcacagaaacttagttttttccattctgactctgtaaaagccactttgatattggcagctggaatggagcttagtgaatgacccaatccaagcagaccagttgttgatagaaaacacgaggcctgggagatctgcttaactccagtgcaggtccaaaactcgccttcggatgtatgagcgtgccagttgatttgatcctgcaatcaacaagaaacaaagacaaagaaaccgtgattaaatccataaatgatagccgatcggctagatgccgatgacatatcatttatctttgagccgatgtcatgtgtaaatcgatcggcaattgttaagtaaacaaatcagaactaaatctactcgatcggctgtagatatcaacgatatataatccttatatcgatatataattgaatcaagtgattgggatagatcggtcactttgccgagacagtataaatcacttagatcgagatatatattaataatgagattatatatatattcatagcatagccgatcagatagatctaacgtgtatcggctaatactccaatactactttatattaagatattaaagcaaatagaatatactaaacataaatctaatatacttaaatgcaacaagatcttaacatagagggcagatctaacatgttaattgagcatgtaggacaaaagcaattggatcagataagatcggctgaaactccgatactaccctaatcggcaaccagtaggcaggctagagattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctaccttctggtaacagatgttagccgattgtaagttagatgacgatattgtcaaggattatgcaagatatatgataacttgacggattacataaacaagattagagtatcataaagatggaagcactaatctcgagaacacaagccgccataacaagttttacctcttgttgaagatcgaaaccgatgcagctcaacccgaaaacaataactcgttgaaataaaactaaagcaaaaagggtggcgatgcgccgaaattgtattgaacgtgtgtgttttttattacatagggctcgaggtctatttatacccgagaaatacaagatatgtccatattggacacgactcttatctctaacaaactctaagataccataagtctttgcggcagacttttgcccacatttatctctaaggaatttatataaaatatcctaattaatagatacaattgccttcccaggactctatccatgcgtggcaatcatcttgaagcacatcaactcgaacccaatgtcgcacacgggtcgtattgtcggaatcggctgtatcacttaaccagtccaactcagacttagccgatcccagtcatagccgatccggactccagccgattcttactctgtttccgaaaaaacccttatcctcgattccgcttcgatttcatcttcatctccgatgctgatattaccaaatttggtcgttaacaccagtacctttgagagtggggacagagggagtaagatttacctaggcccccacgtcgccctgctccaaggcgacacgggcagcgacgccactacccgctgccaccccctccctcctctcctcctccgcctcgccgccgcccgagcggccaccgacaaagctgggcgacggcaaggatggggcggcggggcctctcccttcgctcaagcctcggtgggcgggggcaacgccgagatttgagtggagggacgccggccgtcggcactatttccggcaccgacgaggccggtcgtagtagatccggccccttcgcggccaaatcgggcaagggcggcaccggcagtgccacttctggctcgaggaggaggccgtggtggatctggggaggtgagtccaacctcccgcggctagaatgggatgagattgacagcacggtggagacggcggcaaagtcggcggcgtgcacggcccgggagacgcatgctcgcacgagaggcgtatggcggcacagatgcgaccggtcggctggggcagccggaggaggaggagatgcgtgctgcggtggcaggcgcgtgaattgtgtttgatgcggccaacagagtaggaggacagcgtgggcgacggctgggaggccgtcgcgccccgcgagagaccggcacatccggcggcggtggaggccagcgcgttcgaaggcatcgaggtggagggaagcgcattcggcagcgtctaggtggaggccaacgcgtccagtgacttcgaggtggaggctggcgcgtcctggcaggtggcaaagccagctcggctagaagcagaaggcgaccccatcgggttgcgctcacggcaggagatgcaacgggtactagctgcgccaacggtgagttgcgggaggtggatctaggctggctagtgatggggcactagtgcggcagactttcgagttgatagaggttgttcaggcggcggagctccagggcagcgacggtacgggtgggtgtggacgtttgcaggtgaaaggctagctcgggactgcctgagccgataacggcaacatccttggatgttgtgttccctccttggggcgttgtcgagcagcctctctccccttcctcgataggactctccaggtgaaaaccgagtctagttggacgggcaacggtgatgtctttgttgccatggccttcttgaaggcgttgtctaggacgtctctattcctttccttcgccatcttctcactgtttggacgctggcaggtcttgttgtcatcatcaggttagggtgagagatgagcggatctccttctctctcgccctctccctctcctcaacccctctacgtgaggataaccgggatcttttcattgtctttcggagttaagctggtgtttggcgaggcgtttgtaacccccttgttggcctagtggcaatcggccacgcttagtggcggtcggcttggtgctagtgtcttctccagagtgctgtgtaaagagctgtcaacttgtggtggcggtgtgtttgttttttttcctggttacaatcttccagggtcgttaaaaagaacctttgggagcatgcactcccaaccaagtcgatagtactttgtaattttgacatagtttctacacatttgtgccaagatttttgtcaatgagatgaattgcggcatatgcagtagcatcttcaccaagggctgacagctcccgtctcaatatcctgaatacctcctcatatagcttggatatgagatgaaggggcataaactctagatgataaatgatcagcctgggatcgatatttgggtctacagcatatgctcttaccccttgcaggtatggggcaacaaggattgggggcgaagagagatactttttgagttggcaaaaagtctcttctgcctcctccgtccaggtaaatcccctagttatgttgagaagcttgaagagagggatagcccattctccgaggcgcgagatgacctgggctcccctcggcttaccatcttaagacgtagatctttatatgtctccacactccttttagggaggaatgcgtgacatacaagggcataaggggccccagatcccaaaccgaactgggattcgggctccccttgatttatagtcttaagatgtagatcttgtatttatccacactcctctcagaaaggaatcatgacatataagggcaaatgtgagcacggatcccaaaataagccgggacccaggctttccacggccttattctaaaaatgttgatcttgtaggtttttgcgctcttctcaataagtgatacataacctacaaggtcatgggagggcccaggtcctgagctaaggcagggattcgcgtcccgcacccctcaatctatgaaatcagtttatgtcgtgagatggggatcctgggactcaccctatagtaggtcccaagcccccttatacttattacgcgtcttagattaatactgatataagtacaccttttgtattaatcaatatggaatgctaggttcccggggaaatgggtaccgtagttcccatttcattgacaggccccatgaaggaaaaccagcgccttccaaattttgacaatttttccctacttcgtccataggtgtcaaatttagatgtaaacaacgtcgaattggatatgggcgacatacaaccaactcaaaatccgactcaaacatgcacgacatactaaaattttagtggaaatattttcaatttttataatagtagagataagtagtagtatatgtatacagacactaagtaattaagtagaaactactagctaggatactcctacgcgaccaatacacggtttatacactgtctagttgacagttttttttgtactatatatgtatttggtaacgtagccagccagtactcagaaaattcagagtgcgtgtttccagaggtatagactgtcaaaagaaagcctcagttattcagttatactattcagaagtactcaaggctgtagtataaacatgcgttacagaatgtagaaataatcaatcatttgactttgacttgaaatttgaaaggcgtcccattcattatatatagttgacataagtacgatcgatatgaagctaagtttacgataattattcaaaagcacgaataaatgaattaaatgttagaaagtcgaatcattagttttaagaagttttatgataaaagtttatggaaaaagttttcagaaaaaatcgtatggtttaggagctagacaaacataaccgccataaaatctctactattataaaagttgaagatgtttttgccagtattttttttacgtcatatgtgtgtgagttggtttttaagttcgttcgcttttgaaaataaatatctgtatttgagtcagtttttaagttcgtttgtttttgaaaatacaaaaagagttgtataagaaatctcttaaaaaaactcgcatgctaacttgacacgattgaactcctaattgtaacttatgattttctaaaaatatatatatccaagcgaattctcacagcgaattttaccttaactaagccgcataacaataatagattaaaatagccttcacccgttgcaacgcacgggcattttttctagtaagctaaaaagaatgaaacctatcataacaacacaggtatatatagaactgttcgtgtatacgaatacaagtagatcagcagtcaaattttatttcttacaggctaagggtttttatttttagtgatgaccaaatcattggggctgcatgatttgactgaaatggagtttttagcaccaaacaggcgcgtcccctgtaatacggtgcaaatttgtgatgtattgcgtctcggctgacgaattcattcccttctagttcaagaacatgaatgttctactactttctactgttacatgtcttgtcgtttaatgttcagtgtatttggactatgttaagatgcaagtaggacggactagcaggttttataattcgtctattctaatcataattatagttgtacctatatctttattcatggttatataagtagattaaaattgagtgtatatgcgagttgcatgtgtgaaaacgagtgttgccaagcctaggagaaatagcccgacaaacaagacacaaaacttacattctctatttcagaaaaaaccagtttttgaaaatatatctggacataaagctatgtttagatatatagcccgaagttttttttttttacagaggaatagtttacaaatatagtggcatgccaaagtgaaaacttttttcataggcagattaaacatgggactaagaattttcgcctgtatataataagcaagaatttaaatatgtcaagttgcccaagttgtatataataagcaaagtagcagcgccattttatctgcgatctgttgtttctcgttagtcagtagatgcacggataaaagcgcccaagcaaaacatcaagtgaacatcattcagcatgaatgtgatatagttagtgtcaatctagagttttagcgcagcttacaattgaccaaataaaggttcgtttcaaaaaaaaaaaaatctaaggtgtgtttttttttcacacacgcactagtaatacaagagtatatacattgccttcgcaaaatagaaatgattattacagtctaaacggttggtagagaacaataatttcaaatgataaataattaaatattgacatgatcaattactaaaatatgtacagaacgatctaatccacggccttcctgcattaatttctacagcatattggcaaacacctacaaaaaatgaagagacgagtcattcttattttcgaagttccagagcacgctccgtgtgacagtgtcaacatctttttgtcagtattcatccggtctggctggaatttgcaggcacagagccattctgaattggtccaggctcttcgccgtcagcacgttcgacactcccatggatatcctgggaactgtcaattctgatttcatggtgaggtcgatcatccacatagccatcacccatgacgttttgtgctgagttacgttcttcgcgacctccatttccaccatccgcatcgggacttcgcacttcagaatctctaattctggtgtaattggcaagaactgacttagaaatgcttatcatcagcatgagagctgagatacatccagtgatgatgaaaagaccagagaaactctgcaatgtaagaggtgtcgaatctgtgttaggaattgcatagcttggaggggcagccgttgtgccaaaccattttgcttcgatccgtgaaccttcatccccacccgtaacatccaatatggcagttgaaagattatgcaccaatggaaaaccaggaggaaacgcctgaaagcaaaaaagcacaatgccaattagtccagcatattttgtccagaatgtagtatatctcttgaaggctgaagagcgaatccatggaagcaatagagtcaataacgctagtaaataataaatgggagttggggatttgccccatcactttatgtctcattctcatttatttttatcttcactttttttttatcaaacttatggctgtgtcttatgacagaagcaaataaactcattctcaatgcaaataatccatggaagccgaagatgtaatccattttcattatctaaaaaaatggaagcaatagagtgagagtgagaggcttacaaaaccaaatccaggcgtcttatatatgcggctaagcatctggaattctttctcgtaacgacggtccgaaagaaaagaggttaaatatgggatctcatcgacaatagcagacacacctccattcatggaccccttcctcaaagcttcagcatattcttgtttctttgtgtagggtcttagccttcttttactgaaaccttgttttatcaaaaaggattccacaaaggatccccgttggtatccaacataatcaccatcaaacaggatctgttcaagatctgtctccgagggccggagcttcttcgcagttagtatggatgacaagctagctgtgtagctctgcacaagaaccagcaccacgaagcaccagattaccacaacaatttttgacaaaggacttttaataatgtgacctgtaacaaagacaataggttatttaagaactactgcaagaaactaaattaagccacttatagtgaatcaaatatagcctgcaatttggagctctaagtactaaccatgagaaaatgtcaaagtggagaaagagaaatagagagcagtgctgaactgtcttgagcttgatccttggtactccagatttctgggacgttcaatcatccaaataactatgccggtgaataagaagaagatcacagtggcaacccaaagctcccttgttagtggcttcaagaatacccattcgattgttgatttagagtcattctccatgagtacaagcattgacacaccagactctgtgtatggcatcgtgaagtctgcatggatggttcgctcggcagttattgttacatcccccactgctgcatcatagttctggtagtaagaaccagcagacataatgtaagtacttgattctttgattatgatttgcaagcacagtaagtaaggctcacccctgaagacacacgctgtactagctcgtcataagaaccgttgaagacaacaaacttataactcagatggtgtggtaacttcttcacggcagcctcaaatacatcaatgcaatagccaccgacacttctgtcagttacattcagaaaagctttaaaacctggtttccatggcactgcaatcttgagttccttcccatatcctctaggtagtgctcctaggtctctcctcaccccagcattagttctcttggtttctggatgaaaaaaggattggttcatgtccaagtctcgtgtcctatgagcaaaattgaacatagcacaacaatagcaagaattatttgtgtctatttgcatgatagaaggaaggtcacaaatttcctaagcaatactgttaggtacagtccataggagaagtgcatatggcaaatgaaaacatttccctcggctatatttttattgataatagtgactaacgcaacaggttatatttttcttttttgaaaccactacagcaggagctctgccggatatattaagagggagaagcaaaagtctggcaggaaggcaacattacaggagagcgatctttgcggcaggagagaaagaaacaaaaaaacagtgcctcaaggagggcggaaaaaccagagcacgctactaaatgttcttctatttggttcaagccatatattccaccaagttaagccccccaggatttgcttctaacagaaccaatgcaaggtcctcctctttatcatcaagggtaattcagatttttacatcctatcagaggtatgcaagtgcactgtttttttcttaccattcaatttctttgtgtatcacgggtggcactacctatatttggctcactgaacattcagctctcatatatcgaatgattcaagattaaatccctaagttagtcctcctactattcactactaattttatcctaaattacttagaagtcactaggatacttctacatagcaataacaattcacaaactgatcctgcactagaaacaaaaccaggatgaacagcgaacctcctccaagttggacggatggggccatggccctgcgactgcgaggcttggtacggcggagccgccctgcatgcgcgcacgcgtgctggaagacgggagctctgaacccccccccccccccttccgtcggcggcggcaatccctacttgtcagacggcagccagcagccagcagccggcgccgcgccagcgtggtgtgattgggggtggtggggatggaggcgattggtgtagaatagcggttgtcgcaaccgctaacgccgccgcgcgcctctcctccattggagtgcgccggcggcatcaccggagggagtggacgccgacgaaggggttgcggctacggatcacctatctttttttttctcgttttcttttacgtattactccgtatgatatgatataaagttttacaaaaatcacactattgataattttaatctttgatcaaccatgattttttagttatacggtcacaccttaactttatgagtatttttatccatagtgtaaatatacatagccttttttaaattttgaagttttttttttacattttgatataagaacatatataattagttacagtttttgtgaaactttataaatataatatatggatttatgtgttatgtgtcaataaaattttggttttgtataacttgatcataatagataagatttattttgttaatactaggggcatttattttcctctcttttctaggtgccctattttttctcgaaatattgtgttgtttaagtacaaccgggccccgcggccacatgtcatacacatggcaaaacagcaaatgtatacgtggcacgtttataaatctccgttttgcctgttgcaagaactaatcctatcgttaagactgctgaaatctacctcggatgagtttcaccgctccttaggaatgtaggaaattcgtcggaatttcagacagtttagctcgatttctctaatattctttcgaaattctcccgttcaaaaggaggcctacaagatgaagtgtttgatgaattggtggtaaccacgagcctataagggcagtcccaacccatagtacccataagcagtgtctatggtgtcatgtcaataagacatcataatagaaactacactctacaacccatgatttcttaaagtggaccattaataaatgtatcatctctcttttctatcagtcatatttattcttcatctattatgaagacactattatctcccaatgcaaaacttgatagtgtctagtgcataggttctcgtgttgaagttgtgtcttgcatgagacccaatttcttcctctcttcactctctctctcttaattaatatagtgccacacaagctaaaagtgctatatggcaatgtagttaatgtcatagacaccatcctaggaggagggttgggactgccctaatgatagccgagcacttttgtgtttctttattttgggcagaaatccataagaaaaaaaatagtatactactctactttatagtaagttagtcgtggttagacacatactaaaacttgaatgggaacacgaacatagctatatccacattcgaagtactccaatttagaactaggttaccataatttagaacggagttagtagttggttctattcccatttgcataagtgccatcatttagaactgaatattttgttttagcatgcacaaaaacattaacatgtacttagaacagcaatttcagtgactcactattacaggtctctaaatgtactactttttacgttctaaaacacttatcgtggtttattttggtacggagggaggatatcagaattcagaccaacgagcggttaccatcgccgtgagcagccgtgatagcacccgtgcgcgaaccactgccattcgggtccaagcggtaggcctccaacgccacggaaacatctcctcccgtcgtcgccgccgccgccgccgccaccgccgaactccaaacaacgagcaggacgggcaccaccgccgccgccgccgccatagccagccgccgcgcctccattgctggtcaacttacataccctacactacagccagtggtggagccagaaatttaaacatgtgggatcggtttgtttttaagtggggtcatttctctaatttcgtttagagaaatgactacagctcgcgacgaccacaacgtacgtatatcgaactacatgtacgtaggtagtatgtgttaaataggcattgggaattttgggatcaatcaacacgttcgcccggtcttgctggactatttctctcctctttctcttttttttttccattttgttgattaacgtgtgatttgtgtggctgtgagcagccagtcaagaaattcaggatgcatatataagttttttttttccatggtccatggagatatcagaattcagaactgtatcagcaacagtcaatcatttgacttgactccaagggtataatgacacacaagttggtacagaatggttcatagctcatatagtcataggagcacgatacaagtcgtagatcattcaatcttgtttttctctgcaagcgcttaattagggcttattcgggcatcatatgaccaaatcattgggatctaattaattaagcttgcacagttgcactgcacgacctgcatggtttgagtcaattgagttccacttccactaggcttgtatagcatcaaaccgcgtgtgtcccttttaaatttcttctccttccagaaacttggctactagttcaatgttcaggtctactgacatgacagagatctgtatagttctcccggtttacattgacatgagtcactgaccgagctgctacaaatttttagttccacagagaccaaagaaaaccaggagaaatgtaatggcgcggaaaagaatgcacaagtttagtttgcaagattcagtggcattgtgtcaaggtaaggctgtgtttagatccaaagtttggattcaaacttcagtccttttccattacatcagcctgtcatacatatacaacttttcagtcacatcatctccaatttcaaccaaaatccaaactttgcgctgaactaaacacagcctaaatacaaagtttctcgttacaaagtagcactgacattagctgtgagttttagaatagcttacagttgactcttgcccaagaaaaacttcgttcgtcgtgtttgtgctatattacaatcattgtcaatctagagttcttttagaatagcttacaattgagttttgtcccaagaaaagaaaaacatcaactgaacatcgttcagcatgtttgtgctacattacaattatcattacaattattgcaaatctagagttttagaatagctttcaattgactaattaaaaccaacagaagaggcttacacagttaagcaaggccatgcaacaagcaggccaaaacaagtgaacttttttctagcttcagagccattctagtgccttgggagttgggatagttggtgcagataactgttcacactctttatttgttttcagtcctaatctggagggtatcagcaggcacaggatcgtcgatcgaccatgacaatctgcggtggttgtggttgagcttcaccgtaacaaacaactctctcgccactatggacacggtctgaaccgaagcctctcatctctttgcatttgtcatatagaaacttgctaaagtttatcaacagcacagcacctaaaaggcacccgacaatgatgaaaagaccttggaagctctgaaaactgatacgtgatgagcctttgctgtgactgccataataatccaaggacgaatccatgaaccatgtcttttcaatcttcaacctttcaggttcttccgttaagctcaagatggcctctgaaaggtctggtaccaatggagagcctttaggtaaaacctgtcgaaaagtaaacatatattgtaaagccaaggcagaatgctcgaagatgcattatactaataaataacaagtgcaagaagcttacaaaaccaaatccacttgttctgtcaatggggccaaccatctggaactccctcccgtatttcgagcagaaagaatttagatagggtatctcatcgaagatagccgaaacccctccatgctttgatcccatccttaatgcttttgcatattcctcctgcgtgctataaacctttatcttgtggtcatcaaatttaagcttcttcagaattgattgcacaaatgatccactttggtgtccaacagaatcaccattggccaaaagttgttttagatcagtcactgaaggttggagcctctctgccgttagcattgatgacaaacttgctgtatagctctgcaccagaatcatcaaaactaagcaccaaattaccacaacaatttttgactgaatgctttggatcttttgacctgtccataggattaaaaaaaatagattatcaaaaatcatagtagtatcaaaacaaattacagcaaatactgaatcacagtagcatatgatagcatccttaagagtctttcagctgacccgacaaaaaacaataaaaaaaagcatccttagaaattaataagttgaatgtacgaagatgtatgtagttatgtattttatctattcaatagctaggtctgtaatgacataccatgtgaaaaagtcaaagtggagaatgcaaagtagaaagcagtgatgcactgtttccattttgacccttggaaatcgcgatttataggtctttcaatcacccatacaactaggcctgtgaagaagataaagatcatagtggcaatccataggtcctttgctagtggctgtaggaagatccatgtggttggttcatcgtcactcttagatagaacaagcatcgaaacaccagactctgtgtatggcattgtgaaatctacatatctagttcggttagcaataattgtcacatcaccgactgctgcatcaaacttctgttgcacccagggaaacggaaaggcaacaagtaaattagtaataatgagtttattcacaagggaaaattagttaagaatacaaaataagcagagctcaccttgtaaaagacctgggatactagcaggtcatatgaaacagcacaatcatagggaatgtactcgtagcgtagagcatacggtaatttcttgacagctgcctcaaacatatcaatgctgtagccactgacagttgatctattcgtgttcggattagtctcaacattcacaaaagttttaaaatcacgtctcactggcacaccaatctggagtatcttagcattcactgggaagtcccagcctttgggcactgttgttgaatctccaggccaaacgatattttccagatcagaagaacttgtgctaaatttagcatcaccatggataattctagagttcacagacattgtgagtccagaatcaggactataaaacccgataactctagttttctctccaataacattgacaatctcatatgtgggaacctgcagatgtctatcgataagcctgaattgtccagccaatccatcaaactctccttgcaaaatggaattgaggagttctggaccagcaggcaatgctgggagatcatctactaagttcttgcctatgtttcccggaggatgaaaagttgggttcaaagatctggtcctatgaaccttctcagttgctgttgcgactgcccatgccacatcataagcccataattgaaagatagtgggttttgccatcctaatatcagtatttggatggtacttagttctgaataaggtggtaaatcgagagctgaaatcagtgatccttgtagattctgcaatatatggccggaaaccaacaattccctccatgctttcaatggaatgttggggaagcacatcaaggacaataccaatgctatctgtgacaatccagacataccctttagtcatcataccgagtgcttttgcccttgcaaagaggcgggaagcacgggctggcaacatgtggacaatgaagacacgcgtctgcatggtcatgagcttgtatagttccacatctatatggttattgggggaataagcagggaaggcagaacggttaatgacattaaccccgacaccttgaagagcatcggtaatggaagggaggatgccaacaccataattgttgtcttcatagacaagaacaacatttctccattcataggctttgacgaatgcagcaatggaggccacctgataggagtccttggaacaagcacgaatgaagtacgggacatggtaccgagtgactgcatcaccggttgcagagaaagtgatgacaggaaccttggtcttgttcgctaggtaggtcacaaattctgcttgtaaagtgctctgaggaccaataacaatggcaacattttcattcctgatgagatctattgctgcaggatatataaaagaatgatcagttcaatgttcaatacatatgccaactgtgcaaaatatatgctgtataaccctttccttacatcgaacactccaagatagcacatagaagaaataaatcaatagcaaaatttgaagaacatgtaacaccttaaccaacatgtgcaaatctttctcattctacccatatactagcattttattccaacggttccattctactagaaaacaagctatgctacatcttagccagatttactgcctgatgaacagcaagaacgatctaacctcaccaacaggcccagatttacttcccaagttcaaggaactaattgatcgctttcgatttacaattagttgcaactagttcatgacataatcactgaagcaaagcaatctacctggatcgatggattaaatctaagacagggtacggttcagtaacagatccaactgaaaactgtttggatttggttggctcaatcaggtttcgcgggagctcataccagcgcagcgaacagacgattccgctcaaaatcggtgcctggatcctccctccttcgccaatcgctgcctccgaccatgactccgatctcccgatcccctccgaatcaagtcgacttttacacggcccccgcgagtgaatcccatcagatcactgcttttccttccccagcgacaaaaatcagcggcgagctgaaggggcggacg

SEQ ID NO: 8270 - DNA, 1891 bp, Oryza sativa
ctctaattaagatatagatttttttctcgattttcgttagcatgctttttaaactgctaaatgtgtttttcgtgcaaaaactttttatatagaagttgttttaaaatatcatataaacacatcttttaagtttgtaataattaaaaattatttaatcatacgttaatggttttctcgttttactagacctaactataattcatcttcaccaatttcaaacacatattcgcctctgccaacttcgcaaagtggctaatcaaaatgcagtgacagttcaatgtgcctccttgaaatgagggattggcaaagaaatattggagaaattatttttctatagaacctttgaaggatatgaagatttctataggattgtgctcatatggttaattatatatgaaaataaagaagatgttggatctattgtgaaacttttctctctttttttttttaatttagcgatgccgcaagagtagccttcttaccttctccactaatatcagtacataaatgcacttcttttctttattagtgaaagagatagtcttcctgctttcttattcgaatttttttctataatatatgtaatcaaagggctcctttctccgtttcatgtgctcttaatttctgcatggttgaaaaaacatgtactactttaattcatttttctttttcttacagcgcagtgcagtatgtgccaactatggataggatttgcttgcatgcaaggtagcagggataataatttacacatgcacatgtgtgtgcaagcagtaaccacagctcccaacgaaaataaaatccatggattcttgggtatcatgtgcacttagccaggcaccagctggctgattacactataattatcatttttcctgaaaaaaaaggacctggaaaacttaaataaatccctactgacataagttggcctattcatgcatggtcagtctgcagaaccttaaaactgttcttgcacggttatcatatccacaatctaatatgcccattggatatgctatttaacattcaacagaaatttcgaaaaaaaaaatatgtcaaattttttgaccatgtggatgctctttgagatgcgtacagacaggcaaagaccacaacaacactaggctaccgcacctttttttttaagtacaatgtaaatggagatttgctatatatatttaacatttgacagaaattttaggggaaaaaactgtcgactttttgggtgcggggatgtgctttgagatacgtacagacatgcaaagcccaccgcgacactaagctacgcacaacacctttttctaagtacaatgtaaattgcatgcaacatatacaatgtaaattgtattataatttcgtgcaagttgtaatataattacattataattataaactatagcatagttatatatttagcaaagtttttttaataatatataaacaggccaataaaattatttaaaccacactttgtagtttctattttttattgtcgttgcttgcatgcaaccaattaatcctcatgcaaaactaggagaatcatttattttgttagctttttttttagctaaccaagttcacgtgaatgcaatttggcaacaatatcgtagacaatggatcaaggctggctagaattaactgatcaaagtattaccacttgatcgagagaggtaagtgagcagcttaaaagaactattaacagtccaatgcatggattaggtgatagattcttcctttatatattgtactggggtgcagtagagtgtttaattaattattgcacgttgagttcgatccatctgtatttgggcttacatacgtgttaagtgcattttttaatggcctcttatgtattatggattattatagaaatatttttctaaactgtatgatt

SEQ ID NO: 8271 - DNA, 7828 bp, Oryza sativa
gttcataataaatcatacattagaactttagaatatgtattctctgtcctcataattagttaagctagtgttctggccgatgctcagtctgatgtctagtttttagggggtgtttggaagaaagggactagggacttattttttggagaaagggacttaagtttagtccctctcttctaaacaccctcttagtccgcagtccgcacacttttcaattttctcccaataaaaaagaacagaaaaactttttttagaagaaaaagaagagcagcgacaactgtcatcacatattaccagccttatcttttttcacttatcacttatgcttatatatacttatcagtcaaattttaaatttttaaccttttattcggagtcgattttagagttttttcatgaaagtttattttttacccttgatttttagatcgctacgagcacatatataaaagttttattcacaaattatattttatttgcaaatatatcgtttgtcttattctttaaataagccaaatgatgggaccgtaaacaacgccaaatgtaatcacgtcattaagtaaagcacttcatgattaggcgattgcttagtcacttcagtactagagctagcttagctaccaatgtcgtcgaagtgtcgaagcaagtgtatatacctgcagacgcggcggcgacgacgtcgccgcgggagtccctggcgcgcagcgcgacgcgggtggcgaactccgggtgcgccgcgtacacgtcctccagcgccatctccatgctcagcatgctcttcttccccagcgccgtcgccaggtccagtatcaccccgacgtccaccgccaccctcgccgccgccgcggccgccgccgccgttgtgttgccggccgccgccgcgacaatgagcagcgggaagaagaagaagaagacgacattgagactacgacgacggctgcaggtagcagcagaggaggctgcttccctcctggagccaaataagcctctaggctccatctcagtggcagtggctgtgtacactactacactggttggtgccactcgctagctgctagctgtacgcctggcaaatactcctacatgatggtagtacttatatactgctatatgcatatataatatggtttcaaaaaagaatatatgcatatcttttctctacctctactattataaaaattgaagatatttttaccggtattttggcatgtcatacgtgtttgagttggtttttaagttcgttcgcttttagaaatatagatccgtgtttaagttagattttaagctcatttgcttttggaaaatacaaaatgagtcgtataagaattttctttttttaaaaaaacttgcatgctaacttaagattaaatacagactttatgattttctaaaaagaatatccaagtgggttcccatagtgaattttatcctagctaaaccgtatatataacaacaataaaattaaaatagcatttacccgttgcaaccgacgggtactttttatagtttaatataatgtatgtgattgttgcccgatagacacgatgtagagatcgatgactattgacttaaccgtgtctaatggctctatgttgaatagtataccgtatcaagcctgctaggatcgaataacaatatgtttatgttatatatatttattggtttgtttcatatgagtgctttgtctctctatatgcattcattatgaccgaacaatgcaacacatattgagtgaatctataccgatcttacagagaaataacccgcatacaccgccgctcatacatggaaataacattgtagcatctgtacctaatcgttgtacaagtgtgtcaaggtcttgtttgagaatattaagattctgataagtagcaagtagccaactggttatgaactgaagaagtagggtcttccaacttattgcattttctggattctataatttaagtgagactctgaactatttatacgagagagttggaggttctgcaacaagctagctagctaccagaagctcttgaaacaaaggctgatcgagtaattaacgtttccgggtaatctccaaggtaaggatttgtctttttcatcgcggctgtttgtgagacagcttctattcggtttaatttcctactagcaagctgcttgtcagtatgacaatatgtactagtaatatatacacccactagctagtccattacagctaactagctaactctgaagttaagtgagagcatgcattcatatcgagcagcatcgctgaataagattacttaagaaaaaaataaagatttaggcctcgtttggctgcctgtgtatattatacatgtgtgaatagttccacccgtgtattgagtgaatccacaccacccacccaatacacagcatgattcgatataagggggggctggtggttcgaccggtaatgcccaggtttgactccacagcaagtacgtagtgctagctaagctaagggtatgcatgaagagttgggcagagctaggtttaccttttaggtctcgtttgttaagtaaaaaaataatataaaaaatacagaaaaacctaagaaataaaataccagaatagaaaatccaacatgtatatccatctgtaattctaaaaatcctgctttaaaaatttaaaaaaaacacaagagtagaatttcacaaagaaaatagagaaattaacatgcatgcgcatggatgaacttgttactgatccatgaaatatttataggtgaactagaataattgattcaacacaaatcttccaggtagaaacagcacacaccagacatacacatccaagcatatatgacagtaataaataactttgatagctaagtctaccacagaggtttaatttaaagtctactaggtgttccatctatgaataatttctttgacatgaaacatccaagcaaaagatagacaactccaacagcagcatatctccctactttccattgcatcttttttccatgcatcacctgaaacaaagtacaaggcaaaagattaattggctccatatctgccgtggcaaactgactgctagcaacagagagaaactagagaaaagagctaataaggaagcttgcaaattcctaggacaagagcactaagggtgtgtttgaggagaaggagattgggaagatacgcaaaacgaggtgagccattagcgcatgattaattgagtattaactattttaaatttcaaaaatgaattaatatgactttttaaagcaactttcctatagaaatttttttgcaaaaaacgcaccgtttagtagtttgggaagcgtgcgcgcggaaaacgaggtgctttctcaccctatatcacacaaacgaacggagcctaagggactaagaaaagttggagcaagatgaaattaattgtgcattttacaagctatatcttgataaataagtagaaatgcttatattttggaacggatgtagtacatttaaacaaattcactctgtgcatcttcaaatttgaataaataagctcactccaagtatcagtgttatcattcattcagcaaattcaaatcatgctttcagagcccagtactgctcacccggagagagcaacaataatatattagaatatatgtatataaaagtttacactccccaaaaaacaaaagagcatgaataatatgtaaggcataatgagcatcatttttagcataaataatacacctgcatctcaggtgatgctacaatgtgaaaactacaaatgtatcatctgccaatctgctcaacatttacccccaaaaaatagttttgctgagcatcactgaattgaagttttaggtgatacaacaaacaaaatccaactgtttaatatgattaaagtgtagtactaattaatatattcatcagtttcatagaggcaataacaagacaaaaggagcagtaccagatttacgcagttgtaatcttcctccttaaccacttgagtcgtgtagagtcttttgcaatcatgaaaatggccatgttttgtggatctttgaagacatcataagccaggaccttctcatcatccgacatatcttccatgctgtccacaacagcaatgcatactgggatcgggaactcatcctcatgcacattacttcttgccctttcctgctgcataatttcagtctcggcttgcttctctttaaattccagaaattttcccatcatctcaacaactttcccatcctggcgacgcctttgtgttgccttttctgttttgtcacttgtaccagcatgcttgtttgttgcacttgcaactctttttcccattcttgaccttgtagcggcatcacttgcaattggctgttccactattctcaggtcgtcatcatcactttcagcattgtgtacatgagagtcaaaagggaaattctcatcttctcccatataatgttgtgtgacagtagcttgagaagtttgagaaggctgtgtgagaggaatatgagaaggttgtgtgacaggaacttgaaaaggctgtgtgataggaacttgggaaggggcaatggaggtgaagttcatggttctctcggcagtgtcccacaacagaaagtgaagtcaagtaatgtttaggagaactgaatagaacatgcttagctggtaggaaaataaagattcaacaatggtgacataccatcatatagctctcctaaagcctcaaacaatgggaaagatttattccggaattttttggccttaggatgagactgtttattgaataccagaaagaaaagtaattagcaaatgaaattaaagcaagaactatatttaagaatttaacaagaattaacagcaacgagagacaagaaatctcacaataatgatgttattccaaacagcttcatctccttcaatcctgcacagcttatcatcctaggacacaccactttgttttctcgcttcttttagaactctatattccctcttcaactctctctctttgtcttgaatttgaacctttgtaaaattgacataggggaacttctcatggaaggatttgactattcagttccatgcttctgtggaccacccattctgactcctatagcagtcgttgttgtgatcatgtagtaggtcaaccaaagctttttcaagtcctgcattccaactagctcttgaacgatcaagtacagttggaatagagaaccacacataagctacagataattacatgtttttaatctatcaacctactgaacttgagaagcccatatgtgcatttaacatgacaagaaaaagcccataccttttggcgatgcctttttcttttgatgtcttgaaatctttggagatggctttctttggacagctgcagcttggattaaattgaactttggggaccctcttccaaatattgttgctgcgaataaaaaaaaaccgttatcaaatttaagcatgcaaaaacatcatgatgcaaatacaaaagcaaaatatttcatgagaccagttaagactcacatttattaagacaagttatgactgtagtcattccacatatttagggctatcatatctctaaccgtgtttccatcatctacttgactgttaagggacatcacatcattactatattcgtcgtcaccttcagggacatcaataaactgttctggagatatgttgcttccttggtgattgaaccaaccctcatccccattaagcatccgtataagattgtagaacaccactgtggcaactggaatcttcacttggttttcaatagaatgatgcgttccaacttttaaaatagggaaccgtttcttaagaacaccaattgctctctctatgtgactccgcaatatggcatgcctatgattgaacaactccttataatttcttggtcgttgctgtccacgcccaaattccttcagatggtatcgaactccacggtacgatgcaaggaaggatggcgtgttagtatatccaccatcaacgagataatatttgccttgaggcacattgaatcctttaagcatggctgacctaagaaccctagcatcagttacagatcccttccatccagatgatataaacgaaaaatttagatcaaaatcacaaacccacatcacattttgacttagggtaccctttctattcctaagtgggcctgaaggtcttgagaaatggtgataggaacatgtgttccgtcgacagcccccaagcaattttggaagtaaggaaagaactgttgatctatgctaatcttccagtgagtttcaactccagtaggttgcttgataaatctataggtcaaagtgggattacattgaaaaccgccataatatgtcggtgaatcgtttctccactatgatggaattcatgttgtagatcttcatagctcgcattgtgagatatcatgtaaagaaaaaaaaaatccaagtttctcctctaccgtaatacctctcgtgtcatgtaggagatgttctgttcgaagatatgtcgctattgctctaaatatgttaggctccatgcggaatgcaacaaggcaaatcttttcatgtccctctaaaatatttctgagttgttcttcaccgtactgacttgaagtatgccttactcttttctctatccctccattactagttaaaagatatagggcaggcaaccagaacataataatctcctcatcctcctcatctcttctcttcctaattagcgaattcataccttctaactagaaggaatactgaatatttaagatgaccgcagttagcaaaagaaaaaaaaaagtttcagcactctagtttttagtttcaacactatatatgttcataaataattaaagctaattatgcatgtgtatgaactgaacactcactttgtttaatagaagtgctatactactatgctagtatgctcttttgtgcattcaatggtgttagtgtaaaatactgtaatgtgtgctgcttgctatacatttgtatatcatgcagtggtggtggtacagtctcagcagtgtgtagaggagaactactagttgtagtttatttctgctcaaaatctctttgcactgacacaagatcgaagctagtgattccctaccgtgttttgttcccttcaggatggctgtactttgcatatctctaagcattgacataccttgtctccaatatttctcttgcagatcgtcaaaccctagcaggatggctgtactttccggatcttgaaggtcctagcagcaaaacaagtggatgaaagaagatgggcaaagaaaatgagatgagatgaaggaggagaaggaggagaggactttgaaccttgatcaagcgagtaggctgccggggcgacgccggcgatgaggcgacagacgacgacggccgatgaggaggcggtggatggctcggagaaggtagtggcgccggcggcacaagaggatggcgaggacgtggtggacagctcggagaaggcggcggcgccggtggcgcaacaggacggcgaggaggcggtggacggcttggagaaagcggcggcggtgcaagaggagtcgcgagctgcggcgtgcacgcgagagagttccaggcctcgggtgaggattattctctcacccgtgggtcggcatggatcgagccgcaatacacagcaatacacgaacagctaaatgcatatttgggctggatgtgggaattgatccatgcgtgggctgcattccacggaaggacgggtttggggcctatttttacatcaaacacaaacagccaaacaagccttagctgggatgttccccattatcataagactagcagactaatcaatttcaccttacaagattattcaattaataaaattcagttattcccggggtcttatactat

SEQ ID NO: 8272 - DNA, 9739 bp, Oryza sativa
caatatctagctgggaaaagaaagacagaaaggctactgaatgtttgtgtttgttgagctcagaatgtaatgaattgtggtgatatatttacatagtaagctttaagacataacaattgctaatcaatgatataatgtttatatgagctttaagatataatattgataatgtactgtgatgtgatatgtttgtacgttgagttttaggatgtagagggtcaatcttgtatataagatatatgttgtaaatataagatattataggtgccgacacccatataacacaagccgagccagcgggccccaccacgacgaggtgacgcgagaggagataaggtttccttctctcgctcccttctctctctcgctctctctctctccctcccttctctcgctctcttctctctcttcctcccttctctgctcgccggcggaggcggcagcggcgaccacgccctccactccgccagatccggtaggaggggaggcggcagcgacaggaggggaggcgtcaacggcgggcagggtggttggtttcggcgtcagcggcgggcgaggtggttgtttccggcgtcgacggcaggcggagtggccggatctggcccagaggggagtcggcgatagcgggaggggcggcaacagatccggcggtggcgtggctcacgggcggcagcggcgacctcccctccgccagatccggcgggaggggagacagcggcggcggcggagccctcccctccgccagatccggcggggggtaggcagcggcaatgacggcggcgggctccccacgggcgacggtaagcacccccaaccatctccttcgcttgcgatgatgtttgatgtgagatgaatgatgattcaatgatgtttgatgtgagatgaatgctgattcaatgatgtttgatgtgagatcgatgaatgtttgaaatgtgagaatgaatgttgccaatttttttttgtgagatgaatgttgcctgattcaaatgtttgattcagtgatttattttgtgagatgaatgttgccaaactttttttcttgcggatgtgggaggagggactgctcggctcgatcgagccgacgcattgagccggctttttttttattcgtcgaacctaaaaggtgccggttttaaggaaccgacacctttttgctacctcccttgtgccggttgagaaaaccggcagggaagggggtttgctaaccggtacataatatcttttctgtagtagtgacaccaagcatatctatcatgaaccttttgctataccaacattagggtactctacataaaaaaatcacaaagatattaatttatattatatgataggatttagaaatagttaatccctccatctaaaaaggttctttttttcctactatataagttgcccacattaaccataagttgggtttacttggacagagggagtttttgttggaagtgacaatgagtgagagacattgagtaaagccccgttttaatctacttaaagggagagcgacttcttcgttaatcatgagtcgctttctaaactattaaatgatgtgtttttagaaaactttatatattaaaagtttctttataaaaaaataaatcaattttgctacttcatatataagaattaatacccaattgatcataaactaatgggccagctcatttcacgtgtagtcagccaaatagctgaaaataactcggcctaaggcatgttgaatatataggttggtttagcataggtacacataggatgcccatgcatcaaccattccatgtgagaagaatgttggtctagatttattatgtgaatccgatcctttttcccttaaaaaaatgtttcgaaagctaagttcctaaacatatcatagcatccttaaattgaataaatttattaattaagtttgaagttgaacctattacagtattacacaatattaaatttagtcgcacaaatacaatattaaatttagtcgcacaaatactcagaccactgtataccagtatagtaaaattattagtacaagatatattttttaattacaaggtaattaagcaagacagcacaacatatattgctgctaatcactcttctcagatcctctcctcctccagcgtgaaatcgttctcgatcttgaacgtcttccagctggtctgctccagcgacggtcaggttgagcaggggccctgatccactgcacacacccatggagttggctgccatgagcaggaggtagtacaccgtgtaaatttcagaacatgcaaaagtgaaaatgaatgtaaatcactcagaaatgtaaaaaaataaatgtccaacgccgtccgtgggattcgaacccacgaccacacggttaaaagccgtgcgctctaccgactgagctaggacggctattatgacgaattgtataattacattttataaaatgttatgaggccattcgcaacaggggacgatcatccatcacttccagaaaacagaagtattagttgaaacaaaatctctactagcatcctcctcctctccaattaatgtagttcacacttagaaacccaccccacctaaaattcaatctttgaagatcaaactaaaatcaacctaaagaaaaatcgaatagaaaaaattgaaccataaaaccattattcacaatcttattacaggcttacagcttacaaacatgagatgtcgctagtcaaaacaaaggcaaaattccgcgcgtcgttttgatcgatcgatttggtgaaatcacggcgagcatatatctatccagcgtcccagcagggcagtgacttggcaaactatgcgcagtaatatcagcactgcaatgttcggacttcaggaaagatcaaattttagcagtttccaaaacacatttttgtgaattctacatgttacttttacagattagtgaaaaatatttcatgattgtagaaataaattaaacattttaaaaataaaattaataaatatatgagtaaatttaagaaaacctcatttttatgattaaagttgtaaaagatcacacgtatcatgatatgtggcacctaacttaagtattattacttaatggttttaaagttttacagaacttcacacttatgcattttgagcgtgaatttacttataatttaaaaacatagtgtatataaaatttttaatttttttagtaattgactaagattgataggttaattctttactactttcaaaaatttatttaagatatgctaaactttatcaaggttttaattttgataaagatggagttttgtgaaacattaagaccatgaaaagtatgattatataccacacgttataatacatgtggttttccacaactttaacataaaacatggtttttttatgaaatttactctaaataaatataccacacttgttaaaatctcttatattttgatggagccttcatttcatatcataaatcactttaacccttttctacctcaaacttctataaccttaataaatttttttaaaaaatattaatattttcaactaaaaaaacataaaaactactctaagactaaaaacagatactcccttaattttcgttagatttaggttacatccaaccaaaattatattcgggaacggaaggattaaatgccagaatcaaattctgagtcctttcctttcgtcgtgagaaaaccgaaaagtcgctccactttgcttttgcacccaccggtttcaaaaactcgccccccaaaattcctcctccttcctctcgaaggcggcgaaccccatcgattcctcttcctcctccgccgcacgcgccccaatccgattcaaccgccggcggcggcggcggcggcggcggtggcggcgatggaggtcggggacctgcacaaggtgtgggagatccgcgcgctcaagagaaagcccgacgagcccgccgcccgcgcgctcctcgaccgcgtcgccaagcaggtccagcccatcatgcgccgccgcaagtggcgcgtcaaggtcctctccgagttctcgtaagcgcgaaccctagccgtagcctcctcctcgtcaatctctgtctcgttcccgatcgattgatcggttttttttgtttgtttttttttttgcggggagattgatcggttttgttgcggatgtctgatttggttgttgggggatcaggccgaagaacccgaggctgctggggctcaacgtcggcgggggagtcgaggtgaagctgcggctgcggcacgcgggacgggactacgacttcatcccctacgaggaggtgctcgacaccatgctccacgagctctgccacatcgcgcggggcccccacgacgcgcagttctacaagctctgggatgagctccgcaaggtacatagattttttattttgtatgattgtgtggtgattgaaactaatttttatgattccatctctagatgtcgtgaacaatcgaacatacgagtagtagatgtattgctcaatgtggtgctcttgtataaaactgggaattcagagttgtgtcgatgctgcatttagggtctatctggcatagaaagtgggaagtatccatagtccctcgcaagttggagaatatcccacagagtggtaattcaggttattttatagaatcaaacatcatccagcttgattgttaatgttttaatcaaaatcatgctaaatcagccataaaatagatggaatcggtctcttcagcacatgtgtagagtgcatacatatactttatatagattgtagaggtaggaaccagctatattgcgttgtactattagtttctgatggagctgggattggagtgggcaatagagcaagtatgcacttagtcgtggtttgcatagaagcacaaaaaagatttacctgtgctacgacagtaattcctgcaaggaaaagttgtagcttaagaactggtgtgttcattgcatcgaatttaactgaaagctcaatagcccatccttattcagcctactgtcttaagcttatgctatttatggaaaaaccattcaggaatgtgaagaacttgtttccaagggtatcactggatcaggccaaggatttgatggtacaggtcggcggttaggtgggtttacagtacacccaccgccaccatctttaaggcaagcaacattagctgcagcacagaaacgggcaaggaatggagctcttttgccatccggtcctagaaaggccctttttttgggggttggggaaaaaattaaatggatattatgagtgctcttagtccaatacaagccgctgcaatggctgctgaaaggagaatgtatgacgatttgtggtgtggatcgcacgatcaatctggcattgatgattcagaagacgttgttattcttgaggatacacctaacttgccaacgcagcttgggaaaagcacaaaggatggcttttctagcagttctgagaatcccagcacatcttcgggatttcccacagcagcacagaatggatcctcttcttgtaggataacaaccgatgcaggagatagttctctatgggagtgtgttgcttgcacacttctaaatcaggtatgttttcttttgtaagcaaggagtttctataacagataaacctttttaaatggggttatttttcactggatagatttcatactgaccttccagcatattttttgaagtccactcattatggtggacttgtaaattacaaatattcgaacggtatccaattatccacatacttaagtgctttgtatgcctgaaagtattacattactgcatagatgtaattcaaacatatgaaaaaccaaattccatttggacagcttctgataaatggcacagaaatgccatatattaatgtatcatacaagagaagggctttgacgttgtttctttgcctgaatgttgagccttttctattgcttttctttattttcgtgtgcaaacttaaccttatttcgtagccccttttatattttgtgcatactgaatacacttttcctggtgtgttgtttctttaccagaggcatttttctcgctttgctaaaatttattgtctgagaaaggttatttgaacattataattattaattctcttcatttctaatacttttgtagcctctggcaccaatctgtgaagtttgtagcgcagctaaacctaaaaccacgaaggccaaatatgcaacctggtcctgtaaattctgtactctagaaaacagtactaagattgacaaatgttcagcatgcgatcaatggagatattcacatggaccacctgcagccacatattgtccaagctatgattgatctacattgaagcttgcattaatatggtaagtaccactacattgtaggcacattaaatttaattttcttttggaggcaattttttgctttcatgttggtggattaaacatatccactaatggtatagaagtacagttaagtgaccttctttctgcactcacctactaacaaatttatcttggcctatcaagctgactttctttctgtattcaattcgtaatatacagtttggtggtgttgcaccatagctatctttttgacccagatttgcttatgtagttacattcattcgctccataaatctctatccacttaactgaattgtattattgtaacaacaatttcatgtggttattgcaggactacagaattttggacagccatctgctgaattgtggatacacaaattcgttcccatcagcagttctatctgttaccccattgcacttctgcataacgaatcagatgtgtaatttactatctaaagcattccctctttcgtggatcacatcatgtgtatagagagaaccacctattggaaacatctgacatatcccaagctccctctgggagcagctaacgcttgaaccattttcaatccttcctgctcctgaagtcctgaagcatgaccgagcacgctggtatgttttggctctgaacttgtgatggcaacacaattgtccttactgcattatctattgcaatggtgttttcacatgcttagataatgcaaccgtgcatgtttaaccaggtactatcatgagtcgctgttgctgcagttgagcgatataagctgtcacttcattctaatcaactaaggtcgttgactttttattcgtcctcgtctaatttctccatttggcagctttgggtttgctcttggttgggtgccaactgccaatgacttgacaagttgacattgtatggtcaaagcccaatgggggagtgagctttatcacttgtgtaacgattaacaaatttcttaaaatcattcccgtggtagaatctcgagagaaaccaacactggctccttttgaaacaaaggaattttacatgttcataggaatttgattcgattcacacaaatcctactcaagattcctttgtttcaaaaggaattcacttcatcacctcgcaggtgcaaaagagtacccctccaatgatctcaagcaacacgatgtgcaaaatctagaccgttccacttgattatccatatagcaacctttttgcaaatgcatcattaacaaaagctaatcaacggagctacgaaacggctaataaaaacatatgcaaggacaatcatattactcctaatcaagaggatatttatagtaaactaaattacaccttgtatacatactactatacggtacagtacgtcgctgtagcttctctccatccatccatcgaaatctccactccatccatccatcgaaatctccagtaatccgaaacccatcaacctcaccaccaagagttgataacccgataatcatcgcggcgccagtattcgtcacgcatctcgttttctctttatttgtttcttctttcgcttttttttttagcatttaactattcgccatttttaagatgtgacaattaaaaatttagttatcatgtttctatgacataaagatctaatgataaatcatttatcactaattgtaagagtggtaaatagttaattatttctttttcttcccctctcaaatctcgttttcttctctttccttttcttttttcccttctttttttcttttcatctcaaagcagagagcatctcatctcatcgatcgatctcgatccatttccgtttgcttcttctcctctcctctccaagaagaggcgagctcgcctcctcctcctctcgacgcgagcggcgatgcgtgcgggcgacatgccggggcggggggctcgccgtcgcccggatctcaccctcccgatgccgcagcgcgacgcgccgacgtcgctcgccgtgccgctcccgctcccgccggcggcgacgacgacgacgtccgcgcctcccgcgggaggggcgatgcacccactggcgtcggcgggggccgcgccgccgccgccgctggaggagctggaacgggtgaggcgggtggggagcggggcaggggggacggtgtggatggtgcgccaccgcggcacgggcaaggagtacgcgctcaaggtgctctacggcaaccacgacgacgcggtgcggcgccagatcgcgcgcgagatcgccatcctccgcaccgccgagcacccggcggtggtgcggtgccacgacatgtacgagcgcggcggcgagctgcagatcctgctcgagtacatggacggcgggtccctcgacggccgccgcatcgccgacgagcggttcctcgccgacgtcgcgcgccaggtgctctccgggatcgcctacctccaccgccgccacattgtccaccgggacatcaagccggtcaacctcctttatgacttcggggcccgcgtcaagattgccgacttgggggtcggccgcatcctcaaccagaccatggatccctgcaattcctcggtgggcaccatcgcctacatgagccccgagcgcatcaacaccgacctcaacgacggcgcctacgatggctacgccggcgacatctggagcttcggcctcagcatcctagagttttacatgggaaaattccccttcggttagaatcttggcaagcagggtgactgggccgcgctcatgtgcgccatctgctattccgaccctcccgagccgcccgccgccgtctcgccggagttcagaagcttcgtcggctactgccttcagaagaatccggcgaagcggccgtccgccgcgcagctgatgcagcacccgttcgtcgccggaccgcagccacagccactcgccgccccgccgccatcgtcgtgactgccaattccatccggtcatcgtgtcaaactccatttccatctcatcaagttcttcatagccaatccattttcgagtgttcttcaaacaccatgatcgttttcatccattgctgctgccccaactcaaggttcttcctctctactgttctttgatgttgttttattcacaatgatgatcaaatattgagtaaatctggtttgtacaaaggatttttttttctacgagatcaagtacagacataatcccacttgttagccaatttgccataaaattcccttagaaacgaaaatttccactgtacaagtagcagattttttttactccatttccacgatattttgcttgttagtggtaagctgcttaatgatgatagtgtgcaagttgccactcttcaaagtggttctttggattctactatgtgttctcttgcctaattgggttctatattgagattactttctctatgttttttttggaggaaaaaaaagaatacactctctttattcattctgtgtaaggataatattatgtgtgcatggttgcttttga

SEQ ID NO: 8273 - DNA, 3321 bp, Oryza sativa
  unsure (1)..(3321): unsure at all n locations
cgcagccgttgtccgcggcgccgggccgccgagcgcacttgtgccgctcctacttgtcgccgtccgccgcccgcccccgtgcgccgccttccaccgtgcgcccccacgcgtcgccgtcgtccgcagctccgcgcctccgtgcgcacttgcgccgctcccactcgccgtcgttcgccgcccgccccagagcgccgccgtcgtccgaccgccgctccgcacttgcgcctgcatgcacgagtgagagagaacggagagagaaattaggaagagatagagtggaggcatgacaggtggaccccaccattttttgaaaaaaaatgctgactggactgccacgcgtacgccacgtaggataaaaccgctctgaattgggtcgagggggtatttcgtccggtattgaaagtccagggtgaagaatgttcgtttttgtggttcagggggtaattcggacaaccacaatagttcggggggtaattcgtactttttcctttattttattatgacttgatttatcatcaaatgttctttaagcatgacataactatttttatatttatataaaaatcttgaataagacgagtagtcaaacgttggttaaaaagtcaacagcgttatacattaaaatacggagggagtagatttctgaacttataaattttgtaactacttattcttataatccgagtggaaatatgtattattcgttagcttgagattctagaggaaacagtaaccggtaaaggcttcttcaaacatgcctcgattacaaatttacaatacgaggtcatcgtggattcatggtggactttgccatcatcggtcaacatttctctttcccgccgctgacaacatttatttccttctaccatttgcatgcttgcattcaacacaaaatgtcaaacttgtagccaaaacagttgaggccaaacccaaacatttgaattcaaatagcaaacattctcccaagcacctaggccctagcatctctagcagtctcagctagcactagaagaaatcaagaaatcccgttcaccttcagctagcactcgaagaagaaaaaaggtattttcaacctgctagaaaattaaggaaaaaggaaaatagttgttcctttttctctagaaaaaagatagttgtaaaagtttagaaaaaaacttgggacatttgtgctctaccgataaatttaaaatccaaattcacccgcacattgagaaacaaaataaaattttaaaaaatgacattgtattcagacttgtatttatcttatttatttgtcgctctaagacttgaagttggtaaaatgacattttttcctccttttatataattgtttggattgttgtttcgaagtgtcatttggaagaaaaatgtggcattccagacaaactatcaaactgtttccatagacggatctttccacatttgtgctctacggtcaaatgtcgacataaaaaattccagtctttgactgcgattccaattcttccgtgactagattttagtattggatataatcacaccttaagattacttagctaccacaaacttcatgggtactcttggcttcgttcggtagcagcagattgagagaaattcactctttttaacgggcaaagttcccgaattatttaatgatgcctttttttgcaaaaatatttatataaaaactgttcaaaaaatcgcattaatcttttttaaaaaagtttgaaataattaatactcaattaatgttgcactaatcgcacacctcattatcatcattttacgtattttcccaatcttcctcttttctcacctcttaaacatatcttagattccaaattacactactcccttgcacattcccattgttcattagatacaacctaactatacttttgtgtatgattattgcgtgagacatacggggcgaggaatagatcttgctgccataagtgtaagcaaactaagggctgtgtttttttttttgggaaccctgccctttacacacaaaacatgacaattgattaacacataattaattaagtattaactataaaaaacatgaaaaatatattaatatgattttttaaagcaattttcgtataatttttttttaaaaaaaatacaccgtttagctgtttgaaaagcgtacgcacgaaacataaaagtgatgagttggaaagttggggaaagaacttatgggtgcttaccgaatttgagatgatgctgactcaacctgcggcatcctcagtcatgctgactcacaccggtctacagtccagtcaacctcgtattcacgatggctgatcatatgtcatggctcgccttcaccggtcaacattatctccttaatttaacttcgcagatttcattcaacgccaaatctcacaagcaatctatccaaatctcttttatatatactagttttcatcatccttgctgcaaaatttgacaacgcaacgcaaagcagctgctcttccattccatgtctgcgcgtcccaaccctccgcccgtgcggcggccgcgctggcgccgggatctcaccgtccggacgccgcgcgccgacgtcgccatgtcgctcgccgcgccaccgccgccgccgtccctcgacaccacggtggagcccccgctcgctgagatggagctcgtctgcctcgtcgacagcggcgaggccggcgaggtgtggctggtgcgtcaccgtggcacgcggcgggagtacgcgctcaaggtgctctacgagcgctgggccgccgccgccggcggcgacgccgacgacgacgaccactcgtccctggtgcggtgccacggcgccacgcgccggagcggcggcggcggcgaggagcaccggatcgtcctgctcgagcacatgcgcggcgggtctctctccggccgccgcgtcgcggacgagcgcgccctcgccggcgtcgcgcgccaggcgctctccgggatcgcgcacctccaccgccgcggcgtcgtccacggggacatcaggccgtccaacctgttcgtcgactcgtcggggcgcgtcaagatcgccgggttcggcgccgaccgcgccatcgaccggacggccaacggcgggccctgcagggcgtcgctcagccccgccgcgtacatgagccccgaccacgcctgcggcggcggcggcggctacgccggcgacatatggagcttcggcctcaccatcctcgagctctacacgggcagcttccccttggtcgagcaggggcaatcgatcccgctgacgtgttactccgacggaccaccggaggcgccggccaccgcctcgccggagttccgnnnnnnnnnnnnnnnnnnnnnnnnnnnnnnnnnnnnnnn

SEQ ID NO: 8274 - DNA, 1075 bp, Oryza sativa
gtttgttgccccacaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcatgatttggcggattctattgggatctgggtgggtgtccggtacttttgtacttacgtttcatgttgcgctctttctcttcattgggcacgggcacatccaaggctacatccgtatctgaaagatggaggggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaa

SEQ ID NO: 8275 - DNA, 662 bp, Oryza sativa
aagatcccagggatctttactcccggttgataatatcaaccgggaataaagcgtacgcaccagcccacgcacaagcgcatgcgtagcccctctctctctctctatctcctatccttatctctttttcttctccttccttatcttcatcctctccccttcctcttctctcaccccctctcctcctcccctccccctcttcctcttgcagaggcagccgacggcggcgggatgggggacgggcacgagctggcggcggccggccggcagtggcgggatggaggcggccgggcgcgggctggcggcggccaggcgcgggctggggctggaggcggccggccggcggcggcgggattgcggcttggcgcgggccagcgggatggaggacaggcggcggcgacccggcgtgggccggcgggatggaggccggtcgccggcagcctcgccctcccctcctccagatccggccagaggggaagcggcgggatggaggacggccggcggcggcccggcgcgggccggcgggatggaggccggtcgccggcggcctcgccctcccctcccccagatccggccggaggggaagcggcgagatgggtggccggccggcggcgggatgggaggccggccggtgagtcgattttttttttgattttttttaattt

SEQ ID NO: 8276 - DNA, 518 bp, Oryza sativa
ataaaaacacatggacacaaagaggggaacaacaaacactgggtggagggagaggatcaaaaagctacctattaggaactatgcttactacctgggtgatgacataatctatacaccaatgccctgtgacatgcagtttacctaagtaacaaacctgaacttgcacccggaacctaaaataaaaaataaataaaaggggatgcataagggtgagagaagatgtgacgaccaaagcagaagtcgcagtaatatgggatcacaagctgaggaatgtgacacctctggaagctgaaaagacaatgcagacagattttccccaagatcttccagaagaaacacagtcctgctgtgacagcaggatttcagcccacggagacttgcaagactgtaagataataaattgatattatttaacctaccaagtatatggccatttgttatagcagcacctggaaattcatacacctggatttactttcattcatagaatttaccacttttttttttttttgggacag

SEQ ID NO: 8277 - DNA, 11526 bp, Oryza sativa
ctatcagcttagcaagacttatattatcaacaacaatctagtaggtcgaacctaaccgatgcagcacgagattgtatatgataatctaatactcgataagccgatagatctgtctaatgtgatggatataacaaatctatttagaacagcattgcgattgtagagatatatcggctaagatagaagatcagacctaaccgagacagttccaactaaaccgatgcgtctctaaacacaatgcaattagagatagaattgagatatcaggtaggcaaatcaatcaaccaaaccagagtgatccaagagatcgaagcgatgtagccttgagcgacgccgacgtagatgacagattcaccagggtccgacggaacgtaggacttaccccttcgccggagatcgaaagccgatgcagccccgcgtcaggtgcccaaattccgccggaagataagtaaaacctcggtaaatagggtagcgatgcgccgagagtagttgtattgatcgagagattgattgcatagaccctgggtgtacatatttatacccatgggttgatacaagtccttgtcggacaagaaagaaactttcctaaagataaaaggaaaacataaagtacttatcggacactaaacacactttcctaaagataaaaggaaactaacaaactattcctaattaatagataaactgccacgccgcatccttcttgaaatcggactcttctagataagcttccttcaattgattcgactccactaagaacatgatagcatggcgacttgacaactcccatcggctgcttctagaactcggaagccgatagtgactttcagctgatgatgactttggacttaccaaatttcatcgttaacaggaagaaggcgtcgtagcagtcgagcggcgccttgccgtggataacggggagctcgtcgacggcgaagaagtggcagtcacggccgctggagcagtcggtgaagaggatgtcggggtcgccagagtggagcgtgacgcggaggctgagcccctcgtcgcgggccatgtcgacgacggctctataccccgcccaattgaacctatccagcgactccagctgcgctcaagtcgtccctcctgccgccgccgttgcagccgccgcgatgcgtctgcctgaacccgacccttgtcggcacaatcccggcattctcccggcggacaccgccgcacctcgctgcgtgcgttaccaacaccgagttcatggcacacctcgccggattgctcgtcggagacacgagagaggaaaggaaagtgaaggagaaaggtagagaagaggggaaagagagaaggtgctgagttggacaccctgacatgtggagcccacataggtcccacgctgactcagctgtcccatcggacaaaaccggggttaaaaccacggaaggacctaaagtgaacagttttgtaagttgagggatgtcatatatctggttttgcaattggaggacgattttgtaagtcgatgacaagttgagggaccttcggtgtactttttcctattatagatagccatagacccgaggctcgatggcccggcccaaggcacggcattttggcctagcccaagcacggcacggccttaccgccgagccgtgcctgggcttccccaccgacacactgggccggcccagcacgactaggccctgtacgagagtgtggggatgcataacagacttaatttcaaccatatgtagggcacgagggagcaaaaatagacgtattatataacaaggcccaaagaatagggacataaaatagacttattttagctacatatatgtcacagcccaaagaggagagaggagaaatagacttatttcaaagaaggcacgatggaccacccgtgccttcaggctagcactgcatggcccgattgctagtaggccatgcctaggccggaggtgcagcccatgggccagcacggcccaacacgaagtgccgactgagccgttccagcccgatcgctggtgggccgtgcctagcccgatcctaggccgggccgtgccgggcgagccttatggccatctatagattatatatgtgacgactatctgttgcaactaatatatactctgaaaatatacagagataataatgctactggataccttgctcacaaacgcatgaggagatttcagtgcagcagataacttgtcagactttacccactgatttgatttcagtatatcttgcacttgcagtggttcaattccatttttcccatcagactattgactgcagcacaagtagcagcacaggtgattataaatcacaaagcaatcctccattcctttcaactgctgaataatcaaaatttcacataaacatgtaccagagttaactacaaaatgaacagtgacgtactggcatctttagaattaagaaaccaattttctttagaaaatcaaagtctatgaaagaagatgaaaactgaggtcacgataatttccaaatatattttttaagatcaagatagaatatgaaaaagttgaaattaaccgtagtataacttagacttttttcagaaaaggaatatacaccgcatcacgtatcatcctctcttcctctggaaaagtcccgcacggttaacttattttgggacagaggaagcacacaagattaccattccttcttggtttccgctccaaccaaaaccaagaaagcatttgaaacgaattttaccattgcagtagacaacacataaattaagagtaagtttatagtagttactagtagtagtaaatggtacagttacttaagtgcaggagacaattacaacatgcggacaacgaaggtactacctctgtttcataacctctgtttcataatgtaagactttctagcattacctgtattcatatagatgtcaataaatctaaacatatatgtgtgcttagattcattagcatatatataaatgtggacaatgctagaaagtcttacattatgaaacggaggaagtatcatttttattatgctaaagtaaaattaggacgagacacaagttctcttaaagagagagacagaaaattattcaaaggatggggagtcagcccttaaattaatcagaaaactgccgtgatggtctcctcaccgcagctagacttgtgacatctcgatttgtgcttgatcaatccaatattctcatggtcaacattggcatgggtaaactctacaccagtcaggacagaaacattctggccactcaatccatcgccaaagtcaccagtgtgaaagaaccttgcaatgcagaacttggcagaccccaggttgacaagctgagggtcccgtatctgcttccatccttggatgagtgactcatcaagttcgttccagcagtggcgtatctgtggttgcaggtactcgtccatggcagagaggtcagcaacagcaaagtggccatcgttgggagtgaagccaaaccagagcttgagctcgtggacatactcaaacttgccttggaagggtagcatccacttgcccacttcaatccaagtgtgtttcacagtgtcaaagcaataagtaccaaccccgtcgatggatatgcagatctcagagccacctttaaccaaaccatatgagatgatctttagaaagtcaacgccacatttgacgacgtatggcggcggtggtgggaggagttggcagtcccaggactttgataagtagctggaacagaacatgcggtacaccaaagcctcgaacaaatagtcagcctcctgtggtttcgcaattctatccatgataaaaagagtaccgccaccgccgccatcaaggtcatccagatctatctcagcgccggggatgtagagggcaatgggttccaacttgggcttgtggagatttggcatcaccaccagacgggatgtgtctgcctccagaaggaggccacgccccgactggtccaaagagaaagccctgcgctccaaagcagggaacatgtgtatccgttcgcctggtgctcccaagttgaagattgggctgggaagacaaatcttctccatccttttcttcaatccgtttattttcccattcagtgtcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaaagagggttaagatcaagcggatctgcagggtactgacctgaggcgagctggagaatggagggggcagggtggagctcagctcccaagccctagcaccggagcagaacggcggcggcgtcgcgggattgagggacagatggtttctaggtctggacggaccggctgtgttcgtttcgacgttttcccagcgcgctacagtaacacggaaaacggaatagttaattaacacgtgattaattaaatattagctaatttttttaaaaaaatggattaatttaatttttttaagcaacttttgtatagaaactttttgtaaaaaagtacaccgtgtagtagtttaaaaagcgtgctcggggcaaaacactgtagcgcgctgggaaagtgctgtgccgaacacagccgatatttcagaggagctctcgcgaaaggggctctgtttactgaggatcaatgggccgcttttcacaaaccttgacaaaaagggtcacaatgggccgctatttgggctgtctctgtaaaggggctgtatatgtataaacaatcgtaaaaagttcattttgactccctcaacgatcgcctgagtataatatcatgtcctccaaccacaaaaccgggtatatcgacccctccaactatcaaaaccgatggaaactatgtctctgggtggtttaggaagcgattttggctcacgtggcgcctacgtggcgttgttgacttggtctctatcccacgtgacatcgacatggcgcttttgtggcattataataaaacaaaaggcaaaaaagtacgtgggacccatctgtcattcacagaaaatattgtgggggtcattggcatgtgggtcatacatgtcctcatcttcctcctctcatcccttctctctccttaccatcgcgtgtcaccccgcaccgggatgacgctcctcattgtcaccttcgaatggccacgacggggtcgacatcgtcggcgccgagctgtctcctctgttggcggagtcacccaacgacagcttgaggacaagagagaaggaaacggtgaggccggagccaagtacgaaggcgaggaaaaagtggcagggagaggcagttggacccgcaggagacgtggagggaggggagtgtcggtgcggcggtggcgagcgaaggatggaggtcagtggggttgccagtggtgagggacggaggtcctgttgtatcgtctacttgaaatctcctgcacatcctctatcgccgcttaggccctcgctcaccctccacggtataaaagggacccctggggaggggtgaaaggcatccaattcaatcgccaacacacccaccatatattacgaagccggagtacgtggagccaactcgtcgggagatctcgtcaaatccctcgactacgatctcaccggtatcatctgattcgactactctctttgtaatctattctcatcatcataaatcccatataacctggactagggctattacctgataaggggcctgaactagtataatccttatcttttgtttgcttgatgtcggactacgcccttcaaccgaaaaactagatgcaatgggtccttcaactgtcaaaaccagtgcagatgaggtctctcggcagttttgacgtcggttttcgctgacgtggcgcatatgtcgctattttgactcgtcttcgcatcatgtgccattaatgtggcgcttacgtggcaattcatccagaaaaataataaacttcatgggacccacatgttagtttacacataaattaataaaaaaatggtggggcccacgtgggcccacatgtcatctaaaaaaataaagatggtacgacccacgtagaccccacatgtcattctcatcctcctcttcttcctcctctctctccccaactccctgtattcatttttctcccttctcctctgtcctctccaccgagcgaggagggaggcggcgcgcggcggccgggcgaggcggggcagagtggagcggcggcggtaggccgcgtgcggcggaggtggccggaggaggaggtcgccggccacatgtgagcagacacagaatgaggagtgaatgagagaacagcgggacttggggaatcgggtcgacgggagatgccgatggagggcatcggcgccggcgcagcaagacggacgacgagaggcggcgtagggagctcgtccctcgcatcccggtgagggcgccgggccagcggaggtggagacgagctcggtacccctcggctgcgtcgtggcgggcggcggagtcgaggaggtggtcggcggcgagcgcaggtcgacggtcggccggtggagggtgcggaggagtcgagggcgccatggccggcggcagaaccacgagacgatggcggaggttggctagcggcttgctccaggtgccgtcggggctcggcgagcaagaccgtcggcgtgaagacgatgaacgggagctcgtgcccccggccaccacgcgtcgcctgcaaactcaccatgcctcctcctctcggaaatttcggatccgtgctatggccggggacggcgagcgcggtgcggtgatgccgtacttcgtgcccgtatcaagactcctcgcgccgcagtgcccccagcggaagaagctcgcggtggcgagaagggcggatcgtgatgtattctctgcgatagacctgtagagttggggagagaggaggaaaaagagctggcatgtgggcccatcattttttattgagctggcatgtgggcccatcattttttatttatttatgtgaaactgagttggggagagagaggaggaagatgtgggcccatcattttttatttatttatgtcccgcttctcccaggccgggcacgcttacatctggcagctttcacacccaggaagaatttcccggtcggccacccatcctaaattgctccaggccaagcacgcttaacctggagttctttagaaatcggcttccggaaaagaagttgcaacttgttgatatgagtattctattaatcctattaagccctgggccgggatgtcacaatgctcacccccttaagacaccgacgtcctcgtcggtcaaccccaggccaggaacgtcccctcttagccacgtccgtgtgtcagtgccagtgcatgtgccatgctgtgtgaccactccgggtccacaccagccatgcgcacgtcggtcaaccccaggccaggaacgtcccctcttggccacgtccgtgtgtccagtgccagcgcatgtgccatgctttgtgaccactccgggtccacaccagccatgcgcaccatgcctgcgcaactgcgacaggagtgggtccacaccagccatgcgcacgtcggtcaaccccaggccaggaacgcacgtccgtgtgtccagtgccagcgcatgtgccatgctgtgtgaccactccaggtccacaccagacatgtgcaccatgcctgcgcaactgcgacacacgcgcctgtgaaaccgcgagagtcggctctgataccactttgtaacgtcccgcctctcccaggccgggcacgcttacatctggcagctttcacaggtcatagactgccctcacagaccaacacaagtcttttctgcacactttgtcactcttgcgcacccaggaataatttcccggtctgccacccatcccaaattgttccagaccaagcacgcttaacctggaattctttggaaatcggcttccggaaaagaagttgcaacttgttgatatgagtattctattaatcctattaagctctgggccgggatgtcacatgtgtgtcccatgaagtttattattttgaattgcaacgtaagcgccacgtcatgtgaagaccaagtcaaaatagccacccaggcaccacgtcagcgaaaactgccatcaaaacctccgaaggacctcatcggcattggttttgacagttgagggacgcgttgtatctggttttctggttgaaggacaaatatcggattcgttgacaagttaagggacctcgaatgaacttattccactcctcattgattcctcagcccagtagttgtaatggttgagcccaattgatattattttactgggtttagaggcccaaccatccataagtctacctctcgacggcttccgattaattgttcatttatgttccatcaattctcctctatttatgtgtgcttctcctgcatatatgttagtagcataggacatagtggaagtatatattttatttgaaaattatgcattgcaagcatagctagtcttcattaaatggacaatattaacggtcgaaattggtatgaccgtgccatcggcggatggccttgaagaagaagaccaccttgctagcgtagatggccgcggtgacgcacatgagcgcgacagaaagcgcaccagagcacctggttcaccttggtagtgatgtgaaggaatctcatcggcgttgacgtcgccactgtcttccacaggatctcctggctgctcatgccgaggcagataccgaacgccgacaccgggaacagagcaggaatggccacgttttgtccgacagaagcaccagctcctccgatgactgatgcgacacaacacacaccatgagctctctccagtgttccagcaaatcaaagcacatagatcgatgtgtagttccggaagaattagctcaagaaacttacccggagtttgtccagtttagggccctccagtgcggcgaagaagcgatcaacctgaggcatggacttgatgtggtggctgcggatggcatcgccgtcgcaaccgtcctcctcctcctcagggacctccgtccccggcgctagccagatgggtgagttgccgctcaagcttcccggaccacgtcttgaacgagtcgtagcgcctatcccgagacagagatgaattcatgtgctttgaaacttgaataaagcttataccttagtccagcagcagcactcctctcatcctctggctcaactccaagccaatttcatggtttaattttgggttcccgtcggctctaattgcctaatagcatggatttttttttaaaaaaaatgtaatacagataattgttcattctattgtgctaattttatactgctccacaaaataaaattcagaagtaaaattgtacatgaccaccaaaaacactatggatatcatcaatcagtaactcccctaatctcaccatttttctcatgatttttttttctatctgactgtcttacacgtctccgtttactgttctctgctcctcggcctaacttgcatgtttatgcgttgccggtgcgccggttgcctgcttaattaggccggttgattggtaattagttcatgcatttggggtttggatgccggtcactgtgatggttgtttccggttgggtggcgcgttgaatggcgcgtggcatgctgccatttcttgttttggtccacttgtatgttatttcagatcggtctatctgttctgcactctgtgcctttgtgattttctgtttaggcccttaacttttttgtaaattgaatgtgaagaaggcaaattactttactagccaaatgatttagaggaagactggtgcttggtcaagttcaagaatcaaaacaaggttacagtaatacttcaggacatgagaatccattgcaaaaaaaaccttaccaaattttggtaatgccaaattttggcaattatgccaaaattttgataagatttcttatatagttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcatcgacggggccggccgtcgccgtcgccgccgcggtggttctggacttctggtggtcttgacgtggctgtggacggcgctggtgcagctggtgtggaggccgtacgccgtggcgagggcgttcggccggcaggggatccgcgggccggcgtaccggctcttcgtcggcagcgacgccgaggcgaacgcgatgcgcgcggcgacgtgctcgacctgcgctgccacgacatcgtcccgcgcgtgctgccgcactaccgcgcgtggatgtggcgctacggcaaggtgttcgtctcgtggaacggcgccacgcccgcgctctgcgtcggcgactaagccatggtgaagcagatcctgtccgaccggacggggctgtacggcaaaccggagcccgggccgagctttctggcgctgatcggcaacggcctcgctttcgtcaacggcgacgactgggtgcggcaccgccgcgtcgtgcacccggcgttcgccatggacaagctcaagatgatggccaagacgatggcggagtgcgcgcggaaggtgattcgggcgtgggaggcgcgtgccgccgccggcgagcggcgggtgcaggtggaggtcgggcagaagttccaggagctgaccgccgacgtgatctcgcatacggcgttcggcagcacactagtggagaaagtgtttttcctcccggttggtaacccccctatactcccggttttgcaaccgggagtagcaatctgggactaaagatactcatctttagtcccgggtgaaataaccgggactaaaaatctatctttactcccggttggtgataacaaccgggattaaagatagtgatgccagcgctagtaccggccactgttttttttattattttctcccaaatcgagttggaactgcacaaatctcttccaaatcaaccaaatcaagttgctccctgtatccccaaatcaaaatcaaagtatcatcacaaacatagattcacatcacaaattctcaagaaacaatacatcaagaaatacatcacagattatacatcacatatccaatgaatcacaacttctaaacattctcagatccatcacaaattcttaagaaaa

SEQ ID NO: 8278 - DNA, 899 bp, Oryza sativa
aacaagtttgtctttcattttgtcctccacccactctgattcaggacaaaatgttgtaactgaagtgtgctagaactaaaacaaaagggacaaaagggattgttgacgagcaagcacacgaacaaacgctcagcatctcactctgcatcaaattatgagcataaaatcctgcagcttgtgagatcgtgagatctagatttttgaattggacagtaggtggctcttgtcggtgaagcacgctgaatcccacattcccagcaggcatagagttcagctttcacgtggagtatcaccgggcagtcctcgagagtgtgcttggatgtcctatgcacaggacaccaagatctcggttttagggtggtcgttcttgtcggctctgattttttgtttagaggacaaaattcggccgcttgaggattcctcctgggtattggggccgtcgatgttccattctccacttgagtgggaggaattatcggcggtgcgtcgtttctcggagtcgtaaccgtgcctttctcgttcccgataattattgggccagtcgagatcggcgtgatggtgtagaccggaaagaaaatggatctgacttgagtccacaccagcgatgtcgaggtagaggctccttgatcgacgccggtgttgatactgctgtcaggaagtcttgaagtcatactggtagatccttgagcaccaagtcctcctacctggcgtgccactgtcgacaagcgatacttgtggaccggatgagttgagtattggggtatgttggaacgagggtctacgtagtacgacatcaagcaaacaaaagataaggattatactagttcaagcccccttatcaagtaataaccctaatccaggttatatgggatttatgatgatgagaataagttacaaag

SEQ ID NO: 8279 - DNA, 3145 bp, Oryza sativa
tagtttccatcggttttgatagttggaggggtcgatatacccggttttgtggttggaggacatgatttatactcaggcgatcgttgagggagtcaaaatgaactttttacgattgtttatacatatacagcccctttacagagacagcccaaatagcggcccattgtgaccctttttgtcaaggtttgtgaaaagcggcccattgatcctcagtaaacagagcccctttcgcgagagctcctctgaaatatcgtccgtccagacctagaaaccatctgtccctcaatcccgcgacgccgccgccgttctgctccggtgctagggcttgggagctgagctccaccctgccccctccattctccagctcgcctcaggtcagtaccctgcagatccgcttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgatactgaatgggaaaatatctgaatcagaacgcccacaagactccaccccatgggcgggtgccgacaataacgagaaggaagcggcagcaacgttaaagataggaacgattcagcttcctacaccaatcatgaactttcgatcttcagctgagtacttgagttggtatatcaactgtattccgcttgcaggtcgcaaggtgctctgcacagaccaatctggccgcgcctgcctcttcgatgccgatacgtgcaaagtggataccttgccctctctccacaagcccaagtgtttgccctactccatcttcatccccagtgccgatgacaaggacgaccacgacgacaatagtaatggaggtggcagcgtctacatcatggatacttgtcttaatcacataccaagagacaacatacagctgagcagtcagtttgaggcttttgtctaccgtaggtccaccttgacctccttcaccaagtcctggcagtgcaagcgcctcccgccaccgccattcgtctgtgaccccaagtacaagcatgccagcccccacaagatcacttcatacgcagtggtcgacggcggctcccacatctgcatatcggtggatggtgctggcacctactgcttggacacggtgaaacacacttggatccaaattggggagtggacactacccttcatcggcaaggttgagtatgtaccggagctgaagctgtggtttggcatttgtgccaatgactggaagcaatttggtgccgctgacctctccaccattctctccaccatggactctcagccacagctagtaggatcttggaaggagctggaggcaccccaagagtggacagagatgcagcatcctcatcttgtcaacctggggtctggcagattctgtgtcgcaaggttctaccacagttggacacccacggcgggcttatttggttctgatttaggtgagcttttttttactgtgttgaccggtacagatgtggtgcaatgtgttgtccatgacggcaatgggactggcaatgcctcttgcaatgacagttgcaataacccttatggcagcaacgggaaagtggaactccgaatgatcaagcacaactcaaaatgccacatgtcttatggcaccgatggtaacattaaggtattgttctgaataataacttactttggtgtattatcttacccatcattatcgtctgaataattttggcactttggtatgtaagagacaaattgttctttgagtactgtcatgaaatttaactctccctgtgttatttgcttcgcttagtatgatgatataaatttaactccctgtgttatgcgctttgcatagcatggtgatactgtttcccgcaatgtcacattctgagttatcttaatttaggtcattctgagttatcttaggtcatcatttatgtggtgactcatgtatgttctcatagttttgagggctttgtcatgaacgtagatctccccctgtaatcctttttgtactatgtatgtatggtatcaatctattgcaatggtacacttgttatcttcaatagtcctaccatttgtggtcatcttattattactccctttgtcccaaaatataatataagagatccattactaggatatgtctcatccggtcaaaatctcttatattttaagccggagggagtattgttttttgcctccatctgggttgctaaaatcccttaaatatttaatatttttttggacggaggtggtaatgttgtgtctgctgcatgctctatgtttgactcccatgttcaaccagaaagcattctttatcatcctggtgccatctgcgagatattttttttttggtttccattagcacgctttttaaacgtctaaaaaagacgcgaatattagggaaggacctaatatcaaataattagaaggggtgaggtttcgaatccaggtcgtctagtctatcaccttgtggagctagccggaaaacctccaagcgtttctcgctttttaaactgctaaacggtttgttccatacgaaaactttctacatagaagttgctataaaaatcaaataagttaattttacaagtttttaataattaaaactcaactaatcatgttaaggacttgttcttttgcgtgtgcaattaatcttcatctttcattagattggaacggggcacttaaaagcaacccgtgcccatcgtcctggattcttctgctcatgcgactactcgtaagct

SEQ ID NO: 8280 - DNA, 2062 bp, Oryza sativa
aaataagttaattttacaagtttttaataattaaaactcaactaatcatgttaaggacttgtcttttgcgtgtgcaattaatcttcatctttcattagattcgaacggggcacttaaaagcaagccgtgcccatcgtcctggattcttctgctcatgcgactactcgtaagctattacaatatgtgctgtgcacttgtgtattcatctcactattacaatattgtgttgtgcatttgtgtattcatctcacttgggttctaggactttggcctctcttcttggatacatgggacgcaatagcacaggcccctcagtctatcagagagtttatggctcttctgacttttccttcttcacgatctgatttttccttcttagcgtcaactgcaggaaacagatcaagcaatcagggtcaggcagagcaaaaccacaggggaaaaaaagggagaatcagagtgggatgcttaatttcttaacctttacggctctctatgaattgagcagggattgggtactcagtctgatatagggggcattcgtggcggaaggacttcatggtacagaaagaaaaataacactacgaaatatataacaaaggctaacaaatttatgacacattggttgttagctcacctcttatttgtttgtctaatatagcggcctttccctcacgttttgactcacaaaaaatatattcgacaggacatggacatgatgttaaggctatgcactcacccaaatcgaactggttcttaacacttattctcatgcactgatgtctggtctaacctagatggatttaaggaaacaataattcaagagatagaagtaaatacatggatagtagcagcacacacagctagagtcaatgtgcagatagaagtaaatacatggaaatggtcctcctaacacaccattggatgttctatattttgcatcttgcatttgcagaactttcattggtagtccaatttaaattgggcaacaaaataatctgtcacagaattgattgttcattccaatttgagctaaattttatatgtaataatgaaaaacaacagatacaactattttgcatcataactcataaatttaggtgcagtccatacatgaatttcttgatctttagagttcagtcctcttggaaaccagcacaatgtagccctcgagcttcggatgcctgaatcccaaccaggtgtcctctaaaaaatgtaactactacataacatttggtttaactaaacggaaggtcagcagcaggctgagcggaggagacgtagggaatctggtgtgtcggcaacactacatgactgaaaacaacaatgaccggaagaaataggtcaggcgcagaaggagaggattaaaggaggattaccacggattggactttcctggaggagcctgagatagttgagaagcagcaatggctacgacgacccgatctttagatcgattgtgggggaatcgaacttgaagggacaacagaaatagcttggagggactacgaaggatcttctagaagttttgaggagcttcgagggtggcgaggagttgagctcagatcggcagcggcggtggtggcgatttccccagtaagatcaaagtgtgttttgattcctatttttgtgatgaacaattgacatcagtgattattggttttgatatttggagttaatctacgaagtggattttgagatgattggattttacggggtccggtcagaccgggctagtgtggctgatcagaccggtgctatgcgacggccaacgttgtgtcggtttcggtttcgggttgtttctttggatatctgagtttgtttcatgtttatgacttctagatggatactatacatatgtattactattgtttgctaacaatgagtcaagttggtgatagcttggtctcggaatatggtttctttgtttgattcatgtgtaggtgactcgatgcctcgggatagtatttgcggtgatggatcgggagtcggcttggtggtaagacgatgtccgtggtggtcagatatcatacgggatacttaggctagagttgatgcacatggt

SEQ ID NO: 8281 - DNA, 3766 bp, Oryza sativa
tgagtttggttcgtggctttaggctgcctacctcatgtataaatagagggggagcgtgaggcttcctggtatctctttgtgtatcgcttgagagagcaattgagttgctagtttagttagggtttcgagtttagtcgagatttttgtaaagattgctgttgttgcactttgtaaacacagagagaagcaataaagttgtcatttacttcgagagttcttcgatttgtgttttatcgggttcggcggtccgaccggcaggataccggcggtcagaccggcggcaagcgacgatcagaccggcgggtacacggcagtcagaccggcggcagcaggcaagcgacagcaggcatctcaacggttcgaccgatcgatctacatcggtcagaccgacgttcatcaggcggtcagaccggctcttacacttcggtcagaccgcgatccgtcgaatttgagggtaacttttatttccgctaaaagttttggtttttgggcataccaaccattcaccccccctctggttggcttagttcttgtgtttcgatcctacaagtggtatcagagccatgttttcttctttggattttaaccgatctaaagtttttgccatggctgctaataggttttcaactaagcctcatgtttttgatggaacggaattttctcattggtgcagtaggatgcagtcttacattatggctgaggattgtgatatttggagaaaagtttctcatccttatgtgatccccgaagaaattaatactgctgctttaaaatatgagtttgaagaaaattgcaaagctcgcaatattcttttgagtgggatttctcgttcggattatgatcgtgtttcttatcttcaaactgccaatgagatttgggttgctttgaataattttcatcaaggaacaaataatattaaagaactttgtcgagatcttttcaaaaaaggagtacataaaatttgagatgaaacctagagaagctttggatgactatctttctaggtttaacaaaattttgagtgatcttagatctgttgattcttcttatgatgttaattatacacaatttgagatttctcgtcactttttgaatagtcttgacatgtctatttgggagatgaaagttacatctattcaggagtctgttgacatgtctactttgactttggattcgctttacacaaaactaaaaacacataagatgaatattctttctcgtaaagttgatcttaagtctagtgctttggtttcttcctcgacttctttggatgttcttcatcatcgaattctactgcttttgctttgattaatgccatgtccgatgagcaactcgaacagttcgaggaggatgacttggttttggctgctaacaggttttctcgagctttgaataatgtcaggaataggaaaagaggaggtcataatcgttgctttgagtgtggtgcacttgatcatcttcgttcagattgtcctaagcttgggagaggcaagaaggaagaaaataatagagtcaaagaggttgaagtgtgaacatgctgatgaagcccaaaaggggggggtgaataggctgtccctgaaaacttaaaaacaaatcgcagcggtaaaattcaaacagacccggaacttcctggtatggaacaccggaacttccagtctgccaggcccgggacttccggtgttctagtgtaggaacttccgggtaacagaacaagaataaaattcagatttcgaaacaggagactaagccaatcttcacaagatgatgcacaggtattctaagcagaggacagatcacagaaacatcacataaagagacaagagcgattttttcctgaagttcggatcttgtgatcctactctccgttgaggagctccaaagagctgggtctcgattaaccccttgcctcacttgtgcaaaaaccccagaggaaatccacagcctttaaccccaaacactcctaagcaaatttctagaattaagtgaccaccaagatccaattcaacctacttctagaaatccgccacaagtgtaggttgctctacttggaaagcctctaaaatctcagcacaagaacttcattaatttacctcgttcccttttgaaggagaggagatccttcacaaacttacccgggacatccacaatatgcaacggattctcgtggatgacacctaaccgtctaggagatcatctccaagagtaataagcaccgagatgacagcccacgagatattccaagtgctcacccaagatcctagtctttacacatctccaaatcttcctctctccctctcaatctctctttctcacaagaattaggctctagattgagtggagaaggcaagaaacacttgggagaggctagcaacagctctaggttcgaaaagtaaaagtggaatagccaaagaacgagctggaaacgagctggttatgtataacggctaggtgacgtcatctagccgttactgacaattttgaactggaaactagacaggaagttccagacctggaagataggaacttccggactacacttaggaaaatctttttcacaagaccggaactttcggacctgaaagacaggaagttccggacttgcatttttggacagatggagtatttgcaaaaataactcctagggaaacttgacacttgggtcacactaagagcacttaacatatctcagagcatcacctggaacccctcttaatagtacggtttttcctaaaaaactcgattgcaataaataaactatcctatgcacttctcgagtttcggtccgctttgattctatacttttgggggggtctccaagcatgtgtaacgctccgcttctcgtgggacgttaaaaactaatttggcaaaatcctatatgcgaaaatttcattttttgtgtgcgagtctaagtcatgctgtagatctcaatttaaatctccttgatcctcctcctcaaaatccctattccaaatcaagtctccgaaatcgaacttcgaagttcaatcgcatcctttgaatcctcgccaaacactcactcccaatccccaaaaatatcaaacactaccttgagtcttccttgattcctccctgaaccctcgagttcgaatatcgaatttaaatccaaatccaaacttcaattctctccaaatcagccctctctatgaaagtctaaatcgcctccctcaagttttgtgggtcgattttgtccccctcggcccatctcccctctgcctatctcctccctcctcctcacacgtgctatgcatgtgcgccgcccgagagagtgtcgtcgctcttcctctctctctctctctcgccggtcgaccaccgccgctttgccgattcccgccgccgcggtttgaaccctcccgccgccgccattcgattttcgccgccgcccgtcggtttcccccgcgcgcgcgctcgcgcgtggccagtcgcctggtcgccgcctgtgcccgctctgccgcctggtcccgctactccacgccgcgtgcttccaaaaccgtgagacagagcgcctctctcacgcgctctcccccctccctctgctcgcccaaattggcaaggcgcagagctccctttttccctcccttttctgctttttcccctgaccaccaccgccatgccctatcgccgcctggtcacttgcgcctgtgaccgccagctcacggtccttgcacccttgaccgccctatgtcggttccccctcccaaaccgcctcttctccatctataaagcccaagccgagcctccccatctcatt

SEQ ID NO: 8282 - DNA, 2819 bp, Oryza sativa
ctcgccgccattgccacccgctcccggaggccgccgccgtcgctagccctcctcggtgctccttcgccccacccggcgccggaaacggattccccgacccccatagatactcccaccgctttgaatcgagctctcgttgccccgtcgcatttcccctcttatcttgccgccggccgccgctgccgcaatccgccgattccggccatcccccggcgaatcagagcctatggctcgctttctcttgtccctcccgccactctggtgtactccccctcccttgaacccccgcgaatcgctccggcgaacgccgttgccgtccgccgtcggatgccggcgccccctttttcctcctcctgccggcccgcgtggctgccacgtaggcgccacatcggagccacatcggccgcgaccgggtcagcacgaccagcctgccgcctccccctccctcgaccggtgcgcgcggtccacggagagccctatggctgcgcgtgggcccgccgcctctcggtccatccgacacactacccgtgcgccatcttcaccaaaccctagtgccgcccccgcgtgaacccattcctccgtggacccagccgccgataggtgggcccgtcccgggaccccgcatggtggaccgcggtccacccggtcggtctcctccccctcctgcgccccattaggccgccctcctcgcggccgtgccggcccattaggctcgcccgagctgcgcaagtccctcgagccgcgccaatgccacccgagacaagtctgattcacatctctcgtccatttccttttccaaaggatttaataaatccttttcctttagacagaaaatacaaataatcttaggaaatccatatctcctcaaccgctcgcccgattgaccccgttccacttccagtaattccataaaattgagatctgtctaatggcactataatttagtctaaataggatcttttattggtcttttgtttaggttctgattgtttacgtatagttgcggttaccggattttcgtcaatcgtggttttctcgaagattcgtgaagcttcgtgaagaccttgagcaaggcaagtcaccctttgatcaattgctcctataattggaaaatcattattattttgtttgcaacttgcattattagaatcacacacttaacttgcttggcctcggtttgcgtgccaaaccgacggacctacccagtagtcgcactaattcctgtaggctgtactaccctgattccttgtcgctccacccttgtggtacctcggtatccgtgctctctaagcgcgtataccaaatatcccacatacaccgttgattgtcgaaaacttggaaaatgggtttgagaagccttgaaaacccgacatgtggtgtcggtgtgtttgaaaataaaatgaattgtgaaaactcgcgatgcgggtgttgtgcctatgtggcgtcatcccgtattcgcatataaggaccgattcctgtgggaaattcatcaagcataacaagtgcaaccacatggtggtatgggacaccctggctaagtaattagttgcttttgggaaatcttgtatgccaatagaggtggaaagccgggatgtgggggtagaggcatcctgggagtccgaaacagaggaaggcacccgggagtcctaagggaaagccggagttggcccgatcttggtcagggagaccctctatgtggcatgaggtgacccaggattggctttggaaaggccttgtcacgaacctccgacaccagccagtgtctggagtaagttcgtgtcttgtgggtaaagtgtacccctctgcagaggttaactaactgttcgaacagccgtgcccacagtcaagggcggatgtgaggtgtttcccgttgcgtagatttgtttgccagtgctttgtgaaaagttgttgtggtgtgggaatcgtaaccagaatcagcctatgtggcagatggatgacctgagtggtcagaaacgaatttgtgtgattcggaatgtctacgagcatcatagactaggcttcccgagtggaagcggattgctttgctgctgggcagctggactctgggagtccgcaaaaatgaaaaaggctctgggagccgcctaatcaagtgaaatggctctgggagccgaaaagtaatgatctgacccgggaggttggtacattaccatttgagttgttgaaaatcatcttttaagtcgaatcgagacgcaagtctcctttcgacccaaacttaaaaagaaataaatcacgtagtgatttcaaaaatgatttcaaacaaaggatttgcaaaacaaccttgcctctcttccaagcttgcattaaacacctaagttcccgtgacttgctgagtacgaaagtactcacccttgctctatataaatatatatagttcctccgtcgtgaagtgaagatgaagtgaagtgaagattagggttttgtcctagttcccagccgtcgcctgtggtgttgggtgttagaccgttggttccgctgctgctgttgttgctggtgtttcctcgtctgtgtcttcggttgtattctcaggctgtcctgagctgcaacctaagttaaggtaaataagtcatctatttgttttaaggatttgcaatgatccatatttgtcaccgtgggtaccagcactatgtcctgggactggtactgagatcgcggtttcgtaggaagctgtcggtgacatggggctgggggtatcgtgactagaggccggggtagccgcgatcacccacgtggcctgaccccctcgagggggtcgggcccgagggtgacgtggccacccctccctctgtctccccgagggg

SEQ ID NO: 8283 - DNA, 3607 bp, Oryza sativa
ctccctctgtctcccgaggggtcgggccgctcccgtttcggccccgaggcctggaacgccccgaccccctatggttttggcgccacgtgtgtgggataggtgagcccagcggggctcacctaaccgcatttatagcggattggacgagcgcgccacgccgcatttaatgcggcgcagcgcacgcttatccggtccgtgaccagtcgcggtatgtgaccggtcacagaccggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatgggaagaaagtcgctggccattgaatgaaggttgaaatgggcgtccaccgggagagctgacgagcggagcagaaggcgtgtgctgtgcttgtcagaggtcacttccggctatagactagccctcattgtaaaaagcatgtttcctttcttaggcagctagaggcccatgtggtgacccctgaccacataaaaaggaggcccaggcctaggagaggggggtcgaactctggccacttggttctagagcctgagctctctctggttctctcgagctgtattccttcacacacagatccaccagaacacaggagtagggtattacgcttctcagcggctcgaacctgtctacatcgcccgtgtcttatgcgattcttctcgctgacattcctcagatcgagggcgaagaacctcacttagcgcccccggccgaaccggcaaaggggggcctgcgcggtctcccggtgaggagccccaagctccgtcagaagcggtttgcgccgttattcctacgacacgctcctgtcaagtgccgttgtacggcgatgccggattggggtgtgacagcatgcatcttccacaccttggactaatgcacctgaaaattagctcaataaactcattagtcccttaaccacatttgtcattaatcaccaaaacccactagggggattaatgcactttcaatctccccctttttggtgattgatgacaacatggttaaagcttacaaaagattgatataaattttgttttgaatggttagaggtgaatgaaactcccccttagtgtatgcatatggaagatatgagagaaactcatatgcatatgaataagggaacaactgtggagagtttccttcatcactactcattcgtgggatgcaaataagcagtaagaatagatatgatatgcaaatgatatgacatggtgagcactcaaaaagaataaaatcaacatcacatcacaaacaagaaataagacactcatagcataaatgaagtgcaatatatataaggagcagctaagagcatctaacagtcattacatccacacaactagagaaatattacatgtccacaagtccataagagtagaggccaaaggactgccaggtccggaacttccggataaaatacccggaacttccggacaagctgacaggaatatagagcgagggagctgccaggtccggaacttccggataaaaggatccggaacttccggataaacagacagagcaggcagcaaacaacaaaaacaaaattttgaccctcttcgattgcaattttctccccctttggcatcaaggcaccaaaaagagacaaaatcacaagggaagaagaggatcaagcctcatcaccatctccatcagaaggaatgatctcggtgtcgccggagtgaggtgagtcaatgtcttgcccggcggcgtccactgcctcatctggatctgtaggcacattctctgtaggtgcatcggactctgggtcagggatatcatcaccaccatcatcattgctgctctcctcagagtgggaggactcctcattgaagaaatgagcagtgccagagggtccctcaccactagcaatgtctcgagcagcctcataagcagcaaaaggatcagcaaactattcatcatcagaaatatcagagacctccttgcctgctgcaatccaatcttccttctgacgcctctctatcttcttcaccttcttagctgtcttagcacacatgcaaaagatagcccggagagccttctttatgggggaggaagactcagagcgctgtggagcagcagaagaagaaggagcagctgatgtagaagcacgagtctccctggcagaaggagtagctgaagaagagggagcacgaggacggaaagacttgtgctggttatccttgaaataacaaatcccagcctttgcctcaatcatcttcatgatataaggagcatagatgcaacccctctttggctcacacactgtctcatagatctcactccagataagcttcatgatgctaaaatctgacttgttgtagcgcatgcgactgaggagaagcgcatgcctaccaggaagagctgtagcatctcccactttgaggagcaatgaccacctaaagatagaataaagcactctatagtatggaagcaacccacaagtagtccccaaacaatccttgggagcatccttctcatacaagaaagtagtgctggtcactgataaagcatcctctgcaaagagatgtggacaactcaggtcatcatcatctaactccaaagctgcagcaaactgagccatagaaacctaggattcaatcaccagacacaaacatttatttaccgacgtgaactgttagtattttctcccttgatgatagtatttcaaactcgccattctaaaaagtttccccgaaattgcaccatatgcaagaatattctcaccacgtacgatttttataatagatccaatatattgggtttttttacaaccgataagaaaatggattattgctctagctaacaatctgatccaagactccaagcaatttatagtactataaaaaaaagaaagaagtttcttggaagtttctgaacatgaagcttgtccagattagtagtactaggatacgtcacatccactcaaaatcccttatattttaggacggatggagtactctagttcgaaatatctagtaactagcaaaatgcccgtgtgttgcaccggataatgatatggtgactgaactttgatttgaactatttatatgaagaaaatgaattgaaatattttttgatttgaactatttatttgatttgaaattttcttggaatttacatagcttaattgctaattttgataatacaaatatcatttcagcatttatttaaataaaaattattttttctctatgagcctttttcagcccattttcttcttcagcccgcaagcgaccgacggcccgcgtgcggcccaagtgatgtagcccaagtggtgcggcccaaactctcgatcgatctcaaccgttcgttttcgttttgatggacggctcaaatcagtttgaaattgataaaaaccctaaccctccccctccttcccagccgagccgagccggccgcctcccccctccccatctccccaccggcaccgcttcccctcccttcccctccggcggggccggtccctttccgccttttcccctcccccca

SEQ ID NO: 8284 - DNA, 11017 bp, Oryza sativa
  unsure (1)..(11017): unsure at all n locations
gcgctccctctcccgctctccttcttgtctcgccggcacggtatagcgacgacaggtgcggcggattttttttgcaattttttccatggctattgctaaccaaatcggattgtgtacggatgaaaattagatgtgacgaaagaaaaaatacaaatatttatattagttatagatatagatagtatcaggcaagcctcctatttaggtggtattattcgtgctacagtgcttatttgctacggtatcacacagaactatgttgtactgggctactgcttctctgctctgtgggctggctactgggctacgtttgctttttgttgggccggcctgctgccgtcttggctgggctgctcgcttggtttttctttttttcgtttctcttttgtttgcggagcgtcagagatcgatcgccgtaatgcatccggattcacggattagcggcgtaataatcacgtgggcccaccctttaatgacggacgaaaaaaatcaaccggaagccttacttattttttaattaggtactagcaaaatacccatgcgttgcattgggggaagaaaaaatagtaattagtgtgtgggagcataaaaccaccaggttcattgaggtctttatagtcgaatcgaatctttgtagtgcaaataagacgctaacatgatataattatttgttgctctaaatccactgacatggatactaaactttgaaaccacaaaaaatatttacttttttgtcatgtattattatgagtcaattgcagtactttgttattttttttggtactcgatattgataagcacttttttttcatattgtaaagagtagccataatataagaaatattttttgctagctatcagatcaacctcactgcactccaattgcataaccactcacttaaataatcagaaggaaagaaaaaaatgtggtatatcgcagaataactttcactctaaataatagaagaaattatacaatgaatgaaaaaaaaagtgatgtgattaggtgtcctgtggcgaatgagcaattgatgagcggaaaaaaatccaaatgtaaacatgattcaatttgttggtgattactctttctaaaaaaaagaaagacacatgtgattatttttatttttaaaaaagaatttattttgtcggtaaataattcattttattggtgactacatgttttaagtaataagatctcttctttttcctgcttggcgtgagtccaaactttattcgtgttcggttgctacagtgttgcgcagtactgtgctgggctggtgggctgcttctcctccgctctgtgggctcgctggtgggctgcggctgctatctgggccggtctgcagctgctttggatgggctgcctcgtcactaatccaatccgggctgctttggatgggctgctccacaaacaaggttttctctttttatttttattttctcctttatttgcaggcgtaagagatcgtggccacgctttcggatcgtggattagcgacgaattatcgtgtgggcccactcttaatgacggacgaaaagattaacaggaagccttacttattttttaattaggtatagatatagatgtcaaccatgaagctaaaataaaaacgttccacatctcattggtcaatctgatctgaccgtgacaggttccacatctcatgtgatctgtctgtctataatattgatcaaggccttgtttagttccaaactttttcttcaaactttcaacttttccatcacatcaaaacttttctacacacataaactttcaacttttctatcacatcgttccaatttcaaccaaacttccaattttagcgtgaactataaacacaccccaagattcgaattgtcaaagaatagcaagaagcaatcagaattcagcagtctgtcttccctgaaacttttcttcataaccaagtcttggttttcataggtgactgactgaatgcatgacttcgcaggcactggacacgtgtatgcaatttctcagaatctctagacttctggtctagttccatggtcaggtctatagacttgttcttgcagttctgattctgactttctgaccagtttgtgatgcccccaggtacatatataagaaaaatctgggtattgatcaatcctacagttaaaatttcaagatatcattcatctggtaggctggaagcaaatcagtagtttttttatctgcagagaaattataatacaagagtagatatatatttttttaggaaaacaagaatatatatatttcctttggaaagtagaagtgatagttacatttttgttaaagaatatcaaatgcaaatgataaaacataagacgtgatcagttactaaactatgcatagaactatctaatccaacacggcctgcggtgaagcgtagctatagttgctgaatgggaacagcccagactaatctttgcagcagattattggttaatacctacaatagatgaagagatggagcattcttgattttacatttccagagcacgctcagcatgaccatgtaattcatactgtctgggtggaatttgcaggcacagagccattctgaattggtcgaggctctttgccatcagcacgttcagacactcccatggatatcctgggaactgtcgtcaattctaatttcacggagaggtctatcagccacaaagccattgcccatgctgttttgtgcttgattagatccttcatgagcaccgtttccatcatccacaccaggactttgcacatcagaaactctaatttttgtgtattgggcaagaactgacattgaaatgcttatcatcagcatgagagctgacataaatccatagatgataaaaagaccagagaaactctgcaaagtgagaggtgtcgaatctgtgttggggatcgcattacttggagagacagcctctgcaccaaaccaatttcacttccatacgtgagccctcatccccactcgttacatccaacatggcagttgaaagattatgcaccagtggaaaaccaggaggaaacacctgaagggaagaaaacatgatgcaatttaggccagattgtagcatagctcttaaaggaatatgagtgaattcgccaaagcaatggagtgagagacttacgaaaccaaatccaggcgtcttatatatacgtttaagcatctggaattcgttctcgtaatgagggtctgagacaatagcggttaaaaatgggatctcatcaacgatagcagacacacctccattcttggaccccttcctcaaagattctgcatattcctgcttctttgagtaggatcttagccttccttcactgaaacctcgtcttgtcaaaaatgagtgcacgaaggatccctcttggtatccaacataatcaccattacacaggagctggtcaagatctgtcactgagggctggaacctcttaacagttagaatggatgccaagctagctccgtagctctgcacaagaaccaacaccacgaagcaccagcttaccacaacaattttcgacaacggacttttaataatttgacctgtgcatagtaaaacaaagatagtgggtaattgaagaactattgtaagaaaatagctaaaccacttaatactgcatcaaatatagcctgaaagctgagctccaaatactaaccatgagaaaatgtcaaagtggagaaagcaaaatagagagcagtgcagaactgtcttgttcttgatccttggaactccatgtttctgggacgttcaatcatcgaaataaccaaggcagtgaataggaaaaagtatcatagtggcaaaccaaagttcttttgtcagtggcttcaagaatacccatttggttgttgattcagattcattcttcgcaagcacaagcattgaaaccccagactcggtgtacggcatcgtgaactccacctggctagctcgatcggcagttatggttatatcccccactgcagcatcgttgatctgatagtaagaaccagcagatatagtgtaagaattcggttctgttacaatgtcatcaaagcacagggagtaaggctttacccctgaagatacactctgtactagctggtcataagaaccattgaagacaacaaactcataactcagatgatttggtaacttcttcatggcagcctcaaagacatcaatgcaatagccagtgacaccttgtgttatgtggggcattcagtatcagcgccggaaccgatgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccacttagggccagcgcctaacattttggtatcagacttccacgatcctctccctcgccgccgccgcgccatgtcttccaccgtcaccaacgtcgccgacgattggaagaagggtctcgctgaggtcctcgaccgcttggactccatccgcggcaagctctccgacctcgacaatgaacagcaggcgcaccacatcgccatccagcgtttggaacgcgctggccgcgatcgctcgccgcgccgtaacaatcgcgaccgtgacgacgaccacgacaatgacggccgccgcggtgatcgtccgccacgctaccacaagattgactttcccaaattcaacggccaaggtgacccactccatttcctcaatcgctgtgaacaattcttccagggccagcgcacgccggaggaggagaaagtttggctcgcatcctaccacctgctcgacggtgctcggcagtggtatatgcgcatcgaacgcgatttgggcacaccgacatggcgacgcttctccgacttgctcaatctccattttgggccgccgttacgccaggcgcctttgggcaaactcgccgcctgccgacgcaagactaaggtggccgcctacatcgaccgcttcctcgacttgctcgctcgcgctggccctctcacggaggagcagcaagtagacctcttcaccaccggactccaagaaccactcagcatcgacgtacaactgcagtacccgaccaccttggagttcgccatgaatctggcgcgttcgtttgagcgccgcgagctcgccgctcgcactacaccgtgacacaccgctcgtgaccaggcgtcctcttcagcggcgccgaccccgtcgcaaccggatgcagcttcctcggtgggacaagcgtccacacaggttgcaggccgcacggttcgccgcctgtcccagtccgagatggacgaacgccgacgcaaaggattgtgcttcaactgcgacgagctctacgcccgtggccacaaaaaggtttgcaaacgcctattccttcttgatttggcttatgatgatgatgatgacgaggtggaaggcgctgcaccggctgtcgaaccggagacgcttcgcatctctctgcatgcggtcaccggcgtccgtccgtccaacgccatgcatctccatgtccgcttgggcgacgccaccctccacgcgctcgtcgacacggggtcgacacacaacttcctgtcccaggaggccgcagcacgggtgcacttgccgctcgtccaacgcgctggcctgcgcgtgacagtcgccaacggcgacaaggtgccctcgccagggatgttccaggacgcgcgcatctccattgacaccgaggtgttcatcaccgacctctacgtccttccattgggcggctacgacctcgtcctcggcatgcaatggttgtcaacgctgggccagatactatgggactttggccaacttaccatgtctttttggcacaaagatcacatggttctgtggcgtggcctgcccacgggcgcttcaccggctgcgcacgtcgccaccacccgcgacctgctcgacgacctcctcaccgagttcgccgacgtcttcgccacgccatccggccttccgccaccacgccatcaagaccaccgcatcactttgctgcccgacaccgcgcccgtggcggtccgaccttaccgctactcggcgcgccacaaggacgaactggaacgccagtgccgcgacatggaggcccaaggcatcatccgccgcagctcgtctgccttctcctcgccggtcctcttggtcaagaaggccgacgggtcgtggcgcttctgcgtcgactacagggcgctcaacagccgcactgtcaaggacaaattccccataccggtggtcgacgagctcttggatgaactccacggcgcgcgattcttctccaagctggacctccgctctggttatcaccaggtacggatgcgcgacgccgacgttgagaagacggcattccgcacccacgacggcctctacgagttcttggtgatgccctttgggctgaccaacgcaccggcgacattccaatccctgatgaacgaggtacttgagcccttccttcgccggtttgtgctcgtgtttttcgacgatatattgatctacagcccgtcgtggtcatcgcacctacaacatctgcgcgccgtcttcaacacgctccgcgcccacaagctgttcgtcaagcggtcgaagtgctccttcggggacacctcggtcgcttatttgggccacgtcgtctccggccagggcgtcgccatggacgcctccaaggtgcaggcagtggtggactggcctcgcccctgctccgcgcgagctctccggggcttcctaggccttgcggggtactaccgcaagttcatcaacgatttcggcgccgtggcggctcccctgacacgcctgctcaagaaggacggcttcttgtggtcgccggaagccgaggtagcgtttggacgtctcaaaaaggcgctcaccacggcgcccgtcctcgccctgccggacttcgatcagccgttcatcgtggagtgcgacgcatcaggcacgggcttcggcgcagtgctgcatcaggatggaggacctattgcctatttcagccgcgcctttgcgccacgccaccacgccctggcggcctatgagcgggagctcatcgggttggttcaagcagtccgacactggcggccgtacctttggggtcgccggtttgtcgtcaagaccgatcacttcagcttgaagtacctgctggaccagcggctagccacgctcccgcaacaccactgggtcggcaagctattgggctttgatttcgaggtcgcctacaagccggggcggcagaacacggtggcggacgcgctgtcccgccgcgacgagccggctgcctcgctttgcgccatcaccacgccggtgtttgactggctacaggatctgcacaccgccaacgacacggaccccgcgctggtcgccctccgggaccagattctggccggcaacaggacagcaccatgggcactcaccgacggcatcgtcaccttcaagcagcggatgtacattcccccggcgtcagcccttctccagacggccctggcaatggtgcacgatgacaagcacgaaggcatccagaagaccttgcatcgtctccgccgcgagttccatacgccgggtgaccgccgtgtggtacaggaattcgtcaaggcttgcgccgtctgccagcggaacaagacggaacatctccaccccgccggcctgctcctgccactgccggtgccgtcggccgtctggtccgatgtgtccatggacttcgtggaaggatttcctcgcgtcgcaggcaagtccgtcatcctcaccgtcgtcgaccggttctccaagtacgcgcacttcatcacgctgtcgcacccatactccgccgagtctgtggcgcgcgccttctacaccgacatcgtacgtctgcacggcatcccaacatcgatcgtgtccgaccgggatccggtgttcacttcgacattctggaatgccctcttcgcggccacaggcaccaagctgcacatgtcatcggcgttcctcgacgacattcgctaccggctggagcaggcccagcagcatgcaaagaagttctacgaccgccaccatcgggagctgcaatttgtggtgggcgactgggtttggctccgtcttcgccatcgcgttccggcatcattagcaactccggtaaaaggcaagcttgggccgcgctattatggaccatacaaggtactggaaattatcaacaaggtggcttatcgcctcgctctgccggctggggcgcgcctgcatgatgtgttccatgtcggtcttctcaagccgttcgtcggcacgccgccgacgtctccaccggcgctgccctcgacactacacggagcggcgttgcctcagccagcacaagtactcaagtctcgtatggctcgtggggtgcatcagctgctcgttcgttgggacggtctgccggcatctgcaacgtcgtgggaagacttggacgatttccgtactcgctatcccgcattccagctcgcggacgagctatttgtcgaggaggggagagatgttatgtggggcattcagtatcagcgccggaaccgacgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccacttagggccagcgcctaacaccttggtcagatacattcacaaaagcgctaaaaccatgtttcagtggcacagcaatcttgaggtttctcctcactccaacatttatcctcccggtttctgaattaggaaaaaaaaaggttagttcatgtcaattgtagatccaatattaaaaaaaaaggttggacaccaaggaagaacttggtgtcaatggttttaagaaaggagaggtaaatatttccctggtgagcgtgctcgataagggtcgaacccgggccgacggggtgcgtgccagcgacccctgccactgctgcgctactagcgcatctctagatccaatattctctcgtcctatgagcaaaactaaactacgtggcacagcaacaacaataattctttgcgtatgtttgcaccatgttctttaagcattactgctaggcatatttcataggagtacattgttaaggatatatatcaaacgaaaacatatccctccactatatttttatggatgacagctgggatgagtgtgagaagttaaatcagattctcaaatctgcaagatggatggcatcttggatgaatagaatctctggttgctccaggcgggttgttggtcttttgatcttttctatcttttatttttattattgtttgaactaggtcaatcctgtatgctcatttctgatatatggaaactagcatagtggtccacgcagattgcgcggctagcatcattatattttctctcatataataacatatatgttttctcaatgtagtattcaaatatattaaaatgacaacataattttaaattttatactaactttacgaaactactaatgtgcaatattcatattgtattttatatacgtgttagttattaattattttcaatataaaattttagttatttgtaaattatattatatgaactctagactcgtctttcaatatttcttttttttaattcagaattttagttatctatgaattgtatttctatatagactctaggctcttctttcaatattctttatttttaattttgaatttcagttacttctaaattgtattcatatattaactttagactcttcttcctgtgtttttttaatttcgaattttagttatttgtaaattgtatttttacacgaactctaaaatctacttttaattttattatgtttatttagaattttagttagttttaaattcctatatggactctatactctacttctaatattccttattttaattccgaatttctatcatttcttaattgtatttctatatggactctagtctcctcttccaatattccttgttttttaattccgaatttcaactatttctaaattgtatttctatatggactctgtttttctttttctccgattaatatgagaatttttaggccgtgagagtgaacgtggagactcatttttctattccttcaataacttaatagattggagaagggatcgcgtcctcttatatcattttttttaaaaaattaaaggataccaccgtaaatagagccaataatggatagatatggcaattgatatgatctgctgaaaaaattttgcgtactgcttgtttgattctacgatactgtcatggcaatcactatcaaactggccccgcataagaaaagttaaaaactaagaattcgtggagtgaacaatctatgaactccccgcgatttttttttaaaaatacaaactcttagaaaaattaggatgaacagcgaacctcctcaacttagatggaagaatggatccacggcctttaggggttggtgcggcggagggaccatgcgcgcagcgcgcatgaatgctgcagtaacggagctctgactcaggcggcgcggtgtggttggggaggtgggggattagagcaatacgggtagaatcgcacggtatagcaaccggtggcgcagccgcgcccctccataggggtggaccaccggcggcggcggcgacggtagcggcggcgcggcattgggctctccgtctgaacgatggtgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8285 - DNA, 2584 bp, Oryza sativa
gtgcgctaggacgagggcactaggagcgactgagcaattcgggagtgatgcggtgggggaggaggaaaggggtgccactccatgcacgatcattcgcgcgttagacatccttaagtttctcacattccattctctttctactagtatgtgttaagtaatttaacatgaacttaaaaataagttataatggaagtgtcaatgcaccctagttcccagatctttagagcatctctaaagagtggctaaatgattttccatactaaatttgaaaaagaattgctacccaaattctgtgcatgccagaacttagcttttacccaaattttgctatgttatttatagttactcttatagttatgacctcatcatcgaatctcttatccacaaccgtacatatatcctctacggctctaccattggagagataagtactattgcacaaaatatgctaccatttgtaagtaagtacgtgaatttattgtctaacaaccctatgtacttacttctgttccttttaataaaacatgtgcatctcacgtgttcccaaaaacattatcaaaatacaccttcattatgtacttaattagacgcaatgaacccgagagtgatagaattttatcgtacttacttaccgaaacaattcaaactgtaactaaatttacatagaaatgctcatcgaagtagcgggggatatatagtaaacaattcgtgcatgcagcgacgtactccctccggttctttttatatgacgatggctagttcagtagtacttaagttgcaaatacaaataactttttttttgaaaggaatgttgcaaatacaaataataagcttatatatctcttcactcatattagcattaccattgccgtttaggcccaagcggtgcgccaccgtcgccgccgccgacgccgccattgccatctccggtgaactccaaaccgtgagcagcatgatgagcatcgcggcgcccatagccaaccgaggcatttcctccatagccgtacagtacgaaaacgtgcaaattaactgcaaagcaagagcttagtcgagctagctaattaaggagctaacacacagcaattaacagtgcatggcatctcgagacgaactgcatgtatatatataggtagaagtatacgtatacacggtttttttaaaaaaaaataagtatatgtatacaggcactactaattaagcaattaagtaatagtaattaactaggacactaacacgcaaccaacgtacacacggtttatacactgtcaaaatggctagttgacagtattttttttaatactatttgtgtttggtaatgtacgtagccagtcagaaattcggagtgtttcccaagtatagtagtatactccagatcaggtacagactgtgtcaatgcatgtcagagaacgtctcgattgggtattcagttatactattcctgtaactacctgctccttactatacgtttatataggccctgtttagttcgcgaaataaaaattttttgatgtcacatcggacgtttgatcggatgttggaaggggttttcggacatgaatgaaaaaactaatttcacagcttacctggaaaccgcgagacgaatcttttgagtctaattaatccgtattagcacatatagattactatagcacttatgggtaattatggactaattatactaaaaagaattcctctcgtgattttcatcataactgggaaatagtttttttattatatttaaggcttcatgcatatatatacaaaacttcgatttgatgtttttaaaaaaaaattttaaaactaaactgagccatactttgcagaatgttaaattataatcaatcattgacttgacttgacttgaaaactgaatttgagttatttatgataataattttgatggtacatacaaatagcttaaatgctactaaaaagttaaaaaaaaaacgttggtttaaaaaaattttctaataaaagtagatggaaaaagttcttaaaaaaaacatactatttaagagcttgataagcatatataaccacaataaaataatctaaaaagaatggaacctatcgaaacccacatgcagagaatatgagggtgtaagtgactaatccactaaatccagttataactaaaataagctacgaaaatatcttattatgatctatatatgcgtgggtttgtggcataccaacttatacacctagtagagaacagttcgtgtatacgaatacgagtagagcagtctggtgttctttcttagaggctaaggttagtttttgtagggatgaccaaatcattgggactccatgattagcaccaaacaggcgcgtcgtcccctgtaatacggtgcaaacgacgatgcgttgtctcgatcggctgacgaattcactggtggagaaaccatctttggtcggtcgcccgaaatccacaatagtctcggttccactaaaaaccgggactaaagatgatctttagtcccggttggtggctacagcgggcatatttgatctttagtctcggttggtgttaccaaccgggactaaaaatgatctttagtcccggttctaaatctgtcaggcc

SEQ ID NO: 8286 - DNA, 11381 bp, Oryza sativa
tctttagtcccggattggtagtcccggtttgaaaaccgggactataggggggttacgaaccgggactaaaaagcacttctccaccagtgattccttccctatccatttcaaagaacttgaatgttctacacgtacttctaacgttatatgtcttctcgattaatgttcaggtcttcggactcaacagcatgcaagtgggacgggctagcccgcaggttttaaaactcgtttaattttgcactggttgaagaaaaaaaatagtaattagtgtgtgggagcataaaaccaccagattaattgaggtctttataatcgaatcgaatctttccagtgtaaataagatgctaacatgatataattgtttgctgctctaaatccactgatatggacactaaagtttgaaaccataaaaaatatttatttttttatgtattattatgagtcaattgcagtactttgttattttttggtactaaatattgataaacactttttttttcatattgtaaagagtagccataatataagaaatatttttcgctagctatcagatcaaccttactgcactccaattgtgcgagcagcggtggcagtgccctcctggctatggcggcgcccttcctccctccccgcgagcggcggcggcggctccctccaccccatattgcctcccaggccccctgttgcagtcctcctctcccatctcccccttttcctcccgtctcgccggaacggcacggcgacggggagggaaaccaccggcagcgctgtttccccacggccactccctccccttcctccaccggcctccctcccgcagcaggtagatctggcagcggtggcggcctcgcggcagctactggtggcagcggcggcggctccctccacccccggcagccgcaggtggcgttagcggcggctccctccgtcccctgtcgcctcccccccccccccccaacttgctaaaacgatggcggtggcgggggcggcggtgcagctcggcaagccactgccagcggccactcgccggatctggccatgggaggcggtggcgactgctgctacggcaaactccgctcgatttttggttgatttgtttttttttatctccgtttgctattcttctattcttgtatttgggatctaacatgaactggattaaaactttgtatgttatttgatgcgaactcgtatgtatatgcttctatttgtctgattgaatttcgattggcatttttttggtttttttggttggggggtgatgcaattccaactgagatttttggggggtggggggcggacggacgaaaatttgggcacggacaatgtaaggattgaaaaaatatgaatattttaattagttaagattaaaattaagatttcttcatgtttatactagtagattaaaattgaatgtacatgtaaagaaaacgggacacaagtttattcatgtttatactattagattaaaaagaatgtacatgtgagttgcagtggcgaaaacgagtgcgctgccacctagaaaaaatggtaaagaaaacgagacacaaatttagtttacacatacagtggcatatatatatcaaagggaaagcacttcttttttttgtataggcaaattaaacatggtaacatttttcgcttgtgtgtcaagctgccctagctggatataataagcaaagtagcaatgccatctgatctgctctgttgtctctcggtagtcagtagatgcacggatcaaaaaagcccaagacaaacatcagctgaacatcattcatgctcattcagcatgaatctgatatcatgaatgaccagattatttgtcttgggacaaataatctctagacttctggtctagttccatgttcagatctatacacttgttcatgcagttctgattctgactttctgaccagttggtaatgcccccaggtataagaaaaatctggacattgatcaatcctacagctaaaatttcaaggtatcattcatctggtaggctggaagcgaatcagtagtttttttatctgcagggaaacgataataaaagagtacatatattttttgaggaaaacaagagtatatatatattgcctttggaaaatagaagtgataattacatttttgttaaagaatatcaattgcaagtgataaaacataagacgtgatcagttactaaactatgcatagaactgtctaatccaacacggcctgccgcctgcggtgaagcatggctagttgctgagtgggaacatcccagactaatttctgcagcagattattggttaatacctacaataaatgaagagatggagcattcttgtttttatatttccagagcacgctcagcatgaccatgtaattcatactgtctggatggaatttgcaggcacagggccattctgaattggtcgaggctctccgccatcagctagcacgttcgacactcccatggatatcctgggaactgccaattctaacttcatggaggtgtatatcaaccacaatgcaacccatgctgttctgtgcttgattagattcttcatgtgcatcgtttcgaccacccacatcaggactttgcacatcagaatctctaatttgggtgtaattggcaagaattgacatggagaacctaatcatcagcatgagagttgagatacacccagtgatgataaaaagaccagagaaactccgcaaagtgagaggtgccgaatctgtgttgggaattgcattacttggagagacagcctctgcaccaaaccatttcgtttccatacgtgacccctcatccccacttgttacatccaacatggcagttgaaagattatgcaccagtggaaaaccaggaggaaacacctgaaggggaacaaaaaaagaaaaaaacatgatcatgccagttaggccagaaaattttgtccagaatgtagcatagctcttaaaggatgatgagtgaattaagcgaagcaatagagcaagaggcttacaaaaccaaaaccgggagtcttatatatgcgcttaagcatctggaattctttctggtaatgagggtctgagacaatagcggttaaatatgggatctcatcaacgatagcagacacacctccattcttggaccccttcctcaaagcttcagcatattcctgtttctttgtgtaggatcttagccttctttcactgaaacctcgtcttgtcaaaaatgagttcacaaaggatccctcttggtatccaacataatcaccatttttcaggagctggtcaagatatgtcactgagggcttgaacctctttacagttagaatggatgaaaagctagcagtgtagctctgcacaagaaccagcaccacgaagcaccagattaccacaacgatttttgacaaaggacttttaataatttgacctgtgcatagtataacagagatagtaggttattgaagaagtactatgagaaaatagttaaacctcttaatactgcataaatatagcctactagttgagcctctaagcactaaccatgagaaaatgtcaaagtggagaaagcaaaatagagagcagtgctcaactgccttgtgttcgatccttggtactccatgtttctgggatgttcgattatccaaattactaaggcggtgaatagaaagaagatcacagtggcaaaccaaagttcttttgtcagtggcttcaagaatacccattcgattttttattcagattcattctccgcaagcacaagcattgaaacaccagactcggtgtacggcattgtaaactccacatggctagctcgatcagcaattatggttatatcccccactgctgcatcgttgatctggtagcaagaaccagaagatatataatattagtacttgattatataacaatgtcattaaaacagagggagtaaggcttacccctgaagatacactctgtactagctcgtcataagaacggtcgaagacaacaaactcataaatcagacggtatggtaacttattcacggcagcctcgaagagatcaatgcagtagccagtgacaccttggtcagttacattcacaaaagctctaaagccatgtttcagtggcacagcaatcttgagtttcttatgataaacttcaggcaaacctcctaagttcctcctcacaacagcatttatcctctcggtttctgaatcagggaccaaaaaaaaaaggttagttcgtgtcaattgtcaatccaatattctcatgtcctatgagcaaaaatgaacttcactgcacaacaacaacaataattctttgcatatatttgcccatttctgttacaataattctttgcatatatttgcacatttctgttaggcgcatttcataggagaagtcaagtacatatggaaaattaaaacatttccatttttccctcctccactatatttttatggatacttgtaaaattccgtgtactgcttgtttgattctacgatactgccattgcaataaccattcacaaacttggcccacataagataagaaaattttaaataaaaaaaaactaagaattcgtggagtgaacaagtcaggatgaactccccgcaaacttttaataataaaaaaatcctcaaaaaagaattaagatgaacagcgaacgtcctcaacttagatggacggatggatatgggatccacggcctttaggggttgggtgccgaggagacacctacaggaaggtagctctgattcagacggtgtagttggtgtggggaggtggggatgactttgcatgtcaaattttagcccaacataaaaaaaatactctcaaattccgtgcaggtggaattatccacgatcataaatatatccttctaccagatgagtgttatcgcaacaaatatgctactacaatttgtaagtaagtatgtagagtgctagacaataaattcatagccaacattgtcaaaatataccttcattatgcataaaattttggggcaattgcgtttttgaccttgttttaaagcctaactcccaatttaaccctgttttcttaagtttgctcatttgaccctcttttttaaaaatgaagatcacacttgaccctattacgagaaggcaacataatggtgttaacctgtaataaaaatatcatttatgcccttgctcatttgaccctactttatcaaaagtttttatttatttacccgattttgacaaaggtttgacaaattaatttgtcttagatttgacgaattttgataattaaaggtttgacaaacgtaaattaaaggaaacttgcagacaaatgtgagacacaagctagtgaattaacaggaacttggcaaagctttaatttgcacttcacgtacgtaaaccagataaacagaaatctcaccatacagagagttaatcgcaaggacatagcattgtcgcataattcagaaaatctcgttggataagaaggttcagaaaataattaattctttcaaacgagattagcaacacatccatccagccggcgcatggagatgatgggcgcgcaggagaggatgaaatgaagcagcagaggctaaccataccggagggcaagacatggcacggcacaggggcgtacgtgatggaggcggcaggggcaggcaggtatggcgcgtcgtcgtccctccctccgccgcgcgccagcctccgtcgtccctccgcgacggacggccgagaccgtagccgtgcgccctctgcgcgccgcctccgccgaaagcgcgcttgcagctagctagccgcgccgccgagaaggccgagatgagtgtggaccacgggatgaggaattttggggatagggttgaggggcattttgacccgtttgagctataaaatactccttccgtttccaaatatttggtatagttgacatttttagtatatgtttgaccattcgtcttattcaaaaatttttgtcaaatatataaaactatatgtatacgtataagtatatttaacaatgaaccaaatgatacgaaaagaattaataattacttaaattttttaataatacaaacggtcaaacatatttaaaaaaagtcaacggcgtcaaaaatttagaaactgatgaaatattttattattattattttttaagtgaaatcctaacggtgtacaccctccgtcccataaaaaaccaacttctgtagataaacctggacaagcatgtgtccaagtacatctcagaagttatctttttttttgggacggagggagtagggagatataggtcaaacggtagcttcgattttaaaaagtagggtgaaatagtcaaagttaaaaaaataagtatgaaatagtcaaaattaaaaaagtaagtcagattagtagttaagatctagaacatgatcaaataagcaattgtccctaaaatttttagctacgtatctcaatatattgtgatagaattataacgtatagttatataaataactagctgggtggcccgcgcaattgcgcggctagcacccaaacaaaatcatatatttttagtatgattttacttaaatattattaaatagataccttgttgtcttaagattttgaaagaccaaaccttatcacccccgtatttctaattaaatagtttttaaaaatcacaccagttactatcccttacttttgtcatatcttacttttgtcatatccttctttatttgtttgctcaatctatcccgggcgggggagtgatgtgggctgaagagaagggagagggagggggaggagaagaggacttgggaggacttgggaggaagaagggaggactttggaccacatttgacctaaagagagggagaggattatttttgcgttttttattttaataaatatggaattggtttttgttgttttaaaataatttcttatgctcttatacatgtttgattatgtcttctagtatttaacagtaacttttacccgtagggaagtatgggcattttgctattgagttaataaattaaaacccgttagataattacgagaagaagctagcttgatttagggctgaaaaattctttcggtcgaagaattcagggacgttcttacttatgttgtcaatgctcaggcctacactcgcttaatttatggcctgatacatctccatgtagagactgaattcagttcccatcatcgaaaaaaaaaagaaaagaaagaggtcaacgtcttgtgagcaaaccaaaatgattttcttgtgagcaaaccaaaaagaaaacagagagtatacctgtcaagccttgttatctagctaattaaggatacattacacatttattataaccagtagcctattgacattgctaagtattcaaccatgaatataacttaggtctctcacggtccggttaatcttatcgcacgcaataaagaacaatttttcgggaacgcgtaaaaaaaaaacagttcggttcattactttaattactgcccctttcgtactaaaataaacaaacacatctcacggcgagcaccgactcactcaacccttttatcggcaaggcgctcctggtctgaactgatatgacagtgtgacactgacatactctagtaaacgcttgtttattttagtactgtccagaagaaacattataccattctcatgcaacatgtcaaatcatctagctgaaaaccatagcaaaacaggctttttactagtagaaatactagaaaccatcgtaaaattgcttcctggttatctgcaatggaaatccaggacttcttcagagctgcactccaatgaactgggagacactgacttgaatcaagtctggaggagtgcatatgcatatgcacgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggccttatcctttaaataggggttggtcttaccctctacaggctcttctccacgtccaactcgggatagaaaccaaaggaaatacgaaacatgccttcccgagcaaggaaacccgagacccgatgaaaacagactcggactcggaccctgacggtctgactgcccacatatctgcggtcagaacggccctactagccggtcagaccgcccacacacctgtggtctgaccggtcctatgaaggaaacccgtcactttccaaactttgtcaatttttccctatttcgtccataggtgccaaatttgggtgtaaacataatgttcaacaataaaagacgataacatctgctttaacatctagggcgtgtttagttcacaccgaaattggaaatttgattgaaattggaacgatgtgatggaaaagttagaagtttgtgtacgtaggaaaattttgatatgatagaaaagttggaagtttgaagaaatattttggaactaaatagtagaggtgaaaacggtacggaaacggacagaaacgacctttatcgtttcgttttcatatttttttcggaattgaaatcggaatcggaaacccccggaaacaaaaacggaaacgaatattatcgaaaccgaaaacggagcgaaaacgaaccggcgcggatacggtaacaaaaatttatcggaatacacaaacccctcaaactgagggtcaaactttgtcaagtccaaatctcaagtctcaacattcaacaatacatcacaaaacacaaccatatcaaatccaattgtttctctcagcagtaccatcataaacacaatctatgcagtctgtaacttcatatttgcataacaaatattgcatggagttgcataacttcaacaagcaacaacagcaagtcagccatagtacatagttcatcacaaaacattgctgagaattacatagttcagcaatagtagaagtataaagtcagccactatataaacatatgttagtaaaacaagcacaaaccagggacaccaaggcacaaaaatttcgctccaggttctccattcaccagtcaccaccactccaccagtggggcttgagtcggcggcggtgacgaggacggcgcgagacggtggtgcccgggacgacgcaagacgtcgggggcggggacggggacggcgagcgactacacgagacgcggtggccgggacggcgcgagacgttgggggcggggatggcgagcaacggcggggtcgaggacggcgcgagacggcggtggcgactggcgaggacgaagcgtagggggcgatggccgggacggcgcgagacgagctgacggcggtggcacgagacggcgacggcgtgaggggacggcggccggcagcgccagatctggcgcgtggtgtcgctgccgccactgcaaatcctcacccggcggctgtgtctctcactctctcggctagttagtggccggctagacagtggagtagtacactagttactagtgtgttgcagtgttgggctgggctagtgactactgctagtactagtgtgttgggctggccggttggacacaggaggttttatggactttgtaatgtcggaaattccgagaaagttttcggaaagtttccgaccgattccgagtaccgtcgaaaactgctattattattttcgattccgttttcgaaaaattccgaaaaaattccgaccggctgattccgttttcgaaaaccagtccggaatccggaaatattccgtaccgttttcacccctactaaacagggccctagtaaaaccatctgaattgatatcaacttgtatctgcattggtgaatctatctgacactgacaagtttcaaagttcactgtcggtccagttctctgtctcactaaggctgtgtttagttggatccaatgtttggattttggttaaaattgaagatgatgtgattgaaaaattgtgtgtgtatgacatgttgatgtgatggaaaaagactgaaatttggattcaaactttggatctaaacacagcctaagatcatttacaatgcaagacgaggcgtgtggcaatgtagagccacgtaggcggagtgcatacgtggaagagaggaaggggtggggctcccatgacttgagctggttcgcgtagcctcgtttggctccgataacctcatcgaaagaaaccagcttttgtcagaagaatcgtgggaaaaacaagagaggaagggtagagactcgaaggaggaggacgaggcggcggcagcagggttcatcgccagagacggcgaggaagcggcggccagggcgtcggcgaggaaaccacgaccacggccatcctcacgccgcgccccgacgagccgcaccgttgtccacgtcgccgcagtgaaggatgagatggcgcaacaaaagctccggtacagagcaatttcagataataaatgcattcactaattaaaatatctacataactagtacataccaaaccaaattaatgccctatttggactgcaaaaaaaattcagatacagctattcaggccctgcaaaaatcagttcctagctgcatcccaaacaaggccgaaatgctctctgtttttgcaatttcaaaggggtactgtacataagtatatatcatccagtgttcatgagttcatctgcatctgatatgatgttcaggcatagggccattgtgcatgccattctgcattattggatgaggcctttcatcaccaccctgaaacccatcgtttccaactttttggacagcttgatcaggtgcagggttgctgtcaatgacaatatgaagtggccttgattcttcagtggcagtgctactagtactgcctccatgctccacatcatgaacatgagcttcgatcaattttacggtccttgag

SEQ ID NO: 8287 - DNA, 10299 bp, Oryza sativa
cagtacatacatcaaaagtttaataacatgttaaatacattggtttctagcaaaatatatgttggttattttcaaagcatataggtttaggttaaaaaaagagtctagtcagttataactgctaaccaagttagtttcaaaaatcattagtaacttctatgaacgagggagtacatcctaactgctgagaaatttctctcttgctacgtagcttgtgtgatccgatgcgtcatagataattacgcagaaggttgattttgggtttgaaaattccttccctcgaagaattcagggttctgcacatttcgctatttagagctgtcaatgtttaggtctacaatcagtatatcttccaagcgaagcaacctgactttcttgcaagcagaaaagagtggacacacgtactgattccctgattcaggctgtgtttagttcacgcgaaaattgaaagtttggttgaaattggaacaatgtgacggaaaagtttgaagtttatgtgtgtagaaaagttttgatgtgatggaaaagttggaagttcgaagaaaaactttggatctaaacacggtgtcaaatgatcaacaagaaaagttagcattgcttcaacttatcacagcctgtatctgcattggggaatctcatctgacaagtcacaaagttcatcatcggttcatgtttttatctcagtaactggtaatttacacaatattttacatatttacatcgacgcaataaaaccgtcaaaacagaacaactctagatggtgaataaacccactaaaatatctactcctacataactatatccaaccaaattaaggccctaatttggattgcaaaaacattcagatacaactattcagaccctgcaaaatcaggaaaaattcccgggtcccaaaacaaagcccaaatgctatctgattttttgcaatttcaaaggggtactgtacataaccacgctgacacatatcatccagtgttcatctccatctgaggatgatgttcaggtaccgggccattgatgcaattctgcactggatgatgcctttcattgccaacacttgcctgcatcagttgggcatcctgacacccatcatttgcaacttcttggacagcttgatcaggttcagggttgctgtcaataacaatctgaagtggtcttgattgttcagtggaactgctactagtactgcctccatgctccacatcatgaacacgagcttcctttgcgcatttggcgcaaattaccctattcacaacgcttatcaggagcatcagagcagagatgcagccactgatgatgaagaggccagagaaactttggagtgtgagagggtttgagtcactgctgctgctgctgctgctagggtttgcatcacctcctgtggactgttcagatgagccaaaccacttctcttcaatttttgaaccttcagtctctcctgtaaggttcaagatagctgtagagagatcatgcaccagtggagaacctagaggaaatacctgaatacaaaaacatgatgcaaactaattagacaaaaaagaacatattgaatttcttcatgtaagcaccacacatctgaatgtttttcgagaacacgcaaaaactttgcgcgatatactaattgcaaaaagaaaagaaaattgaagaattctgaatctaccaaagtgaacaagattgagaagcttacaaatccaaatccgggggtcttgtagaaccgattaaccatctgaaattctttctgatattgggggttggataaaaaagaagttaaataagggatctcgtcgacgatcgccgacactcctccattcatggacccctttctcagagcttcagcatactccttttgtgttccataagaccttaacctggatggcatgaaccctcgttttttcaggagtgagccaacaaatgatccattttgatatccaacatagtcaccggtaaggaggagctgatccaagcttttcaccgatggtcggagcctctttgcagttagcatggatgacaagcttgccgtgtagctctgcactaggatcagcactacaaagcaccatatcaccacaacaatttttgacaaagggctcttgataatttgacctgtttgaacattgaaagaaaccaagtaaacctctaatgatgcaattacaaaggagcaattttatgatctttggtgaggtaccacaatttccggtatgaaataaccatacccttttatactaaaatactaaaaatatacctaaaggagaccaaaatttacactataaatgtcatacgtctcgttacctttttcaaagtaaaaaaagatctcgttataataactatgtgctttatttatgtttggaaaaaatgtacaacaagctgtactctctccattcatgaataactagcactattgactatacaactgtcttaccttgaccataaattatttttaaatgatcatattgtaatgaatgaaaagttatatggttatatttacgatgcaacacagtccgataatataactcgttttcaagtatttattaagacaagatcagcgatccaaataaaacatgaatactaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcgagaattcttagaaatgtcattcaaagggacttggcgtaaattattagtccctgtttgacaattggcacatatatatatttttttaaagctagctatttctagttccagaaatctttatacctaaatatgcgaatatatttatagcaattgaatgagtcattttgtttgtattttataaaaaaatatacaatttcaattcattataatttgactttacaaactctagttttaaactgatttgttttacaatttgtatgctcttatgttgaggctgcgatattatatgatacttcttaattagatttcccaaggaacatacggactttactaattattttctataaaattttcggtaaaattcctcaattacaaatgatatataatgcggttaaatctaatatctcccatataaaagtgaaaaatataaagtgctcttttcctggtaaattggttaagcttatgcctttgatttgttttagttttcttatatttaatataatcagccttgttaggaaaaaataaatgttttagaaacataaaactattgtttttactactatctcaattttaaattaattattgttttagttttgtcttaattccaaatatgtttatctttgaacatcaactgatttctgtaaaatcgtaataatttaccacacatgtgaattatatattatgaaagtattattcaagttaaatctggaaacataaaccttattgtgttaactatattagattttagatttttagaaatattgatagtcaaagaccaaagtttgacttaggactacaaaactagaatgaacaaataacttaaaatggagggagtatagataacataattttataatttttaataaggtaccctggagagctatcatattttttacatgtagtaccaaaaattttacagccccggcatatttgtaaacgaaaattaatttgtgaataaaactttttatatgtgtttttaacaatataaaaacaaaggctgaaaaataaacttcaatgaaaaaaccctaaaatcagttgcaaatttaaggttgagatttcaaattttagctgataaacataagcataagtgaaaagatgaggcccctcgtgtaaaatttaggtatctcaagttaatttcttaaggactaaaaaattcaactaaaaataaacaagttcgtgggagtaattaaggcttacccctgaagatacattgcgtacaagatcatcatacgatccgtcaaagacgtggaactcgtacttccggcgaggccgcactctagccatggcggcgttgaagacgtcgatgcagtatccggtgatgttctgcctcttggtgtccgggtcgattctcacgtcgacgaaagcctggaacccggtcttccgcggcacggcgatccgcagcacctcgcctgatgatgaccttctccccgccaatcgccggcggtcgagacgacgaccagtcggagcgccggcgttgtagcggcggccatggggcggcgagccggcggcgcgccgtgctgatgagaatatggcggtgaggatgccggtgagcgccgccctggctgaagtgtgatcggcgccgaacggcggcgccgtcgccgttgcatggtggggtggatgatgtgatgacggcggaggagcaccgccggagatggggaaggtgaggatggggacgcggtggtggcggcgaaggcgggcaaccacggccgtatccgcctccgtggtgacgatgatggcctgcacctgtgcgttcttgataaggtcttcggctgcatacacaaattaacacagcccatgcacatacctttcgcataagttacacccacaaataagttattaatcaaaatatatgtcgatcgagttagtagctagaaaagatgtaacgggatgtaagaggtaatttttaagatggtactctctccgtcccaagatataacaatttttagtcttcagaatttgtgccaaaatataacaattttttcactaacattttcttcccaaccaatcataaccctccaccgttcacttttctcatctacctccactactcattcaatcacaaacctctaccactcacttctacctactttcttaagaaccgtgtccaacactaaaacttcttatattctgagacagagggagtatcatgttctttagtgtaaaatttgatactttaacatattgtacatcgagatactaaggtttttgcatattttcttgagtactgtgaagtttctctctatatatgatcccttaatttaccaaaccaaaataaattctgaattaactacatagtagcataatactctctccgtttcattttaagtgcaaccatgagtttccgcgctcaactttgatcgtccgtctaatttaaattttttttataattagtatgtttgttgttatgagatgataaaacatgaatacttcctccgtcctaaaatataacaacttttagccttaggatttgtcctaaaatataataatttctccaccaacattatcttccaatcaatcacaacccttaacattcactttttccaactagttccactaattatccaatcacaaccatccaccacttacttttacctattttcttaataaccgtgtccaaccctaaaactccttacggagagattaatactttactcgtgacttatgtttttaaattttttcaaaaatttttcaattaaaacaaacgatcaaagttgagcatgaaaatcatggctgcacttagaatgggacggagggagtataagggcagtcccaacccataacactagatatagtttccataaacaccacatcatcaagaaactagtactagacactactcttccaatgcaaacaccactattccatacttcaatttaatgctacttatctcacatgatatcttggatgttgggtagaaaccatgtctcatacaagacatggtttccttctctttcctcatttattcacttgccacatcattttttatcctatgtgacaacttatttaatgctatggacatcatcctagttattgggttgggaatgccctaacataacagtttagaatttagttaggttccttaattagtacatgatgatattcatttatgtgcatcctttatgggagacatgtatgtactgtcaacatgaactttttttataaatgaagttttgtttcgacgcctgcaacgatgcgcttgctactacctcgctcacgttgcaaattttctttgactttacggtggttacacacgcgatttattccagtttggctgtcaccatctgccaacgcggttgtatatatgcagtttaattttctatggtgtactgatatactagtactaaattactactaattaattaacaagtgtgaggggacttgttgggttctgcagggcatattgtatttttggctaggccgtatctgtaaatttgtactgattctaatcacctttagttttatattttgaagagaaatatactactccagctatatatagttttttagaaacactggtttgcaaagaagtttcaatggttttgctgaattgatgtccaagagatgtattcctaagatgggattatatataccataatatatggtcccttatacttataatatactattctatcgctataactcttcaatgacaaaaaagaacttaagagacctggtacaactaattaacatatttgggtttttctacaaggtcgcaattttgaattttcattggtgtgcatgttatcttcaacttacaatcttacacacaagtgaaaaacatcgtgattgcgacattttattacttatttaatttgaaattttctccaaactcattactggttttagagacaaagcctgtgggtcatgatacttctggtcggttccacagtctatttatacacactactaaaaaatcgattttccgacatggcgatatgtgtttttttcccaggcgggcatcgccctcagagacaaaacggccgcctacgatattagcaatcggggccatgctagccgtccatctgcgaagattgttttttgcaggtgaaccatataagatgccgcctgcgaaaactatcttcgcaggcggaccgtatttttgtgacggtattttggcctataggctagctcttgagtctggtagtgactctattgtccgtttttctcactctaatatactgtttatttaagttagcttaatgcatgctatgtctgaaatttgaactacgaaatcaaaaacgaaaaaaagatgcaactattttaccggcgcgtgcagctgcagcaccatcgtctccacgcgagtccctcacccgcagctccaccaccgcggcggagcccggacgatgtcgccgccggtggaagtcctccaccgccatggaaatgccggcgaggctcctcctcccctcgccgctcgtcatgtccaccacgacgcccaccctcaccggcgccggcgacgccgccgccgccgcattccggagagcgagcagcgagaggaaagcagcagcaacagcgagcagacggcgacgctgcctgatccccatgcaatgcgacggcagattaattctcgcacacctttgatcgagtgataaattagttgctgtgtgtacgtgaaaatgcagtgattatatatacacatagctatatatagctgttacagcagtggagaaatttcgtcgaaattttcggtttcgagctgaataggatgacgtttcaccagttcattttcttttacatggggaaagaatgtgtgatggcgttttacaattgttttttacgctggagacatatcactagattttgttagtagttcgtattttgatcaagtcaaattgaatttatatacgtacgatcttatcgatctgttagaaaaaaagatatgataatgtttgcatataacgtagcaactaggggacctgatattatatacgtgttgcgttgcatgtgtgacagctgggaactagaggaaattaaattaaggttcctagtcgaacatttttttaaataatccatttcttggtgtttaatggaacattaactcctataaaacatgacatacacaaaaccacatgatcaacaacttttgaccttaagatcatgttagtaaaaaataacagccattggatctagaagttacttaattaggggtgtccgtgttcggtgttcctatgttgtgctacctgaggactgatgaggtcactgagacccaaaaatttttaatcttttgttgttttaacctatattaagcacattattagcttaaaattagaatattatatatatactatcatatgtataatatttttttgtttgccactctaattacttattatctatttaattcaatcattaattagtcatccttttatcccccgcgcttctagcaacatagtgcatataagcatattaatgcataaatagcactaccttttccatcgtaatctttcttcatacggctatgattttttttgggttaattctcagagtactaagtgcgctaactataatttagtttatatatttttcacaatagatccaaatttattagcatgggaatgatgaatggtaaatgtctttcctttctaacaacctaactcaactggagcaagcacctaaaaatatgccactccatctctccattaattattaaatttttaaagtttttagaaagagttccaagatgtacttaaatcatcgcaaatatcgatcccacacgtaatatataaatatattttgaaactaatattttctattttaccaaaaagaagtttcgcagcaacgcacagattctcactggttatacttaatttgctcaaccacacccaagaacagtaccatgcatgttgcgtgagttcatgaaaggacggcaaattattttcaagaaagaagattttcaagaaagaagccagagggaactagctagcgtggaattcttacaaaatccctcatatataaatatgattatatttgtcctgatctgtggtcattgccttgcagcatcgctgtcattttcagaataacatacgacataatgtacaagaataaattactaaactataggatttaatgaccggacacaaacatttatttaccgacgaactgttagtattttctcccttgatgatagtatttcaaacccgccattctaaaaagtttccccgaaattgcaccatatgcaagaggaatgttttgaatattctcaccacgtacgatttttataatagatccaatgtattgggtttttttacaaccaataagaaaatggattattgctctagctaacaatctgatccaagactccaagcaatttagtactataaaaacgaaagaaagaagtttcttggaaatgtcaaataattggaagaactgttttatatactcttattctagttccgaaatatatccagtaatgtcaactatgaagctaaaataaaaacgttccacatctcattggtcaatctgatctgaccgtgacaggttccacatctcatgatctgtcattcaatctctctcccccagtttgattttatctgtctataatattgatcaagattcgaactgtcaaagaatagcaagaagtaatcagaattcagcagtctgtcttccctgaaacttttcttcataaccaagtcttggttttcataggtgactgactgaatgcatgacttcgcaggcactggacatgtgtgtgcaatttctcagaatctctagacttctggtctatagttccatggtcaggtctatagacttgttcttgcagttctgattctgactttctgaccagtttgtgatgcccccaggtacatatatatagtaagaaaaatctgggtattgatcaatcctacagttaaaatttcaaggtatcattcatctggtaggctggaagcaaatcagtagttttttttatctgcagagaaataataatacaagagtagatatattttttggggggggggaaacaagagtatatatattgcctttggaaagtagaagtgacaattacatttttgttaaagaatatcaattgcaagtgataaaacataagacgtgatcagttactaaactatgcatagaactatctaatcaacacggcctgcggtgaagcatggctagttgctgaatgggaacatcccagactaatttctgcagcagattattggttaatacctacaataaatgaagagatggagcattcttgtttttatatttccagagcacgctcagcatgaccatgtaattcatactgtctgggtggaatttgtaggcacagggccattctgaattggtcgaggcttttcgccatcagcacgttcgacacttccatggatatcctgggaact

SEQ ID NO: 8288 - DNA, 718 bp, Oryza sativa
aacccaatgagctcccgctcataggccgccagggcgtggtggcgtgcgcaaaggcgcggctaaaatagccaatagttcctccatcttaatgaagcactgcgccaaagcccgtgcctgatgcgtcgcactccacgatgaaaggctgatcgaagtccgccagggcgaggacgggccccgtggtgagcgcctttttgagacgtccaaacgctacctcggcttccggcgaccacaagaagccgtccttcttgagcaggcgtgtcaggggagccgccacggcgccgaaatcgttgatgaacttgcggtagtaccccgcaaggcctaggaagccccggagagctcgcgcggagcaggggcgaggccagtccaccactgcctgcaccttggaggcgtccatggcgacgccctggccggagacgacgtggcccaaataagcgaccgaggtgtccccgaaggagcacttcgaccgcttgacgaacagcttgtgggcgcggagcgtgttgaagacggcgcgcagatgttgtaggtgcgatgaccacgacgggctgtagatcaatatatcgtcgaaaaacacgagcacaaaccggcgaaggaagggctcaagtacctcgttcatcagggattggaatgtcgccggtgcgttggtcagcccaaagggcatcaccaagaactcgtagaggccgtcgtgggtgcggaatgccgtcttctcaacgtcggcgtc

SEQ ID NO: 8289 - DNA, 628 bp, Oryza sativa
ttctcttgcaccaccgcgactgccgatgctgcgattttttcgactctctcgagcgcctcccccgcttgggactttggcgcgaagaagttggggaagtacaagctcgatggcgcgggttttggctccccgtcgtcgccgctcacactcgaagagaggtcatgcgcctttgcttgctcggccattaggctgaacaagggaaacttggcccacacggaagagtatgagagctcagaaaacacacgctgagccccttacctggcgcgccagatgacggagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctggaaagcgtaataccctactcctgtgtttttggtggatctgtgtaagagcaagttacaaaaaatcaaccagccctctcttctctcgggaaaatccagccccctctctttgtgggcatggtcctccttttatatcttaaggggataccacatgtaccctttcctttccaaactggacttttcttctctttatggacggaga

SEQ ID NO: 8290 - DNA, 17488 bp, Oryza sativa
  unsure (1)..(17488): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatgtaaatatatcaccacaattcattacattctgagctcaacaaacacaaacattcagtagcctttctgtctttcttttcccagctagatattgtacttatgccttcttaatcttgtgagagaaattatcccttcttaagtaatcttcacactatatatcgtatctctccagtattatattaattatactagtaacacggacaaacagtgacagatccaaggctccatccaaccaaaccaaagcagcatctctccctgacgacggccggactcgctgtcagcgtagacagtgccatgtctcccggaccaaccgtgtcacgtcaacgccaagtcaacatagtataagaccccgggaataactgaattttactaattgaataatcttgcaaggtgaaattgattagtctgctagtctcacgataatggggaacatcccagctaaggcctgtttggctgtttgtgtttcgatgtggaataggccccaaacccgtccttccgtggaatgcagcccacgcctggatcaattcccacatccagcccaaatatgcatttagctgttcgtgtattgctgtgtattgcggctcgatccatgccgacccacgggtgagagaataatcctcacccgaggcctggaactctctcgcgtgcacgccgcagctcgcgacttctcctgcaccgccgccgctttctccaagccgtccaccgcctcctcgccgtcctgctgcgccaccggcgccgccgccttctccgagctgtccaccacgtcctcgccatcctcctgtgccgccggcgccactaccttctccgagccatccaccgcctcctcatcggccgtcgtcgtctgtcgcctcatcgccggcgtcgccccggcagcctactcgcttgatcaaggttcaaagtcctctcctccttctcctccttcatctcatctcattttctttgcccatcttctttcatccacttgttttgctgctaggaccttcaagatccggaaagtacagccatcctgctagggtttgacgatctgcaagagaaatattggagacaaggtatgtcaatgcttagagatatgcaaagtacagccatcctgaagggaacaaaacacggtagggaatcactagcttcgatcttgtgtcagtgcaaagagattttgagcagaaataaactacaactagtagttctcctctacacactgctgagactgtaccaccaccactgcatgatatacaaatgtatagcaagcagcacacattacagtattttacactaacaccattgaatgcacaaaagagcatactagcatagtagtatagcacttctattaaacaaagtgagtgttcagttcatacacatgcataattagctttaattatttatgaacatatatagtgttgaaactaaaaactagagtgctgaaacttttttttttcttttgctaactgcggtcatcttaaatattcagtattccttctagttagaaggtatgaattcgctaattaggaagagaagagatgaggaggatgaggagattattatgttctggttgcctgccctatatcttttaactagtaatggagggatagagaaaagagtaaggcatacttcaagtcagtacggtgaagaacaactcagaaatattttagagggacatgaaaagatttgccttgttgcattccgcatggagcctaacatatttagagcaatagcgacatatcttcgaacagaacatctcctacatgacacgagaggtattacggtagaggagaaacttggattttttttttctttacatgatatctcacaatgcgagctatgaagatctacaacatgaattccatcatagtggagaaacgattcaccgacatattatggcggttttcaatgtaatcccactttgacctatagatttatcaagcaacctactggagttgaaactcactggaagattagcatagatcaacagttctttccttacttccaaaattgcttgggggctgtcgacggaacacatgttcctatcaccatttctcaagaccttcaggccccatataggaatagaaagggtaccctaagtcaaaatgtgatgttggtttgtgattttgatctaaatttttcgtttatatcatctggatggaagggatctgtaactgatgctagggttcttaggtcagccatgcttaaaggattcaatgtgcctcaaggcaaatattatctcgttgatggtggatatactaacacgccatccttccttgcatcgtaccgtggagttcgataccatctgaaggaatttgggcgtggacagcaacgaccaagaaattataaggagttgttcaatcataggcatgccatattgcggagtcacatagagagagcaattggtgttcttaagaaacggttccctattttaaaagttggaacgcatcattctattgaaaaccaagtgaagattccagttgccacagtggtgttctacaatcttatacggatgcttaatggggatgagggttggttcaatcaccaaggaagcaacatatctccagaacagtttattgatgtccctgaaggtgacgacgaatatagtaatgatgtgatgtcccttaacagtcaagtagatgatggaaacacggttagagatatgatagccctaaatatgtggaatgactacagtcataacttgtcttaataaatgtgagtcttaactggtctcatgaaatattttgcttttgtatttgcatcatgatgtttttgcatgcttaaatttgataacggtttttttttattcgcagcaacaatatttggaagagggtccccaaagttcaatttaatccaagctgcagctgtccaaagaaagccatctccaaagatttcaagacatcaaaagaaaaaggcatcgccaaaaggtatgggctttttcttgtcatgttaaatgcacatatgggcttctcaagttcagtaggttgatagattaaaaacatgtaattatctgtagcttatgtgtggttctctattccaactgtacttgatcgttcaagagctagttggaatgcaggacttgaaaaagctttggttgacctactacatgatcacaacaacgactgctataggagtcagaatgggtggtccacagaagcatggaactgaatagtcaaatccttccatgagaagttcccctatgtcaattttacaaaggttcaaattcaagacaaagagagagagttgaagagggaatatagagttctaaaagaagcgagaaaacaaagtggtgtgtcctaggatgataagctgtgcaggattgaaggagatgaagctgtttggaataacatcattattgtgagatttcttgtctctcgttgctgttaattcttgttaaattcttaaatatagttcttgctttaatttcatttgctaattacttttctttctggtattcaataaacagtctcatcctaaggccaaaaaattccggaataaatctttcccattgtttgaggctttaggagagctatatgatggtatgtcaccattgttgaatctttattttcctaccagctaagcatgttctattcagttctcctaaacattacttgacttcactttctgttgtgggacactgccgagagaaccatgaacttcacctccattgccccttcccaagttcctatcacacagccttttcaagttcctgtcacacaaccttctcatattcctctcacacagccttctcaaacttctcaagctactgtcacacaacattatatgggagaagatgagaatttcccttttgactctcatgtacacaatgctgaaagtgatgatgacgacctgagaatagtggaacagccaattgcaagtgatgccgctacaaggtcaagaatgggaaaaagagttgcaagtgcaacaaacaagcatgctggtacaagtgacaaaacagaaaaggcaacacaaaggcgtcgccaggatgggaaagttgttgagatgatgggaaaatttctggaatttaaagagaagcaagccgagactgaaattatgcagcaggaaagggcaagaagtaatgtgcatgaggatgagttcccgatcccagtatgcattgctgttgtggacagcatggaagatatgtcggatgatgagaaggtcctggcttatgatgtcttcaaagatccacaaaacatggccattttcatgattgcaaaagactctacacgactcaagtggttaaggaggaagattacaactgcgtaaatctggtactgctccttttgtcttgttattgcctctatgaaactgatgaatatattaattagtactacactttaatcatattaaacagttggattttgtttgttgtatcacctaaaacttcaattcagtgatgctcagcaaaactattttttgggggtaaatgttgagcagattggcagatgatacatttgtagttttcacattgtagcatcacctgagatgcaggtgtattatttatgctaaaaatgatgctcattatgccttacatattattcatgctcttttgttttttggggagtgtaaacttttatatacatatattctaatatattattgttgctctctccgggtgagcagtactgggctctgaaagcatgatttgaatttgctgaatgaatgataacactgatacttggagtgagcttatttattcaaatttgaagatgcacagagtgaatttgtttaaatgtactacatccgttccaaaatataagcatttctacttatttatcaagatatagcttgtaaaatgcacaattaatttcatcttgctccaacttttcttagtcccttaggctccgttcgtttgtgtgatatagggtgagaaagcacctcgttttccgcgcgcacgcttcccaaactactaaacggtgcgttttttgcaaaaaaatttctataggaaagttgctttaaaaagtcatattaattcatttttgaaatttaaaatagttaatactcaattaatcatgcgctaatggctcacctcgttttgcgtatcttcccaatctccttctcctcaaacacacccttagtgctcttgtcctaggaatttgcaagcttccttattagctcttttctctagtttctctctgttgctagcagtcagtttgccacggcagatatggagccaattaatcttttgccttgtactttgtttcaggtgatgcatggaaaaaagatgcaatggaaagtagggagatatgctgctgttggagttgtctatcttttgcttggatgtttcatgtcaaagaaattattcatagatggaacacctagtagactttaaattaaacctctgtggtagacttagctatcaaagttatttattactgtcatatatgcttggatgtgtatgtctggtgtgtgctgtttctacctggaagatttgtgttgaatcaattattctagttcacctataaatatttcatggatcagtaacaagttcatccatgcgcatgcatgttaatttctctattttctttgtgaaattctactcttgtgttttttttaaatttttaaagcaggatttttagaattacagatggatatacatgttggattttctattctggtattttatttcttaggtttttctgtattttttatattatttttttacttaacaaacgagacctaaaaggtaaacctagctctgcccaactcttcatgcatacccttagcttagctagcactacgtacttgctgtggagtcaaacctgggcattaccggtcgaaccaccagcccccccttatatcgaatcatgctgtgtattgggtgggtggtgtggattcactcaatacacgggtggaactattcacacatgtataatatacacaggcagccaaacgaggcctaaatctttatttttttcttagttaatcttattcagcgatgctgctcgatatgaatgcatgctctcacttaacttcagagttagctagttagctgtaatggactagctagtgggtgtatatattactagtacatattgtcatactgacaagcagcttgctagtaggaaattaaaccgaatagaagctgtctcacaaacagccgcgatgaaaaagacaaatccttaccttggagattacccggaaacgttaattactcgatcagcctttgtttcaagagcttctggtagctagctagcttgttgcagaacctccaactctctcgtataaatagttcagagtctcacttaaattatagaatccagaaaatgcaataagttggaagaccctacttcttcagttcataaccagttggctacttgctacttatcagaatcttaatattctcaaacaagaccttgacacacttgtacaacgattaggtacagatgctacaatgttatttccatgtatgagcggcggtgtatgcgggttatttctctgtaagatcggtatagattcactcaatatgtgttgcattgttcggtcataatgaatgcatatagagagacaaagcactcatatgaaacaaaacaataaatatatataacataaacatattgttattcgatcctagcaggcttgatacggtatactattcaacatagagccattagacacggttaagtcaatagtcatcgatctctacatcgtgtctatcgggcaacaatcacatacattatattaaactataaaaagtacccgtcggttgcaacgggtaaatgctattttaattttattgttgttatatatacggtttagctaggataaaattcactatgggaacccacttggatattctttttagaaaatcataaagtctgtatttaatcttaagttagcatgcaagtttttttaaaaaaagaaaattcttatacgactcattttgtattttccaaaagcaaatgagcttaaaatctaacttaaacacggatctatatttctaaaagcgaacgaacttaaaaaccaactcaaacacgtatgacatgccaaaataccggtaaaaatatcttcaatttttataatagtagaggtagagaagagatatgcatatattcttttttgaacccatattatatatgcatatagcagtatataagtactaccatcatgtaggagtatttgccaggcgtacagctagcagctagcgagtggcaccaaccagtgtagtagtgtacacagccactgccactgagatggagcctagaggcttatttggctccaggagggaagcagcctcctctgctgctacctgcagccgtcgtcgtagtctcaatgtcgtcttcttcttcttcttcccgctgctcattgtcgcggcggcggccggcaacacaacggcggcggcgccccgggcggcggcgagggtgccggtggacgtcggggtgatactggacctggcgacggcgctggggaagaagagcatgctgagcatggagatggcgctggaggacgtgtacgcggcgcacccggagttcgccacccgcgtcgcgctgcgcgccagggactcccgcggcgacgtcgtcgccgccgcgtctgcaggtatatacacttgcttcgacacttcgacgacattggtagctaagctagctctagtactgaagtgactaagcaatcgcctaatcatgaagtgctttacttaatgacgtgattacatttggcgttgtttacggtcccatcatttggcttatttaaagaataagacaaacgatatatttgcaaataaaatataatttgtgaataaaacttttatatatgtgctcgtagcgatctaaaaatcaagggtaaaaaataaactttcatgaaaaaactctaaaatcgactccgaataaaaggttaaaaatttaaaatttgactgataagtatatataagcataagtgataagtgaaaaaagataaggctggtaatatgtgatgacagttgtcgctgctcttctttttcttctaaaaaaagtttttctgttcttttttattgggagaaaattgaaaagtgtgcggactgcggactaagagggtgtttagaagagagggactaaacttaagtccctttctccaaaaaataagtccctagtccctttctcccaaacaccccctaaaaactagacatcagactgagcatcggccagaacactagcttaactaattatgaggacagagaatacatattctaaagttctaatgtatgatttattatgaacgaaattgagattatgataattattcgattttaaacacaaaataattaataaatattaaaatttttaaaagttgaatttcaagtactaatcttttagaaaatcatacagtttagaaaaatatttctatgataatccataatacataagaggaaattaaaaaatgcacctaaaacgtacgtaagcacaaatacagatggatcgaactcaacgtgcaataattaattaaacactctactgcaccccagtacaatatataaaggaagaatctatcacctaatccatgcattggactgttaatagttcttttaagctgctcacttacctctctcgatcaagtggtaatactttgatcagttaattctagccagccttgatccattgtctacgatattgttgccaaattgcattcacgtgaacttggttagctaaaaaaaaagctaacaaaataaatgattctcctagttttgcatgaggattaattggttgcatgcaagcaacgacaataaaaaatagaaactacaaagtgtggtttaaataattttattggcctgtttatatattattaaaaaaactttgctaaatatataactatgctatagtttataattataatgtaattatattacaacttgcacgaaattataatacaatttacattgtatatgttgcatgcaatttacattgtacttagaaaaaggtgttgtgcgtagcttagtgtcgcggtgggctttgcatgtctgtacgtatctcaaagcacatccccgcacccaaaaagtcgacagttttttcccctaaaatttctgtcaaatgttaaatatatatagcaaatctccatttacattgtacttaaaaaaaaaggtgcggtagcctagtgttgttgtggtctttgcctgtctgtacgcatctcaaagagcatccacatggtcaaaaaatttgacatattttttttttcgaaatttctgttgaatgttaaatagcatatccaatgggcatattagattgtggatatgataaccgtgcaagaacagttttaaggttctgcagactgaccatgcatgaataggccaacttatgtcagtagggatttatttaagttttccaggtccttttttttcaggaaaaatgataattatagtgtaatcagccagctggtgcctggctaagtgcacatgatacccaagaatccatggattttattttcgttgggagctgtggttactgcttgcacacacatgtgcatgtgtaaattattatccctgctaccttgcatgcaagcaaatcctatccatagttggcacatactgcactgcgctgtaagaaaaagaaaaatgaattaaagtagtacatgttttttcaaccatgcagaaattaagagcacatgaaacggagaaaggagccctttgattacatatattatagaaaaaaattcgaataagaaagcaggaagactatctctttcactaataaagaaaagaagtgcatttatgtactgatattagtggagaaggtaagaaggctactcttgcggcatcgctaaattaaaaaaaaaaagagagaaaagtttcacaatagatccaacatcttctttattttcatatataattaaccatatgagcacaatcctatagaaatcttcatatccttcaaaggttctatagaaaaataatttctccaatatttctttgccaatccctcatttcaaggaggcacattgaactgtcactgcattttgattagccactttgcgaagttggcagaggcgaatatgtgtttgaaattggtgaagatgaattatagttaggtctagtaaaacgagaaaaccattaacgtatgattaaataatttttaattattacaaacttaaaagatgtgtttatatgatattttaaaacaacttctatataaaaagtttttgcacgaaaaacacatttagcagtttaaaaagcatgctaacgaaaatcgagaaaaaaatctatatcttaattagagaataacaccaccctagctccactatttgcatagatagatactctccgctttgtatcttcaaaaatctgtgtctagccaagattctctctacctccctctctgctatatgtgcattgatagatactctaatccttgtaacgataaactactactgtagtagcttgtgttgtgatctgtgaacactgaacacgagcggccaacacatgcataggagtggttgcgacaaacataatccaaatgagattgcattgggattagcggtgtaatcatgcatgtgacatctaatctatctggctttgaaagaaaaaaatatttaaatacttgaagagtaaaatttagtgatatcaaaccgaattttcaattataatttataagtaccattgccaccagaacaataacaaaatagtagctgtgtaccataatttaattttttttttagaaaaaaattgagccaaaccataagaagataacagcaatcaattgcaaatcagttaaaaaggcatatcaaatcgccgagaaggaattgccctaaaaaaaagcaaaaaattaaaaagcaaacgcgataacgcgaactcgcgaaggaagacgagagagagagagagagagagagagagagagagaggagagaggcagtcgccgccgtccgccccttcagctcgccgctgattttggtcgctggggaaggagaggagtgatctgatgggattcactcgcgggggccgtgtagaagtcgacttgattcggaggggatcgggagatcggagtcatggtcggaggcagcgattggcgaaggagggaggatccaggcaccgattttgagcggaatcgtctgttcgctgcgctggtatgagctcccgcgaaacctgattgagccaaccaaatccaaacagttttcagttggatctgttactgaaccgtaccctgtcttagatttaatccatcgatccaggtagattgctttgcttcagtgattatgtcatgaactagttgcaactaattgtaaatcgaaagcgatcaattagttccttgaacttgggaagtaaatctgggcctgttggtgaggttagatcgttcttgctgttcatcaggcagtaaatctggctaagatgtagcatagcttgttttctagtagaatggaaccgttggaataaaatgctagtatatgggtagaatgagaaagatttgcacatgttggttaaggtgttacatgttcttcaaattttgctattgatttatttcttctatgtgctatcttggagtgttcgatgtaaggaaagggttatacagcatatattttgcacagttggcatatgtattgaacattgaactgatcattcttttatatatcctgcagcaatagatctcatcaggaatgaaaatgttgccattgttattggtcctcagagcactttacaagcagaatttgtgacctacctagcgaacaagaccaaggttcctgtcatcactttctctgcaaccggtgatgcagtcactcggtaccatgtcccgtacttcattcgtgcttgttccaaggactcctatcaggtggcctccattgctgcattcgtcaaagcctatgaatggagaaatgttgttcttgtctatgaagacaacaattatggtgttggcatcctcccttccattaccgatgctcttcaaggtgtcggggttaatgtcattaaccgttctgccttccctgcttattcccccaataaccatatagatgtggaactatacaagctcatgaccatgcagacgcgtgtcttcattgtccacatgttgccagcccgtgcttcccgcctctttgcaagggcaaaagcactcggtatgatgactaaagggtatgtctggattgtcacagatagcattggtattgtccttgatgtgcttccccaacattccattgaaagcatggagggaattgttggtttccggccatatattgcagaatctacaaggatcactgatttcagctctcgatttaccaccttattcagaactaagtaccatccaaatactgatattaggatggcaaaacccactatctttcaattatgggcttatgatgtggcatgggcagtcgcaacagcaactgagaaggttcataggaccagatctttgaacccaacttttcatcctccgggaaacataggcaagaacttagtagatgatctcccagcattgcctgctggtccagaactcctcaattccattttgcaaggagagtttgatggattggctggacaattcaggcttatcgatagacatctgcaggttcccacatatgagattgtcaatgttattggagagaaaactagagttatcgggttttatagtcctgattctggactcacaatgtctgtgaactctagaattatccatggtgatgctaaatttagcacaagttcttctgatctggaaaatatcgtttggcctggagattcaacaacagtgcccaaaggctgggacttcccagtgaatgctaagatactccagattggtgtgccagtgagacgtgattttaaaacttttgtgaatgttgagactaatccgaacacgaatagatcaactgtcagtggctacagcattgatatgtttgaggcagctgtcaagaaattaccgtatgctctacgctacgagtacattccctatgattgtgctgtttcatatgacctgctagtatcccaggtcttttacaaggtgagctctgcttattttgtattcttaactaattttcccttgtgaataaactcattattactaatttacttgttgcctttccgtttccctgggtgcaacagaagtttgatgcagcagtcggtgatgtgacaattattgctaaccgaactagatatgtagatttcacaatgccatacacagagtctggtgtttcgatgcttgttctatctaagagtgacgatgaaccaaccacatggatcttcctacagccactagcaaaggacctatggattgccactatgatctttatcttcttcacaggcctagttgtatgggtgattgaaagacctataaatcgcgatttccaagggtcaaaatggaaacagtgcatcactgctttctactttgcattctccactttgactttttcacatggtatgtcattacagacctagctattgaatagataaaatacataactacatacatcttcgtacattcaacttattaatttctaaggatgcttttttttattgttttttgtcgggtcagctgaaagactcttaaggatgctatcatatgctactgtgattcagtatttgctgtaatttgttttgatactactatgatttttgataatctattttttttaatcctatggacaggtcaaaagatccaaagcattcagtcaaaaattgttgtggtaatttggtgcttagttttgatgattctggtgcagagctatacagcaagtttgtcatcaatgctaacggcagagaggctccaaccttcagtgactgatctaaaacaacttttggccaatggtgattctgttggacaccaaagtggatcatttgtgcaatcaattctgaagaagcttaaatttgatgaccacaagataaaggtttatagcacgcaggaggaatatgcaaaagcattaaggatgggatcaaagcatggaggggtttcggctatcttcgatgagataccctatctaaattctttctgctcgaaatacgggagggagttccagatggttggccccattgacagaacaagtggatttggttttgtaagcttcttgcacttgttatttattagtataatgcatcttcgagcattctgccttggctttacaatatatgtttacttttcgacaggttttacctaaaggctctccattggtaccagacctttcagaggccatcttgagcttaacggaagaacctgaaaggttgaagattgaaaagacatggttcatggattcgtccttggattattatggcagtcacagcaaaggctcatcacgtatcagttttcagagcttccaaggtcttttcatcattgtcgggtgccttttaggtgctgtgctgttgataaactttagcaagtttctatatgacaaatgcaaagagatgagaggcttcggttcagaccgtgtccatagtggcgagagagttgtttgttacggtgaagctcaaccacaaccaccgcagattgtcatggtcgatcgacgatcctgtgcctgctgataccctccagattaggactgaaaacaaataaagagtgtgaacagttatctgcaccaactatcccaactcccaaggcactagaatggctctgaagctagaaaaaagttcacttgttttggcctgcttgttgcatggccttgcttaactgtgtaagcctcttctgttggttttaattagtcaattgaaagctattctaaaactctagatttgcaataattgtaatgataattgtaatgtagcacaaacatgctgaacgatgttcagttgatgtttttcttttcttgggacaaaactcaattgtaagctattctaaaagaactctagattgacaatgattgtaatatagcacaaacacgacgaacgaagtttttcttgggcaagagtcaactgtaagctattctaaaactcacagctaatgtcagtgctactttgtaacgagaaactttgtatttaggctgtgtttagttcagcgcaaagtttggattttggttgaaattggagatgatgtgactgaaaagttgtatatgtatgacaggctgatgtaatggaaaaggactgaagtttgaatccaaactttggatctaaacacagccttaccttgacacaatgccactgaatcttgcaaactaaacttgtgcattcttttccgcgccattacatttctcctggttttctttggtctctgtggaactaaaaatttgtagcagctcggtcagtgactcatgtcaatgtaaaccgggagaactatacagatctctgtcatgtcagtagacctgaacattgaactagtagcaagtttctggaagnagaagaaatttaaaagggacacacgcggtttgatgctatacaagcctagtggaagtggaactcaattgactcaaaccatgcaggtcgtgcagtgcaactgtgcaagcttaattaattagatcccaatgatttggtcatatgatgcccgaataagccctaattaagcgcttgcagagaagagaagattgaatgatctacgacttgtatcgtgctcctatgactatatgagctatgaaccattctgtaccaacttgtgtgtcattatacccttggagtcaagtcaaatgattgactgttgctgatacagttctgaattctgatatctccatggaccatggaaaaaaaaaacttatatatgcatcctgaatttcttgactggctgctcacagccacacaaatcacacgttaatcaacaaaatggaaaaaaaaaagagaaagaggagagaaatagtccagcaagaccgggcgaacgtgttgattgatcccaaaattcccaatgcctatttaacacatactacctacgtacatgtagttcgatatacgtacgttgtggtcgtcgcgagctgtagtcatttctctaaacgaaattagagaaatgaccccacttaaaaacaaaccgatcccacatgtttaaatttctggctccaccactggctgtagtgtagggtatgtaagttgaccagcaatggaggcgcggcggctggctatggcggcggcggcggcggtggtgcccgtcctgctcgttgtttggagttcggcggtggcggcggcggcggcggcgacgacgggaggagatgtttccgtggcgttggaggcctaccgcttggacccgaatggcagtggttcgcgcacgggtgctatcacggctgctcacggcgatggtaaccgctcgttggtctgaattctgatatcctccctccgtaccaaaataaaccacgataagtgttttagaacgtaaaaagtagtacatttagagacctgtaatagtgagtcactgaaattgctgttctaagtacatgttaatgtttttgtgcatgctaaaacaaaatattcagttctaaatgatggcacttatgcaaatgggaatagaaccaactactaactccgttctaaattatggtaacctagttctaaattggagtacttcgaatgtggatatagctatgttcgtgttcccattcaagttttagtatgtgtctaaccacgactaacttactataaagtagagtagtatactattttttttcttatggatttctgcccaaaataaagaaacacaaaagtgctcggctatcattagggcagtcccaaccctcctcctaggatggtgtctatgacattaactacattgccatatagcacttttagcttgtgtggcactatattaattaagagagagagagtgaagagaggaagaaattgggtctcatgcaagacacaacttcaacacgagaacctatgcactagacactatcaagttttgcattgggagataatagtgtcttcataatagatgaagaataaatatgactgatagaaaagagagatgatacatttattaatggtccactttaagaaatcatgggttgtagagtgtagtttctattatgatgtcttattgacatgacaccatagacactgcttatgggtactatgggttgggactgcccttataggctcgtggttaccaccaattcatcaaacacttcatcttgtaggcctccttttgaacgggagaatttcgaaagaatattagagaaatcgagctaaactgtctgaaattccgacgaatttcctacattcctaaggagcggtgaaactcatccgaggtagatttcagcagtcttaacgataggattagttcttgcaacaggcaaaacggagatttataaacgtgccacgtatacatttgctgttttgccatgtgtatgacatgtggccgcggggcccggttgtacttaaacaacacaatatttcgagaaaaaatagggcacctagaaaagagaggaaaataaatgcccctagtattaacaaaataaatcttatctattatgatcaagttatacaaaaccaaaattttattgacacataacacataaatccatatattatatttataaagtttcacaaaaactgtaactaattatatatgttcttatatcaaaatgtaaaaaaaaaacttcaaaatttaaaa

SEQ ID NO: 8291 - DNA, 11355 bp, Oryza sativa
gataaaaatactcataaagttaaggtgtgactcggataactaaaaaatcatggttgatcaaagattaaaattatcaatagtgtgatttttgtaaaactttatatcatatcatacggagtaatacgtaaaagaaaacgagaaaaaaaaagataggtgatccgtagccgcaaccccttcgtcggcgtccactccctccggtgatgccgccggcgcactccaatggaggagaggcgcgcggcggcgttagcggttgcgacaaccgctattctacaccaatcgcctccatccccaccacccccaatcacaccacgctggcgcggcgccggctgctggctgctggctgccgtctgacaagtagggattgccgccgccgacggaagggggggggggggggttcagagctcccgtcttccagcacgcgtgcgcgcatgcagggcggctccgccgtaccaagcctcgcagtcgcagggccatggccccatccgtccaacttggaggaggttcgctgttcatcctggttttgtttctagtgcaggatcagtttgtgaattgttattgctatgtagaagtatcctagtgacttctaagtaatttaggataaaattagtagtgaatagtaggaggactaacttagggatttaatcttgaatcattcgatatatgagagctgaatgttcagtgagccaaatataggtagtgccacccgtgatacacaagaaattgaatggtaagaaaaaaacagtgcacttgcatacctctgataggatgtaaaaatctgaattacccttgatgataaagaggaggaccttgcattggttctgttagaagcaaatcctggggggcttaacttggtggaatatatggcttgaaccaaatagaagaacatttagtagcgtgctctggtttttccgccctccttgaggcactgtttttttgtttctttctctcctgccgcaaagatcgctctcctgtaatgttgccttcctgccagacttttgcttctccctcttaatatatccggcagagctcctgctgtagtggtttcaaaaaagaaaaatataacctgttgcgttagtcactattatcaataaaaatatagccgagggaaatgttttcatttgccatatgcacttctcctatggactgtacctaacagtattgcttaggaaatttgtgaccttccttctatcatgcaaatagacacaaataattcttgctattgttgtgctatgttcaattttgctcataggacacgagacttggacatgaaccaatccttttttcatccagaaaccaagagaactaatgctggggtgaggagagacctaggagcactacctagaggatatgggaaggaactcaagattgcagtgccatggaaaccaggttttaaagcttttctgaatgtaactgacagaagtgtcggtggctattgcattgatgtatttgaggctgccgtgaagaagttaccacaccatctgagttataagtttgttgtcttcaacggttcttatgacgagctagtacagcgtgtgtcttcaggggtgagccttacttactgtgcttgcaaatcataatcaaagaatcaagtacttacattatgtctgctggttcttactaccagaactatgatgcagcagtgggggatgtaacaataactgccgagcgaaccatccatgcagacttcacgatgccatacacagagtctggtgtgtcaatgcttgtactcatggagaatgactctaaatcaacaatcgaatgggtattcttgaagccactaacaagggagctttgggttgccactgtgatcttcttcttattcaccggcatagttatttggatgattgaacgtcccagaaatctggagtaccaaggatcaagctcaagacagttcagcactgctctctatttctctttctccactttgacattttctcatggttagtacttagagctccaaattgcaggctatatttgattcactataagtggcttaatttagtttcttgcagtagttcttaaataacctattgtctttgttacaggtcacattattaaaagtcctttgtcaaaaattgttgtggtaatctggtgcttcgtggtgctggttcttgtgcagagctacacagctagcttgtcatccatactaactgcgaagaagctccggccctcggagacagatcttgaacagatcctgtttgatggtgattatgttggataccaacggggatcctttgtggaatcctttttgataaaacaaggtttcagtaaaagaaggctaagaccctacacaaagaaacaagaatatgctgaagctttgaggaaggggtccatgaatggaggtgtgtctgctattgtcgatgagatcccatatttaacctcttttctttcggaccgtcgttacgagaaagaattccagatgcttagccgcatatataagacgcctggatttggttttgtaagcctctcactctcactctattgcttccatttttttagataatgaaaatggattacatcttcggcttccatggattatttgcattgagaatgagtttatttgcttctgtcataagacacagccataagtttgataaaaaaaaagtgaagataaaaataaatgagaatgagacataaagtgatggggcaaatccccaactcccatttattatttactagcgttattgactctattgcttccatggattcgctcttcagccttcaagagatatactacattctggacaaaatatgctggactaattggcattgtgcttttttgctttcaggcgtttcctcctggttttccattggtgcataatctttcaactgccatattggatgttacgggtggggatgaaggttcacggatcgaagcaaaatggtttggcacaacggctgcccctccaagctatgcaattcctaacacagattcgacacctcttacattgcagagtttctctggtcttttcatcatcactggatgtatctcagctctcatgctgatgataagcatttctaagtcagttcttgccaattacaccagaattagagattctgaagtgcgaagtcccgatgcggatggtggaaatggaggtcgcgaagaacgtaactcagcacaaaacgtcatgggtgatggctatgtggatgatcgacctcaccatgaaatcagaattgacagttcccaggatatccatgggagtgtcgaacgtgctgacggcgaagagcctggaccaattcagaatggctctgtgcctgcaaattccagccagaccggatgaatactgacaaaaagatgttgacactgtcacacggagcgtgctctggaacttcgaaaataagaatgactcgtctcttcattttttgtaggtgtttgccaatatgctgtagaaattaatgcaggaaggccgtggattagatcgttctgtacatattttagtaattgatcatgtcaatatttaattatttatcatttgaaattattgttctctaccaaccgtttagactgtaataatcatttctattttgcgaaggcaatgtatatactcttgtattactagtgcgtgtgtgaaaaaaaaacacaccttagatttttttttttttgaaacgaacctttatttggtcaattgtaagctgcgctaaaactctagattgacactaactatatcacattcatgctgaatgatgttcacttgatgttttgcttgggcgcttttatccgtgcatctactgactaacgagaaacaacagatcgcagataaaatggcgctgctactttgcttattatatacaacttgggcaacttgacatatttaaattcttgcttattatatacaggcgaaaattcttagtcccatgtttaatctgcctatgaaaaaagttttcactttggcatgccactatatttgtaaactattcctctgtaaaaaaaaaaaacttcgggctatatatctaaacatagctttatgtccagatatattttcaaaaactggttttttctgaaatagagaatgtaagttttgtgtcttgtttgtcgggctatttctcctaggcttggcaacactcgttttcacacatgcaactcgcatatacactcaattttaatctacttatataaccatgaataaagatataggtacaactataattatgattagaatagacgaattataaaacctgctagtccgtcctacttgcatcttaacatagtccaaatacactgaacattaaacgacaagacatgtaacagtagaaagtagtagaacattcatgttcttgaactagaagggaatgaattcgtcagccgagacgcaatacatcacaaatttgcaccgtattacaggggacgcgcctgtttggtgctaaaaactccatttcagtcaaatcatgcagccccaatgatttggtcatcactaaaaataaaaaaccttagcctgtaagaaataaaatttgactgctgatctacttgtattcgtatacacgaacagttctatatatacctgtgttgttatgataggtttcattctttttagcttactagaaaaaatgcccgtgcgttgcaacgggtgaaggctattttaatctattattgttatgcggcttagttaaggtaaaattcgctgtgagaattcgcttggatatatatatttttagaaaatcataagttacaattaggagttcaatcgtgtcaagttagcatgcgagtttttttaagagatttcttatacaactctttttgtattttcaaaaacaaacgaacttaaaaactgactcaaatacagatatttattttcaaaagcgaacgaacttaaaaaccaactcacacacatatgacgtaaaaaaaatactggcaaaaacatcttcaacttttataatagtagagattttatggcggttatgtttgtctagctcctaaaccatacgattttttctgaaaactttttccataaacttttatcataaaacttcttaaaactaatgattcgactttctaacatttaattcatttattcgtgcttttgaataattatcgtaaacttagcttcatatcgatcgtacttatgtcaactatatataatgaatgggacgcctttcaaatttcaagtcaaagtcaaatgattgattatttctacattctgtaacgcatgtttatactacagccttgagtacttctgaatagtataactgaataactgaggctttcttttgacagtctatacctctggaaacacgcactctgaattttctgagtactggctggctacgttaccaaatacatatatagtacaaaaaaaactgtcaactagacagtgtataaaccgtgtattggtcgcgtaggagtatcctagctagtagtttctacttaattacttagtgtctgtatacatatactactacttatctctactattataaaaattgaaaatatttccactaaaattttagtatgtcgtgcatgtttgagtcggattttgagttggttgtatgtcgcccatatccaattcgacgttgtttacatctaaatttgacacctatggacgaagtagggaaaaattgtcaaaatttggaaggcgctggttttccttcatggggcctgtcaatgaaatgggaactacggtacccatttccccgggaacctagcattccatattgattaatacaaaaggtgtacttatatcagtattaatctaagacgcgtaataagtataagggggcttgggacctactatagggtgagtcccaggatccccatctcacgacataaactgatttcatagattgaggggtgcgggacgcgaatccctgccttagctcaggacctgggccctcccatgaccttgtaggttatgtatcacttattgagaagagcgcaaaaacctacaagatcaacatttttagaataaggccgtggaaagcctgggtcccggcttattttgggatccgtgctcacatttgcccttatatgtcatgattcctttctgagaggagtgtggataaatacaagatctacatcttaagactataaatcaaggggagcccgaatcccagttcggtttgggatctggggccccttatgcccttgtatgtcacgcattcctccctaaaaggagtgtggagacatataaagatctacgtcttaagatggtaagccgaggggagcccaggtcatctcgcgcctcggagaatgggctatccctctcttcaagcttctcaacataactaggggatttacctggacggaggaggcagaagagactttttgccaactcaaaaagtatctctcttcgcccccaatccttgttgccccatacctgcaaggggtaagagcatatgctgtagacccaaatatcgatcccaggctgatcatttatcatctagagtttatgccccttcatctcatatccaagctatatgaggaggtattcaggatattgagacgggagctgtcagcccttggtgaagatgctactgcatatgccgcaattcatctcattgacaaaaatcttggcacaaatgtgtagaaactatgtcaaaattacaaagtactatcgacttggttgggagtgcatgctcccaaaggttctttttaacgaccctggaagattgtaaccaggaaaaaaaacaaacacaccgccaccacaagttgacagctctttacacagcactctggagaagacactagcaccaagccgaccgccactaagcgtggccgattgccactaggccaacaagggggttacaaacgcctcgccaaacaccagcttaactccgaaagacaatgaaaagatcccggttatcctcacgtagaggggttgaggagagggagagggcgagagagaaggagatccgctcatctctcaccctaacctgatgatgacaacaagacctgccagcgtccaaacagtgagaagatggcgaaggaaaggaatagagacgtcctagacaacgccttcaagaaggccatggcaacaaagacatcaccgttgcccgtccaactagactcggttttcacctggagagtcctatcgaggaaggggagagaggctgctcgacaacgccccaaggagggaacacaacatccaaggatgttgccgttatcggctcaggcagtcccgagctagcctttcacctgcaaacgtccacacccacccgtaccgtcgctgccctggagctccgccgcctgaacaacctctatcaactcgaaagtctgccgcactagtgccccatcactagccagcctagatccacctcccgcaactcaccgttggcgcagctagtacccgttgcatctcctgccgtgagcgcaacccgatggggtcgccttctgcttctagccgagctggctttgccacctgccaggacgcgccagcctccacctcgaagtcactggacgcgttggcctccacctagacgctgccgaatgcgcttccctccacctcgatgccttcgaacgcgctggcctccaccgccgccggatgtgccggtctctcgcggggcgcgacgggctcccagccgtcgcccacgctgtcctcctactctgttggccgcatcaaacacaattcacgcgcctgccaccgcagcacgcatctcctcctcctccggcgcccccagccgaccggtcgcatctgtgccgccatacgcctctcgtgcgagcatgcgtctcccgggccgtgcacgccgccgactttgccgccgtctccaccgtgctgtcaatctcatcccattctagccgcgggaggttggactcacctccccagatccaccacggcctcctcctcgagccagaagtggcactgccggtgccgcccttgcccgatttggccgcgaaggggccggatctactacgaccggcctcgtcggtgccggaaatagtgccgacggccggcgtccctccactcaaatctcggcgttgcccccgcccaccgaggcttgagcgaagggagaggccccgccgccccatccttgccgtcgcccagctttgtcggtggccgctcgggcggcggcgaggcggaggaggagagaagggagggggtggcagcgggtagtggcgtcgctgcccgtgtcgccttggagcagggcgacgtgggggcctaggtaaatcttactccctctgtccccactctcaaaggtactggtgttaacgaccaaatttggtaatatcagcatcggagatgaagatgaaatcgaagcggaatcgaggataagggttttttcggaaacagagtaagaatcggctggagtccggatcggctatgactgggatcggctaagtctgagttggactggttaagtgatacagccgattccgacaatacgacccgtgtgcgacattgggttcgagttgatgtgcttcaagatgattgccacgcatggatagagtcctgggaaggcaattgtatctattaattaggatattttatataaattccttagagataaatgtgggcaaaagtctgccgcaaagacttatggtatcttagagtttgttagagataagagtcgtgtccaatatggacatatcttgtatttctcgggtataaatagacctcgagccctatgtaataaaaaacacacacgttcaatacaatttcggcgcatcgccaccctttttgctttagttttatttcaacgagttattgttttcgggttgagctgcatcggtttcgatcttcaacaagaggtaaaacttgttatggcggcttgtgttctcgagattagtgcttccatctttatgatactctaatcttgtttatgtaatccgtcaagttatcatatatcttgcataatccttgacaatatcgtcatctaacttacaatcggctaacatctgttaccagaaggtagccgattaggttaaataacgacgttggcttagattatatgagatatccaccactctatgaaacatccagcggcttgattgtctagatattgttcttcttttcatacttaatgctgtatcagttgagtttgatctattaagtcgtgcttagaatttcaatctctagcctgcctactggttgccgattagggtagtatcggagtttcagccgatcttatctgatccaattgcttttgtcctacatgctcaattaacatgttagatctgccctctatgttaagatcttgttgcatttaagtatattagatttatgtttagtatattctatttgctttaatatcttaatataaagtagtattggagtattagccgatacacgttagatctatctgatcggctatgctatgaatatatatataatctcattattaatatatatctcgatctaagtgatttatactgtctcggcaaagtgaccgatctatcccaatcacttgattcaattatatatcgatataaggattatatatcgttgatatctacagccgatcgagtagatttagttctgatttgtttacttaacaattgccgatcgatttacacatgacatcggctcaaagataaatgatatgtcatcggcatctagccgatcggctatcatttatggatttaatcacggtttctttgtctttgtttcttgttgattgcaggatcaaatcaactggcacgctcatacatccgaaggcgagttttggacctgcactggagttaagcagatctcccaggcctcgtgttttctatcaacaactggtctgcttggattgggtcattcactaagctccattccagctgccaatatcaaagtggcttttacagagtcagaatggaaaaaactaagtttctgtgaagaaatgctactcgtcccatggctttgaagaaatgctactcgtcccatggcttactactgcggcaaccaccagtccctcaagcaagctctgcttctggtgctggccaacttcctactcctgcccaggcaatcttgtcatttgtgcaagctaacccatcagttactctagcaagcgctacttctaggcaaattcctacctctgctgcttaagcaacatcaccatccgtgcaagttatgccttctgcacgtccaacaatacctgctcatggccaatttgcaccctcaatttctcaaggaagcttttctactatgcaaaatctgccgaaaaatttccaataggctattatctatgcatagtcatgcttcagtccacttggttgagaaaggtactatcaacagactgatgcaactcactaatcaactggagagacgggcagtgcttcaatgtaaaaactcaactggagagacggtacccgcatatctgctgcgatgcattcatgaagcgtgaaacatgggaaaagcttggtctcgttgatcaatttgaaatccccaaggctctttacatctcatcttgtgacggtaatgtatacttcttcaacaacgtcggaggctttattgtggcaaatttaagccattggcaagagtctctgcttttatcttgtggtgcactgaaactagatgctatagcgtgatttcacttgatacatattatctagtcttatatcgcattatttcacttgatgtgagtgtactcaactagttgttgcttctgtactctaactactgttaaatatttctactagttatggactaatggtgtactctaacttctgttaaatatttctactagttatggactaatggtagataattcatgtgtgcacatttggtgctactgtgtttttattcactcttttcctattttaggaggatgtttcatgttcatttgctgtatcggggtaaataaataggatcatataagaggagttgtttgaataattagaacagaaattgacagagatcatagatcatatgagaggagttgtttgaatatgagagggagttgtttgaatctgaatagaggaaagatatgagttcgaaagggaattagacgtccagaaaaaaattggttggaaaagaagatgtggtaagaatggatttttaaggggatttcaaacacttctttttttccacatggctgctaattgaaggaaaagaaagagccatttttctttgcagtagggggaagaggtcatcacagatttgaggcagattcaacaacacatctatgattactacaaaaaaaactttttggcagagatcactacagggaggttcacttgcatgataatgtttgggccaagaagctgagactatctgatgaggagaaaacaactattgtcagacctttcactatgaatgaggtagaagctgtgattagaagtatgaaatctaatatagctccgggacctgatgggtttcctgtgggtttttataaacaaatgtggccacaattcaaatatcttataaaggaaatgttagatgatctccacatgggggctttagatgtggatagggttaattatggagttatttctcttctacc

SEQ ID NO: 8292 - DNA, 6532 bp, Oryza sativa
gtcccttgtcacccattctatttaatttagtaggggatgcattgacggctattttggataaagctaaggaaagtggaacttttgaggggttagttcctgatttaattgatgggggtattacacacttgcagtatactgatgataccattctttttgttaaagctggtgatcataacatcctggtgctcaaatttcttctattctattttaaggaaatgtcagggatgaaaataaacttattagaagtgtgaggtctatgggtttgggatggataagagtaccgaactaaggtttgctgatatgctgaactacaaagtgggtgatttgcctctcacctacttgggcttgcctatgcatgttgagaagattggtatgagggaattatgttgtatcactcagaaagtgaaaaaaggctccagtaattacttgacatatgggggtagggagataaaaatctcatgtctatccagtgtcccaatgtatctatggttttttatttacttcttgatggttttcaccacaagattggtgctttaagaagtagattctattggcaaggtttggtaagagaaaatatcatatggtgaaatgggaggcactgtgaagactaaaagattatggtggaatggggttcttggatactaaggtcatgaacatatgtttcctaagtaagtggattcttaaattagaaaatgggtgtcctgacatgtgctttgagatacttaggaagtctcttcatccggtagattggtgatgagtggggagtcatctggcaccggatgtgcagcaagaaattccgccaaggcttggcccttaattgctttctgcggtacaaaagtgatatcatattccatcatgagcagggcccatttactcgatgcctggggaatcgacgtcatcggcctcatcgatccaccttcttcaagggggcatcgcttcatcctcgttgcaacaggaagaagtatttgagtaatgacagtttctttgagagctcagctataccgttgtctcaattttggaaagggatgcactattttaagaaatggctggaaaggttgattgagaaaaagttttacaatggggtttccgtgttcttttggaaaggtgtgtggtgtgggacaaactctctgagggttcagttgatttgtatgagattagttaccagcagggggctagtgtgagtgatgtttttgatgagggaattggaagtatgagtgatgtttttgataagggaattttagaaggaacctgaatgagcagaaagatagagatttatctcggaatatggatccgattgtttggcctcataataagaaaaaccttttcaccaccaaatcaatgtatagaatcctgacttttggtggggtgaaagatgccgggatgtgtgagatctgaaagagtaggctgcctcttaagattaagcattttctttatctggtgggtaggggtagacttccctgtgcaaatcagttagttaagagaaaatggagaggggagactgattttgtaagttgtatgacaaaactgaaaccactgctcatattatttttggttgtcctttagcactttttacatggtgtattgtcaaggaggccctggacctttctggctatcctaacagtttttgggtctgtgttgatttgtagaaagataaaaaggagactaaactttggatttttcttctggggtgtctttgcagggctttgtggttaactaggaatgggtgagtgtttgaaaacattctagtaaaatctccaatgcaggtggttcaagtctttgtcctttgcacagaaatggagcatcttgctaagagagaaggagcgtgcgctgctgcaaagttggcgtgaagcaatcctgtagaaattgaagcaagtcaggcctcaaacgctgccaggagatctgtggtgctgcttcttaagtaaaaaattgcttttgctgtgttgtttcctctatgctcacggtgtaagctggcgtccccagcaaaaacctaaagctgtttctttttcaaattttattttctgtaaaagactctgttatctctttgggctttctttaaaaagccggctccatgcttgatctgtcatcaaaagaaaaaaaattctgggagaaatggtgaactcctgaactcgtcatttgttcggttcagatttcagtgttgttctatgtcatgtccagttttcagtgcatcctgttggctgcaatagctttgctggttgaaacgagtccatgaaagggttatgttgctgttcagcattggatggcttccttacctgctagtccatcctactccctctgtcaaaaaaaaaagctaatctagtattagatgtgacgttttctaatataataaatctagacgtgtctagattcgttgcgctaggaaacgtctaatccaatactccctccatcctatgatatagcaacaattggatgtgacactttatagtataacgaatctggacaagaagcatgtccggattcattgtactatgaaatgtctcgtcctatactatgttgctatattatgggacggagggagtactagattaggttttttttacggagggagtaacatagtccaaatacctgaacattaaacgacaagacatgtaacagtaatgcgtagttattattggactataagggaatgaattcgtcagccgagacgcaatacatcacaaatttgcaccccgtagcaatacatcacaaatttgcaccgcattacaggggacgcgcctgttcggtgctaaaaactccatcgagtcaaaccatgcagtcccaatgatttggtcatcaccaaaaataaataaccttagcctgtagtaagaaaactgactgctcgatctactcgtattcgtatacaagaacagttctatatacttatgttgttacgataggtttcattaagtctctcattggatggcgtaatcagtcaaagaaaaagctaaattttaaattttcaaatttaattttaagattgtttttaagatattttctacgcagtttctttttcagtattagcttttaagtcaccaagatttacgtataaatttaattttattccctaataagccgttttgatttattaagtaataagccaaatgatgggaccttaattcttttctgaaaacttatgcttgtccagctcctaaacattacaatttttttttattttctgaaaactttttccatcaacttttatcagagaactttttaaactaatgtattcaactttctaacatttaattcatttattcgtactttcgaataactatcatgaacttattagtttcatatcgaccgtacgtatgtcaactataaagaacgcatgtacagtatagttaggagtaggtagatatagtacagccttgagtacttctgaatagtataactgaataactgagactttctcttgacagtttgtacttgatctatatatataatatacttgggaaacactctgaatttctgactggtttcatatatacaccaaacacacacatataaagtaattaaaaactgtcaactagctagctatcttaacagtgtattggtcgcgtaggagtatatatcctagctctagtttctacttaattatttaattaattagttcctgtatacatgtactactgcttatatatacacatgcagtacgttcgtctcgagatgtccatgcactgcgagcacttgttaattagctagctcgactaagctcttgcttaatttgcagtacattaatttgttgcacgtacgtaatacggcaatggaggagcaccgtcggttggctatggcggcggcgttcgtcatcctgctcacggtttggagttcgccggcgatggcaatggcggcggcggcggcgacggaggtgcacagcttgggccttaattgcaatggtaatgctaatatgagtgaagaaatatgatctaaacttatttgtatttttcaactttactagtacacattgcatatcgctgcatgcacgaattcaatatagttttatattatccccggatacttcggtgagcatttctatggaagtacgaattacactttgaattatttatataactacgttaaaattctatcccaatatatcgagataagtagctaaaaattttagggacaatttgcttatttgatcccattctagatattaactactaatctgactctatttttttttaactttgcctatttaaccatattttttaaaatcgaagctaccgtctgactaagttctccctacaccattagggtttcacttaaaaaataataaaaaaatacttcatccgtttctaaatatttgatgccgttgacttttttaaatatgtttgaccgtttgtattattcaaaaaatttaagtaattattaattcttttcgtatcatttatatattgttaaatatattaatatatttatatgtatacatatggctttacatatttcacaaaagtttttaaataagacaacggtcaaatatgtgcttaaaaagtcagcggtgttaaatatttagaaacgaaaggagtattttgtagctcaaacgggtcaaaatgcccctcaaccctatccccaaaattcctcatcccgtggtccacactcatctcggccttctcggcggcgcggctagctagctgcaagcgcgctttcggcggaggcggcgcgcagagggcgcacggctacggtctcggccgtccgtcgcggagggacgacggaggctggcgcgcggcggagggagggacgacgacgcgccatacctgcctgcccctgccgcctccatcacgtacgcccctgtgccgtgccatgtcttgccctccggtatggttagcctctgctgcttcatttcatcctctcctgcgcgcccatcatctccatgcgccggctggatggatgtgttgctaatctcgtttgaaagaattaattattttctgaaccttcttatccaacgagattttctgaattatgcgacaatgctatgtccttgcgattaactctctgtatggtgagatatctgtttatctggtttacgtacgtgaagtgcaaattaaagctttgccaagttcctgttaattcactagcttgtgtctcacatttgtctgcaagtttcctttaatttacgtttgtcaaacctttaattatcaaaattcgtcaaatctaagacaaattaatttgtcaaacctttgtcaaaatcgggtaaataaataaaaacttttgataaagtagggtcaaatgagcaagggcataaacgatatttttattacaggttaacaccattatgttgccttctcgtaatagggtcaagtgtgatcttcatttttaaaaaagagggtcaaatgagcaaacttaagaaaacagggttaaattgggagttaggctttaaaacagggtcaaaaacgcaattgccccaaaattttatgcataatgaaggtatattttgacaatgttggctatgaatttattgtctagcactctacatacttacttacaaatggtagtagcatatttgttgcgataacactcatctggtagaaggatatatttatgatcgtggataattccacctgcacggaatttgagtagtattttttttatgttgggctaaaatttgacatgcaaagtcatccccgcctccccacaccaactacaccgtctgaatcagagctaccttcctgtaggtgtctcctcggcacccaacccctaaaggccgtggatcccatatccatccgtccatctaagttgaggaggttcgctcttcatcttaattcttttttgagaattttttttattattaaaagtttgcggggagttcatcttgacttgttcactccacgaattcttagttttttttatttaaaattttcttatcttatgtgggccaagtttgtgaatggttattgcaatggcagtatcgtagaatcaaacaagcagtacacggaattttacaagtatccataaaaatatagtggaggagggaaaaatggaaatgttttaatttgccatatgtacttgacttctatgaaatgcgcctaacagaaatgtgcaaatatatgcaaagaattattgttgttattgtgcagtgaagttcatttttgctcataggacatgagaatattggattgacaattgacacgaactaagtctgtgtttagttccacgccaaaattggaagtttgaagaaattggaacgatgtgacggaaaagttggaagtttgtgtgtgtagaaaagttcgatgtgacggaaaagttgaaagggaaaaagttggaatttaaacagggcctaaccttttttctttgtccctgattcagaaaccaagaggataaatgctggagtgaggaggaacttaggatgtttgcctgaagtttatcataagaaactcaagattgctgtgccactgaaacatggctttagagcttttgtgaatgtaactgaccaaggtgtcactggctactgcattgatctcttcgaggctgccgtgaataagttaccataccgtctgatttatgagtttgttgtcttcgaccgttcttatgacgagct

SEQ ID NO: 8293 - DNA, 3813 bp, Oryza sativa
gtcatccccccctccccacaccaactacaccgtttgaatcagagctcccttcctgtaggtgtctcctcggcacccaacccctaaaggccggggatcccatatccatccgtccatctaagttgaggacgttcgctgttcatcttaattcttttttgaggatttttttattattaaaagtttgcggggagttcatcctgacttgttcactccacgaattcttagtttttttttatttaaaattttcttatcttatgtgggccaagtttgtgaatggttattgcgatggcagtatcgtagaatcaaacaagcagtacacggaattttacaagtatccataaaaatatagtggaggagggaaaaatggaaatgttttaattttccatatgtacttgacttctcctatgaaatgcgcctaacagaaatgtgcaaatatatgcaaagaattattgtaacagaaatgggcaaatatatgcaaagaattattgttgttgttgtgcagtgaagttcatttttgctcataggacatgagaatattggattgacaattgacacgaactaaccttttttttttggtccctgattcagaaaccgagaggataaatgctgttgtgaggaggaacttaggatgtttgcctgaagtttatcataagaaactcaagattgctgtgccactgaaacatggctttagagcttttgtgaatgtaactgaccaaggtgtcactggctactgcattgatctcttcgaggctgccgtgaataagttaccataccgtctgatttatgagtttgttgtcttcgaccgttcttatgacgagctagtacagagtgtatcttcaggggtaagccttactccctctgttttaatgacattgttatataatcaagtactaatattatatatctgctggttcttgctaccagatcaacgatgcagcagtgggggatataaccataattgccgatcgagctagccatgtggagttcacaatgccgtacaccgagtctggtgtttcaatgcttgtgcttgcgaagaatgaatctgaatcaaaaatcgaatgggtattcttgaagccactgacaaaagaactttggtttgccactgtgatcttctttctattcaccgcattagtaatttggataattgaacatcccagaaacatggagtaccaaggatcgaacacaaggcagttgagcactgctctctattttgctttctccactttgacattttctcatggttagtacttagaggctcaactagtaggctatatgcagtattaagaggtttaactattttctcatagtacttcttcaataacctactatctctgttatactatgcacaggtcaaattattaaaagtcctttgtcaaaaatcgttgtggtaatctggtgcttcgtggtgctggttcttgtgcagagctacactgctagcttttcatccattctaactgtaaagaggttcaagccctcagtgacatatcttgaccagctcctgaataatggtgattatgttggataccaagagggatcctttgtgaactcatttttgacaagacgaggtttcagtgaaagaaggctaagatcctacacaaagaaacaggaatatgctgaagctttgaggaaggggtccaagaatggaggtgtgtctgctatcgttgatgagatcccatatttaaccgctattgtctcagaccctcattaccagaaagaattccagatgcttaagcgcatatataagactcccggttttggttttgtaagcctcttgctctattgcttcgcttaattcactcatcatcctttaagagctatgctacattctggacaaaattttctggcctaactggcatgatcatgtttttttctttttttgttccccttcaggtgtttcctcctggttttccactggtgcataatctttcaactgccatgttggatgtaacaagtggggatgaggggtcacgtatggaaacgaaatggtttggtgcagaggctgtctctccaagtaatgcaattcccaacacagattcggcacctctcactttgcggagtttctctggtctttttatcatcactgggtgtatctcaactctcatgctgatgattaggttctccatgtcaattcttgccaattacacccaaattagagattctgatgtgcaaagtcctgatgtgggtggtcgaaacgatgcacatgaagaatctaatcaagcacagaacagcatgggttgcattgtggttgatatacacctccatgaagttagaattggcagttcccaggatatccatgggagtgtcgaacgtgctagctgatggcggagagcctcgaccaattcagaatggccctgtgcctgcaaattccatccagacagtatgaattacatggtcatgctgagcgtgctctggaaatataaaaacaagaatgctccatctcttcatttattgtaggtattaaccaataatctgctgcagaaattagtctgggatgttcccactcagcaactagccatgcttcaccgcaggcggcaggccgtgttggattagacagttctatgcatagtttagtaactgatcacgtcttatgttttatcacttgcaattgatattctttaacaaaaatgtaattatcacttctattttccaaaggcaatatatatatactcttgttttcctcaaaaaatatatgtactcttttattatcgtttccctgcagataaaaaaactactgattcgcttccagcctaccagatgaatgataccttgaaattttagctgtaggattgatcaatgtccagatttttcttatacctgggggcattaccaactggtcagaaagtcagaatcagaactgcatgaacaagtgtatagatctgaacatggaactagaccagaagtctagagattatttgtcccaagacaaataatctggtcattcatgatatcagattcatgctgaatgagcatgaatgatgttcagctgatgtttgtcttgggcttttttgatccgtgcatctactgactaccgagagacaacagagcagatcagatggcattgctactttgcttattatatccagctagggcagcttgacacacaagcgaaaaatgttaccatgtttaatttgcctatacaaaaaaaagaagtgctttcactttgatatatatatgccactgtatgtgtaaactaaatttgtgtctcgttttctttaccattttttctaggtggcagcgcactcgttttcgccactgcaactcacatgtacattctttttaatctaatagtataaacatgaataaacttgtgtcccgttttctttacatgtacattcaattttaatctactagtataaacatgaagaaatcttaattttaatcttaactaattaaaatattcatattttttcaatccttacattgtccgtgcccaaattttcgtccgtccgccccccaccccccaaaaatctcagttggaattgcatcaccccccaaccaaaaaaaccaaaaaaatgccaatcgaaattcaatcagacaaatagaagcatatacatacgagttcgcatcaaataacatacaaagttttaatccagttcatgttagatcccaaatacaagaatagaagaatagcaaacggagataaaaaaaaacaaatcaaccaaaaatcgagcggagtttgccgtagcagcagtcgccaccgccttccatggccagatccggcgagtggccgctggcagtggcttgccgagctgcaccgccgcccccgccaccgccatcgttttagcaagttggggggggggggggaagcccacaggg

SEQ ID NO: 8294 - DNA, 35317 bp, Oryza sativa
  unsure (1)..(35317): unsure at all n locations
ggcctgggaggcaatatggggtggagggagccgccgccgccgctcgcggggagggaggaagggcgccgccatagccaggagggcactgccaccgctgctcgcacaattggagtgcagtaaggttgatctgatagctagcgaaaaatatttcttatattatggctactctttacaatatgaaaaaaaaagtgtttatcaatatttagtaccaaaaaataacaaagtactgcaattgactcataataatacataaaaaaataaatattttttatggtttcaaactttagtgtccatatcagtggatttagagcagcaaacaattatatcatgttagcatcttatttacactggaaagattcgattcgattataaagacctcaattaatctggtggttttatgctcccacacactaattactattttttttcttcaaccagtgcaaaattaaacgagttttaaaacctgcgggctagcccgtcccacttgcatgctgttgagtccgaagacctgaacattaatcgagaagacatataacgttagaagtacgtgtagaacattcaagttctttgaaatggatagggaaggaatcactggtggagaagtgctttttagtcccggttcgtaacccccctatagtcccggttttcaaaccgggactaccaatccgggactaaagagagggtagcggcagtccatcagctagtcctttttttttattttctcccgaatcgagtggtatgcatatcatcaaatcaaaccccaaatccacatcacaactccacagcatgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaaatcgactcaccggccggcctcccatcccgccgccggccggccacccatctcgccgcttcccctccggccggatctgggggaggggagggcgaggccgccggcgaccggcctccatcccgccggcccgcgccgggccgccgccggccgtcctccatcccgccgcttcccctctggccggatctggaggaggggagggcgaggctgccggcgaccggcctccatcccgccggcccacgccgggtcgccgccgcctgtcctccatcccgctggcccgcgccaagccgcaatcccgccgccgccggccggccgcctccagccccagcccgcgcctggccgccgccagcccgcgcccggccgcctccatcccgccactgccggccggccgccgccagctcgtgcccgtcccccatcccgccgccgtcggctgcctctgcaagaggaagagggggaggggaggaggagagggggtgagagaagaggaaggggagagcatgaagataaggaaggagaagaaaaagagataaggataggagatagagagagagagaggggctacgcatgcgcttgtgcgtgggctggtgcgtacgctttattcccggttgatattatcaaccgggagtaaagatccctgggatctttagtcccggttggtaacaccacccgggactcaaaatcctatctttagtcccggtttggtgtatcaacccgggactaaagatatcgaagggcctacaaaggcctgaaagattaagaccgggacttaaagatcattttaagtccggtgtggtacccccanggagactaaagatcaaatatgcccgctgtagccaccaccggggactaaagatcatctttagtcccggtttttagtggaaccgagactattgtggatttcgggcgaccgaccaaagatggtttctccaccagtgaattcgtcagccgatcgagacaacgcatcgtcgtttgcaccgtattacaggggacgacgcgcctgtttggtgctaatcatggagtcccaatgatttggtcatccctacaaaaactaaccttagcctctaagaaagaacaccagactgctctactcgtattcgtatacacgaactgttctctactaggtgtataagttggtatgccacaaacccacgcatatatagatcataataagatattcgtagcttattttagtttataactggatttagtggattagtcacttacaccctcatattctctgcatgtgggtttcgataggttccattctttttagattattttattgtggttatatatgcttatcaagctcttaaatagtatgttttttttaagaactttttccatctacttttattagaaaatttttttaaaccaacgttttttttttaactttttagtagcatttaagctatttgtatgtaccatcaaaattattatcataaattaactcaatctcagtttcaagtcaagtcaagtcaatgattgattattatttctacattctgcaacgtatggctcagtttagttctaaaattttttttctaaaaacatcatatcgaagttttgtatatatatgcatgaagcattaaatatagataaaaaaactaattacacagttatgatgaaaatcacgagaggaatctttttagtataattagtccataattagccataagtgctatagtaatctatatgtgctaataacggattaattagactcaaaagattcgtctcgcggtttccaggtgagctgtgaaattagttttttcattcatgtccgaaaaccccttccaacatccgatcaaacgtccgatgtgacatcaaaaaatttttatttcgcgaactaaacagggcctatataaacgtatagtaaggagcaggtagttacaggaatagtataactgaatacccaatcgagacgttctctgacatgcattgacacagtctgtacctgatctggagtatactactatacttgggaaacactccgaatttctgactggctacgtacattaccaaacacaaatagtattaaaaaaaatactgtcaactagccattttgacagtgtataaaccgtgtgtacgttggttgcgtgttagtgtcctagttaattactattacttaattgcttaattagtagtgcctgtatacatatacttatttttttttaaaaaaaccgtgtatacgtatacttctacctatatatatacatgcagttcgtctcgagatgccatgcactgttaattgctgtgtgttagctccttaattagctagctcgactaagctcttgctttgcagttaatttgcacgttttcgtactgtacggctatggaggaaatgcctcggttggctatgggcgccgcgatgctcatcatgctgctcacggtttggagttcaccggagatggcaatggcggcgtcggcggcggcgacggtggcgcaccgcttgggcctaaacggcaatggtaatgctaatatgagtgaagagatatataagcttattatttgtatttgcaacattcctttcaaaaaaaaagttatttgtatttgcaacttaagtactactgaactagccatcgtcatataaaaagaaccggagggagtacgtcgctgcatgcacgaattgtttactatatatcccccgctacttcgatgagcatttctatgtaaatttagttacagtttgaattgtttcggtaagtaagtacgataaaattctatcactctcgggttcattgcgtctaattaagtacataatgaaggtgtattttgataatgtttttgggaacacgtgagatgcacatgttttattaaaaggaacagaagtaagtacatagggttgttagacaataaattcacgtacttacttacaaatggtagcatattttgtgcaatagtacttatctctccaatggtagagccgtagaggatatatgtacggttgtggataagagattcgatgatgaggtcataactataagagtaactataaataacatagcaaaatttgggtaaaagctaagttctggcatgcacagaatttgggtagcaattctttttcaaatttagtatggaaaatcatttagccactctttagagatgctctaaagatctgggaactagggtgcattgacacttccattataacttatttttaagttcatgttaaattacttaacacatactagtagaaagagaatggaatgtgagaaacttaaggatgtctaacgcgcgaatgatcgtgcatggagtggcacccctctcctcctcccccaccgcatcactcccgaattgctcagtcgctcctagtgccctcgtcctagcgcacgtgggcacgcacaaaacttggttttgaaaacaaattcaaaaataagattttctaaaaaaatgtactaacaacagaaaaacaattatgtttgagaatattcatgtgctttatgcatataaatatatatacattgaaactctataggtataaaatgtactagaatcttagcaaaattctatatacccctttctttcctttttatatgaagttggttagtttaaccaacgtcaaacaaataaaacatagagtataaatttgatagataaccttttatatacaaatttcatacatatatcttaaaaaaaaagtcatgcggtgccaaaataagaaaagcctacctgattatgcggtcgcgcgatcacccgtacattagccttcttggaggaacccagagtggaagatatagggtagctaagaggtgaaatctgagccatacatccaaatccaccggccaattcttcctcaatcagagctcatccccttcccttcctctttgtcagttctcaattctcaccatcgttcagacggagagcccaatgccgcgccgccgctaccgtcgccgccgccgccggtggtccacccctatggaggggcgcggctgcgccaccggttgctataccgtgcgattctacccgtattgctctaatcccccacctccccaaccacaccgcgccgcctgagtcagagctccgttactgcagcattcatgcgcgctgcgcgcatggtccctccgccgcaccaacccctaaaggccgtggatccattcttccatctaagttgaggaggttcgctgttcatcctaatttttctaagagtttgtatttttaaaaaaaaatcgcggggagttcatagattgttcactccacgaattcttagtttttaacttttcttatgcggggccagtttgatagtgattgccatgacagtatcgtagaatcaaacaagcagtacgcaaaattttttcagcagatcatatcaattgccatatctatccattattggctctatttacggtggtatcctttaattttttaaaaaaaatgatataagaggacgcgatcccttctccaatctattaagttattgaaggaatagaaaaatgagtctccacgttcactctcacggcctaaaaattctcatataaatcggagaaaaagaaaaacagagtccatatagaaatacaatttagaaatagttgaaattcggaattaaaaaacaaggaatattggaagaggagcctagagtccatatagaaatacaattaagaaatgatagaaattcggaattaaaataaggaatattagaagtagagtatagagtccatataggaatttaaaactaactaaaattctaaataaacataataaaattaaaagtagattttagagttcgtgtaaaaatacaatttacaaataactaaaattcgaaattaaaaaaacacaggaagaagagtctaaagttaatatatgaatacaatttagaagtacctgaaattcaaaattaaaaataaagaatattgaaagaagagcctagagtctatatagaaatacaattcatagataactaaaattctgaattaaaaaaaagaaatattgaaagacgagtctagagttcatataatataatttacaaataactaaaattttatattgaaaataattaataactaacacgtatataaaatacaatatgaatattgcacattagtagtttcgtaaagttagtataaaatttaaaattatgttgtcattttaatatatttgaatactacattgagaaaacatatatgttattatatgagagaaaatataatgatgctagccgcgcaatctgcgtggaccactatgctagtttccatatatcagaaatgagcatacaggattgacctagttcaaacaataataaaaataaaagatagaaaagatcaaaagaccaacaacccgcctggagcaaccagagattctattcatccaagatgccatccatcttgcagatttgagaatctgatttaacttctcacactcatcccagctgtcatccataaaaatatagtggagggatatgttttcgtttgatatatatccttaacaatgtactcctatgaaatatgcctagcagtaatgcttaaagaacatggtgcaaacatacgcaaagaattattgttgttgctgtgccacgtagtttagttttgctcataggacgagagaatattggatctagagatgcgctagtagcgcagcagtggcaggggtcgctggcacgcaccccgtcggcccgggttcgacccttatcgagcacgctcaccagggaaatatttacctctcctttcttaaaaccattgacaccaagttcttccttggtgtccaacctttttttttaatattggatctacaattgacatgaactaacctttttttttcctaattcagaaaccgggaggataaatgttggagtgaggagaaacctcaagattgctgtgccactgaaacatggttttagcgcttttgtgaatgtatctgaccaaggtgttaggcgctggccctaagtggcgtagcgcgtagctgtgctcgacgggagggcgagggcgcacgcctcgccttcccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttaatccaacctcacggcgcctgctctggctgttggcgtcggttccggcgctgatactgaatgccccacataacatctctcccctcctcgacaaatagctcgtccgcgagctggaatgcgggatagcgagtacggaaatcgtccaagtcttcccacgacgttgcagatgccggcagaccgtcccaacgaacgagcagctgatgcaccccacgagccatacgagacttgagtacttgtgctggctgaggcaacgccgctccgtgtagtgtcgagggcagcgccggtggagacgtcggcggcgtgccgacgaacggcttgagaagaccgacatggaacacatcatgcaggcgcgccccagccggcagagcgaggcgataagccaccttgttgataatttccagtaccttgtatggtccataatagcgcggcccaagcttgccttttaccggagttgctaatgatgccggaacgcgatggcgaagacggagccaaacccagtcgcccaccacaaattgcagctcccgatggtggcggtcgtagaacttctttgcatgctgctgggcctgctccagccggtagcgaatgtcgtcgaggaacgccgatgacatgtgcagcttggtgcctgtggccgcgaagagggcattccagaatgtcgaagtgaacaccggatcccggtcggacacgatcgatgttgggatgccgtgcagacgtacgatgtcggtgtagaaggcgcgcgccacagactcggcggagtatgggtgcgacagcgtgatgaagtgcgcgtacttggagaaccggtcgacgacggtgaggatgacggacttgcctgcgacgcgaggaaatccttccacgaagtccatggacacatcggaccagacggccgacggcaccggcagtggcaggagcaggccggcggggtggagatgttccgtcttgttccgctggcagacggcgcaagccttgacgaattcctgtaccacacggcggtcacccggcgtatggaactcgcggcggagacgatgcaaggtcttctggatgccttcgtgcttgtcatcgtgcaccattgccagggccgtctggagaagggctgacgccgggggaatgtacatccgctgcttgaaggtgacgatgccgtcggtgagtgcccatggtgctgtcctgttgccggccagaatctggtcccggagggcgaccagcgcggggtccgtgtcgttggcggtgtgcagatcctgtagccagtcaaacaccggcgtggtgatggcgcaaagcgaggcagccggctcgtcgcggcgggacagcgcgtccgccaccgtgttctgccgccccggcttgtaggcgacctcgaaatcaaagcccaatagcttgccgacccagtggtgttgcgggagcgtggctagccgctggtccagcaggtacttcaagctgaagtgatcggtcttgacgacaaaccggcgaccccaaaggtacggccgccagtgtcggactgcttgaaccaacccgatgagctcccgctcataggccgccagggcgtggtggcgtggcgcaaaggcgcggctgaaataggcaataggtcctccatcctgatgcagcactgcgccgaagcccgtgcctgatgcgtcgcactccacgatgaacggctgatcgaagtccggcagggcgaggacgggcgccgtggtgagcgcctttttgagacgtccaaacgctacctcggcttccggcgaccacaagaagccgtccttcttgagcaggcgtgtcaggggagccgccacggcgccgaaatcgttgatgaacttgcggtagtaccccgcaaggcctaggaagccccggagagctcgcgcggagcaggggcgaggccagtccaccactgcctgcaccttggaggcgtccatggcgacgccctggccggagacgacgtggcccaaataagcgaccgaggtgtccccgaaggagcacttcgaccgcttgacgaacagcttgtgggcgcggagcgtgttgaagacggcgcgcagatgttgtaggtgcgatgaccacgacgggctgtagatcaatatatcgtcgaaaaacacgagcacaaaccggcgaaggaagggctcaagtacctcgttcatcagggattggaatgtcgccggtgcgttggtcagcccaaagggcatcaccaagaactcgtagaggccgtcgtgggtgcggaatgccgtcttctcaacgtcggcgtcgcgcatccgtacctggtgataaccagagcggaggtccagcttggagaagaatcgcgcgccgtggagttcatccaagagctcgtcgaccaccggtatggggaatttgtccttgacagtgcggctgttgagcgccctgtagtcgacgcagaagcgccacgacccgtcggccttcttgaccaagaggaccggcgaggagaaggcagacgagctgcggcggatgatgccttgggcctccatgtcgcggcactggcgttccagttcgtccttgtggcgcgccgagtagcggtaaggtcggaccgccacgggcgcggtgtcgggcagcaaagtgatgcggtggtcttgatggcgtggtggcggaaggccggatggcgtggcgaagacgtcggcgaactcggtgaggaggtcgtcgagcaggtcgcgggtggtggcgacgtgcgcagccggtgaagcgcccgtgggcaggccacgccacagaaccatgtgatctttgtgccaaaaagacatggtaagttggccaaagtcccatagtatctggcccagcgttgacaaccattgcatgccgaggacgaggtcgtagccgcccaatggaaggacgtagaggtcggtgatgaacacctcggtgtcaatggagatgcgcgcgtcctggaacatccctggcgagggcaccttgtcgccgttggcgactgtcacgcgcaggccagcgcgttggacgagcggcaagtgcacccgtgctgcggcctcctgggacaggaagttgtgtgtcgaccccgtgtcgacgagcgcgtggagggtggcgtcgcccaagcggacatggagatgcatggcgttggacggacggacgccggtgaccgcatgcagagagatgcgaagcgtctccggttcgacagccggtgcagcgccttccacctcgtcatcatcatcatcataagccaaatcaagaaggaataggcgtttgcaaacctttttgtggccacgggcgtagagctcgtcgcagttgaagcacaatcctttgcgtcggcgttcgtccatctcggactgggacaggcggcgaaccgtgcggcctgcaacctgtgtggacgcttgtcccaccgaggaagctgcatccggttgcgacggggtcggcgccgctgaagaggacgcctggtcacgagcggtgtgtcacggtgtagtgcgagcggcgagctcgcggcgctcaaacgaacgcgccagattcatggcgaactccaaggtggtcgggtactgcagttgtacgtcgatgctgagtggttcttggagtccggtggtgaagaggtctacttgctgctcctccgtgagagggccagcgcgagcgagcaagtcgaggaagcggtcgatgtaggcggccaccttagtcttgcgtcggcaggcggcgagtttgcccaaaggcgcctggcgtaacggcggcccaaaatggagattgagcaagtcggagaagcgtcgccatgtcggtgtgcccaaatcgcgttcgatgcgcatataccactgccgagcaccgtcgagcaggtggtaggatgcgagccaaactttctcctcctccggcgtgcgctggccctggaagaattgttcacagcgattgaggaaatggagtgggtcaccttggccgttgaatttgggaaagtcaatcttgtggtagcgtggcggacgatcaccgcggcggccgtcattgtcgtggtcgtcgtcacggtcgcgattgttacggcgcggcgagcgatcgcggccagcgcgttccaaacgctggatggcgatgtggtgcgcctgctgttcattgtcgaggtcggagagcttgccgcggatggagtccaagcggtcgaggacctcagcgagacccttcttccaatcgtcggcgacgttggtgacggtggaagacatggcgcggcggcggcgagggagaggatcgtggaagtctgataccaaaatgttaggcgctggccctaagtggcgtagcgcgtagctgtgctcgacgggagggcgagggcgcacgcctcgcctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttaatccaacctcacggcgcctgctctggctgttggcatcggttccggcgctgatactgaatgccccacataacacaaggtgtcactggctattgcattgatgtctttgaggctgccatgaagaagttaccaaatcatctgagttatgagtttgttgtcttcaatggttcttatgaccagctagtacagagtgtatcttcaggggtaaagccttactccctgtgctttgatgacattgtaacagaaccgaattcttacactatatctgctggttcttactatcagatcaacgatgctgcagtgggggatataaccataactgccgatcgagctagccaggtggagttcacgatgccgtacaccgagtctggggtttcaatgcttgtgcttgcgaagaatgaatctgaatcaacaaccaaatgggtattcttgaagccactgacaaaagaactttggtttgccactatgatactttttcctattcactgccttggttatttcgatgattgaacgtcccagaaacatggagttccaaggatcaagaacaagacagttctgcactgctctctattttgctttctccactttgacattttctcatggttagtatttggagctcagctttcaggctatatttgatgcagtattaagtggtttagctattttcttacaatagttcttcaattacccactatctttgttttactatgcacaggtcaaattattaaaagtccgttgtcgaaaattgttgtggtaagctggtgcttcgtggtgttggttcttgtgcagagctacggagctagcttggcatccattctaactgttaagaggttccagccctcagtgacagatcttgaccagctcctgtgtaatggtgattatgttggataccaagagggatccttcgtgcactcatttttgacaagacgaggtttcagtgaaggaaggctaagatcctactcaaagaagcaggaatatgcagaatctttgaggaaggggtccaagaatggaggtgtgtctgctatcgttgatgagatcccatttttaaccgctattgtctcagaccctcattacgagaacgaattccagatgcttaaacgtatatataagacgcctggatttggtttcgtaagtctctcactccattgctttggcgaattcactcatattcctttaagagctatgctacaatctggcctaaattgcatcatgttttcttcccttcaggtgtttcctcctggttttccactggtgcataatctttcaactgccatgttggatgtaacgagtggggatgagggctcacgtatggaagtgaaattggtttggtgcagaggctgtctctccaagtaatgcgatccccaacacagattcgacacctctcactttgcagagtttctctggtctttttatcatctatggatttatgtcagctctcatgctgatgataagcatttcaatgtcagttcttgcccaatacacaaaaattagagtttctgatgtgcaaagtcctggtgtggatgatggaaacggtgctcatgaaggatctaatcaagcacaaaacagcatgggcaatggctttgtggctgatagacctctccgtgaaattagaattgacgacagttcccaggatatccatgggagtgtctgaacgtgctgatggcaaagagcctcgaccaattcagaatggctctgtgcctgcaaattccacccagacagtatgaattacatggtcatgctgagcgtgctctggaaatgtaaaatcaagaatgctccatctcttcatctattgtaggtattaaccaataatctgctgcaaagattagtctgggctgttcccattcagcaactatagctacgcttcaccgcaggccgtgttggattagatagttctatgcatagtttagtaactgatcacgtcttatgttttatcatttgcatttgatattctttaacaaaaatgtaactatcacttctactttccaaaggaaatatatatattcttgttttcctaaaaaaatatatatctactcttgtattataatttctctgcagataaaaaaactactgatttgcttccagcctaccagatgaatgatatcttgaaattttaactgtaggattgatcaatacccagatttttcttatatatgtacctgggggcatcacaaactggtcagaaagtcagaatcagaactgcaagaacaagtctatagacctgaccatggaactagaccagaagtctagagattctgagaaattgcatacacgtgtccagtgcctgcgaagtcatgcattcagtcagtcacctatgaaaaccaagacttggttatgaagaaaagtttcagggaagacagactgctgaattctgattgcttcttgctattctttgacaattcgaatcttggggtgtgtttatagttcacgctaaaattggaagtttggttgaaattggaacgatgtgatagaaaagttgaaagtttatgtgtgtagaaaagttttgatgtgatggaaaagttgaaagtttgaagaaaaagtttggaactaaacaaggccttgatcaatattatagacagacagatcacatgagatgtggaacctgtcacggtcagatcagattgaccaatgagatgtggaacgtttttattttagcttcatggttgacatctatatctatacctaattaaaaaataagtaaggcttcctgttaatcttttcgtccgtcattaagagtgggcccacacgataattcgtcgctaatccacgatccgaaagcgtggccacgatctcttacgcctgcaaataaaggagaaaataaaaataaaaagagaaaaccttgtttgtggagcagcccatccaaagcagcccggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaataaaatgaattatttaccgacaaaataaattcttttttaaaaataaaaataatcacatgtgtctttcttttttttagaaagagtaatcaccaacaaattgaatcatgtttacatttggatttttttccgctcatcaattgctcattcgccacaggacacctaatcacatcactttttttttcattcattgtataatttcttctattatttagagtgaaagttattctgcgatataccacatttttttctttccttctgattatttaagtgagtggttatgcaattggagtgcagtgaggttgatctgatagctagcaaaaaatatttcttatattatggctactctttacaatatgaaaaaaaagtgcttatcaatatcgagtaccaaaaaaaataacaaagtactgcaattgactcataataatacatgacaaaaaagtaaatattttttgtggtttcaaagtttagtatccatgtcagtggatttagagcaacaaataattatatcatgttagcgtcttatttgcactacaaagattcgattcgactataaagacctcaatgaacctggtggttttatgctcccacacactaattactattttttcttcccccaatgcaacgcatgggtattttgctagtacctaattaaaaaataagtaaggcttccggttgatttttttcgtccgtcattaaagggtgggcccacgtgattattacgccgctaatccgtgaatccggatgcattacggcgatcgatctctgacgctccgcaaacaaaagagaaacgaaaaaaagaaaaaccaagcgagcagcccagccaagacggcagcaggccggcccaacaaaaagcaaacgtagcccagtagccagcccacagagcagagaagcagtagcccagtacaacatagttctgtgtgataccgtagcaaataagcactgtagcacgaataataccacctaaataggaggcttgcctgatactatctatatctataactaatataaatatttgtattttttctttcgtcacatctaattttcatccgtacacaatccgatttggttagcaatagccatggaaaaaattgcaaaaaaaatccgccgcacctgtcgtcgctataccgtgccggcgagacaagaaggagagcgggagagggagcgcggaccccgtcgacgccgccgttgggagggcgccgtttccgccgcaccccgccgtcaccgcgccgtaccggtgagaagggagggagaagagaaggggaagcggcgccggtggggggagagacgaccccggtggcgggggagccggtcggctggggggagggggagaggcggagagggagcggcgccgccggaggggaagggaggggaagcggtgccggtggggagatggggaggggggaggcggccggctcggctcggctgggaaggagggggagggttagggtttttatcaatttcaaactgatttgagccgtccatcaaaacgaaaacgaacggttgagatcgatcgagagtttgggccgcaccacttgggctacatcacttgggccgcacgcgggccgtcggtcgcttgcgggctgaagaagaaaatgggctgaaaaaggctcatagagaaaaaataatttttatttaaataaatgctgaaatgatatttgtattatcaaaattagcaattaagctatgtaaattccaagaaaatttcaaatcaaataaatagttcaaatcaaaaaatatttcaattcattttcttcatataaatagttcaaatcaaagttcagtcaccatatcattatccggtgcaacacacgggcattttgctagttactagatatttcgaactagagtactccatccgtcctaaaatataagggattttgagtggatgtgacgtatcctagtactactaatctggacaagcttcatgttcagaaacttccaagaaacttctttcttttttttatagtactataaattgcttggagtcttggatcagattgttagctagagcaataatccattttcttatcggttgtaaaaaaacccaatatattggatctattataaaaatcgtacgtggtgagaatattcttgcatatggtgcaatttcggggaaactttttagaatggcgagtttgaaatactatcatcaagggagaaaatactaacagttcacgtcggtaaataaatgtttgtgtctggtgattgaatcctaggtttctatggctcagtttgctgcagctttggagttagatgatgatgacctgagttgtccacatctctttgcagaggatgctttatcagtgaccagcactactttcttgtatgagaaggatgctcccaaggattgtttggggactacttgtgggttgcttccatactatagagtgctttattctatctttaggtggtcattgctcctcaaagtgggagatgctacagctcttcctggtaggcatgcgcttctcctcagtcgcatgcgctacaacaagtcagattttagcatcatgaagcttatctggagtgagatctatgagacagtgtgtgagccaaagaggggttgcatctatgctccttatatcatgaagatgattgaggcaaaggctgggatttgttatttcaaggataaccagcacaagtctttccgtcctcgtgctccctcttcttcagctactccttctgccagggagactcgtgcttctacatcagctgctccttcttcttctgctgctccacagcgctctgagtcttcctcccccataaagaaggctctccgggctatcttttgcatgtgtgctaagacagctaagaaggtgaagaagatagagaggcgtcagaaggaagattggattgcagcaggcaaggaggtctctgatatttctgatgatgaatagtttgctgatccttttgctgcttatgaggctgctcgagacattgctagtggtgagggaccctctggcactgctcatttcttcaatgaggagtcctcccactctgaggagagcagcaatgatgatggtggtgatgatatccctgacccagagtccgatgcacctacagagaatgtgcctacagatccagatgaggcagtggacgccgccgggcaagacattgactcacctcactccggcgacaccgagatcattccttctgatggagatggtgatgaggcttgatcctcttcttcccttgtgattttgtctctttttggtgccttgatgccaaagggggagaaaattgcaatcgaagagggtcaaaattttgtttttgttgtttgctgcctgctctgtctgtttatccggaagttccggatccttttatccggaagttccggacctggcagctccctcgctctatattcctgtcagcttgtccggaagttccgggtattttatccggaagttccggacctggcagtcctttggcctctactcttatggacttgtggacatgtaatatttctctagttgtgtggatgtaatgactgttagatgctcttagctgctccttatatatattgcacttcatttatgctatgagtgtcttatttcttgtttgtgatgtgatgttgattttattctttttgagtgctcaccatgtcatatcatttgcatatcatatctattcttactgcttatttgcatcccacgaatgagtagtgatgaaggaaactctccacagttgttcccttattcatatgcatatgagtttctctcatatcttccatatgcatacactaagggggagtttcattcacctctaaccattcaaaacaaaatttatatcaatcttttgtaagctttaaccatgttgtcatcaatcaccaaaaagggggagattgaaagtgcattaatccccctagtgggttttggtgattaatgacaaatgtggttaagggactaatgagtttattgagctaattttcaggtgcattagtccaaggtgtggaagatgcatgctgtcacaccccaatccggcatcgccgtacaacggcacttgacaggagcgtgtcgtaggaataacggcgcaaaccgcttctgacggagcttggggctcctcaccgggagaccgcgcaggcccccctttgccggttcggccgggggcgctaagtgaggttcttcgccctcgatctgaggaatgtcagcgagaagaatcgcataagacacgggcgatgtagacaggttcgagccgctgagaagcgtaataccctactcctgtgttctggtggatctgtgtgtgaaggaatacagctcgagagaaccagagagagctcaggctctagaaccaagtggccagagttcgacccccctctcctaggcctgggcctcctttttatgtggtcaggggtcaccacatgggcctctagctgcctaagaaaggaaacatgctttttacaatgagggctagtctatagccggaagtgacctctgacaagcacagcacacgccttctgctccgctcgtcagctctcccggtggacgcccatttcaaccttcattcaatggccagcgactttcttcccatgcttgcgctgaagcctagaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccggtctgtgaccggtcacataccgcgactggtcacggaccggataagcgtgcgctgcgccgcattaaatgcggcgtggcgcgctcgtccaatccgctataaatgcggttaggtgagccccgctgggctcacctatcccacacacgtggcgccaaaaccatagggggtcggggcgtcccaggcctcggggccgaaacgggagcggtccgacccctcggggagacagagggaggggtggccacgtcaccctcgggcccgacccccttgagggggtcaggccacgtgggtgatcgcggctaccccgggctctagtcacgatacccccagccccatgtcaccgacagcttcctacgaaaccgcgatctcagtaccagtcccaggacatagtgctggtacccacggtgacaaatatggatcattgcaaatccttaaaacaaatagatgacttatttaccttaacttaggttgcagctcaggacagcctgagaatacaaccgaagacacagacgaggaaacaccagcaacaacagcagcagcggaaccaacggtctaacacccaacaccacaggcgacggctgggaactaggacaaaaccctaatcttcacttcacttcatcttcacttcacgacggaggaactatatatatttatatagagcaagggtgagtactttcgtactcagcaagtcacgggaacttaggtgtttaatgcaagcttggaagagaggcaaggttgttttgcaaatcctttgtttgaaatcatttttgaaatcactacgtgatttatttctttttaagtttgggtcgaaaggagacttgcgtctcgattcgacttaagagatgattttcaacaactcaaatggtaatgtaccaacctcccgggtcagatcattacttttcggctcccagagccatttcacttgattaggcggctcccagagcctttttcatttttgcggactcccagagtccagctgcccagcagcaaagcaatccgcttccactcgggaagcctagtctatgatgctcgtagacattccgaatcacacaaattcgtttctgaccactcaggtcatccatctgccacataggctgattctggttacgattcccacaccacaacaacttttcacaaagcactggcaaacaaatctacgcaacgggaaacacctcacatccgcccttgactgtgggcacggctgttcgaacagttagttaacctctgcagaggggtacactttacccacaagacacgaacttactccagacactggctggtgtcggaggttcgtgacaaggcctttccaaagccaatcctgggtcacctcatgccacatagagggtctccctgaccaagatcgggccaactccggctttcccttaggactcccgggtgccttcctctgtttcggactcccaggatgcctctacccccacatcccggctttccacctctattggcatacaagatttcccaaaagcaactaattacttagccagggtgtcccataccaccatgtggttgcacttgttatgcttgatgaatttcccacaggaatcggtccttatatgcgaatacgggatgacgccacataggcacaacacccgcatcgcgagttttcacaattcattttattttcaaacacaccgacaccacatgtcgggttttcaaggcttctcaaacccattttccaagttttcgacaatcaacggtgtatgtgggatatttggtatacgcgcttagagagcacggataccgaggtaccacaagggtggagcgacaaggaatcagggtagtacagcctacaggaattagtgcgactactgggtaggtccgtcggtttggcacgcaaaccgaggccaagcaagttaagtgtgtgattctaataatgcaagttgcaaacaaaataataatgattttccaattataggagcaattgatcaaagggtgacttgccttgctcaaggtcttcacgaagcttcacgaatcttcgagaaaaccacgattgacgaaaatccggtaaccgcaactatacgtaaacaatcagaacctaaacaaaagaccaataaaagatcctatttagactaaattatagtgccattagacagatctcaattttatggaattactggaagtggaacggggtcaatcgggcgagcggttgaggagatatggatttcctaagattatttgtattttctgtctaaaggaaaaggatttattaaatcctttggaaaaggaaatggacgagagatgtgaatcagacttgtctcgggtggcattggcgcggctcgagggacttgcgcagctcgggcgagcctaatgggccggcacggccgcgaggagggcggcctaatggggcgcaggagggggaggagaccgaccgggtggaccgcggtccaccatgcggggtcccgggacgggcccacctatcggcggctgggtccacggaggaatgggttcacgcgggggcggcactagggtttggtgaagatggcgcacgggtagtgtgtcggatggaccgagaggcggcgggcccacgcgcagccatagggctctccgtggaccgcgcgcaccggtcgagggagggggaggcggcaggctggtcgtgctgacccggtcgcggccgatgtggctccgatgtggcgcctacgtggcagccacgcgggccggcaggaggaggaaaaagggggcgccggcatccgacggcggacggcaacggcgttcgccggagcgattcgcgggggttcaagggagggggagtacaccagagtggcgggagggacaagagaaagcgagccataggctctgattcgccgggggatggccggaatcggcggattgcggcagcggcggccggcggcaagataagaggggaaatgcgacggggcaacgagagctcgattcaaagcggtgggagtatctatgggggtcggggaatccgtttccggcgccgggtggggcgaaggagcaccgaggagggctagcgacggcggcggcctccgggagcgggtggcaatggcggcgaggccatgccgggtggcggcggcggggcttggggcttcgtctacgcgtgttcgagagtctagctgacctaccacgcgagctggaggtggcgagagagagcgaggaagtggaacggaaggctaccgcatcaggacgggcgttgggagatggccgacggcgcgggcgggctctccggcctcggaccggggaaggggaagaaggagggtgcccggagtcctcttcggctcctcgcgcgcacgcaggcttcaccagcacgcgcgacggcgaaggatgtgaggtcggcagctgcgaggcggcaacaatggcgcagcggcggtgtaagagagatgccgagagagaatgagatggggaggctcggcttgggctttatagatggagaagaggcggtttgggagggggaaccgacatagggcggtcaagggtgcaaggaccgtgagctggcggtcacaggcgcaagtgaccaggcggcgatagggcatggcggtggtggtcaggggaaaaagcagaaaagggagggaaaaagggagctctgcgccttgccaatttgggcgagcagagggaggggggagagcgcgtgaaaaaggcgctctgtctcacggttttggaagcacgcggcgtggagtagcgggaccaggcggcagagcgggcacaggcggcgaccaggcgactggccacgcgcgagcgcgcgcgcgggggaaaccgacgggcggcggcgaaaatcgaatggcggcggcgggagggttcaaaccgcggcggcgggaatcggcaaagcggcggtggtcgaccggcgagagagagagagagaggaagagcgacgacactctctcgggcggcgcacatgcatagcacgtgtgaggaggagggaggagataggcagaggggagatgggccgagggggacaaaatcgacccacaaaacttgagggaggcgatttagactttcatagagagggctgatttggagagaattgaagtttggatttggatttaaattcgatattcgaactcgagggttcagggaggaatcaaggaagactcaaggtagtgtttgatatttttggggattgggagtgagtgtttggcgaggattcaaaggatgcgattgaacttcgaagttcgatttcggagacttgatttggaatagggattttgaggaggaggatcaaggagatttaaattgagatctacagcatgacttagactcgcacacaaaaaatgaaattttcgcatataggattttgccaaattagtttttaacgtcccacgagaagcggagcgttacacatgcttggagacccccccaaaagtatagaatcaaagcggaccgaaactcgagaagtgcataggatagtttatttattgcaatcgagttttttaggaaaaaccgtactattaagaggggttccaggtgatgctctgagatatgttaagtgctcttagtgtgacccaagtgtcaagtttccctaggagttatttttgcaaatactccatctgtccaaaaatgcaagtccggaacttcctgtctttcaggtccgaaagttccggtcttgtgaaaaagattttcctaagtgtagtccggaagttcctatcttccaggtctggaacttcctgtctagtttccagttcaaaattgtcagtaacggctagatgacgtcacctagccgttatacataaccagctcgtttccagctcgttctttggctattccacttttacttttcgaacctagagctgttgctagcctctcccaagtgtttcttgccttctccactcaatctagagcctaattcttgtgagaaagagagattgagagggagagaggaagatttggagatgtgtaaagactaggatcttgggtgagcacttggaatatctcgtgggctgtcatctcggtgcttattactcttggagatgatctcctagacggttaggtgtcatccacgagaatccgttgcatattgtggatgtcccgggtaagtttgtgaaggatctcctctccttcaaaagggaacgaggtaaattaatgaagttcttgtgctgagattttagaggctttccaagtagagcaacctacacttgtggcggatttctagaagtaggttgaattggatcttggtggtcacttaattctagaaatttgcttaggagtgtttggggttaaaggctgtggatttcctctggggtttttgcacaagtgaggcaaggggttaatcgagacccagctctttggagctcctcaacggagagtaggatcacaagatccgaacttcaggaaaaaatcgctcttgtctctttatgtgatgtttctgtgatctgtcctctgcttagaatacctgtgcatcatcttgtgaagattggcttagtctcctgtttcgaaatctgaattttattcttgttctgttacccggaagttcctacactagaacaccggaagtcccgggcctggcagactggaagttccggtgttccataccaggaagttccgggtctgtttgaattttaccgctgcgatttgtttttaagttttcagggacagcctattcaccccccccttttgggcttcatcagcatgttcacacttcaacctctttgactctattattttcttccttcttgcctctcccaagcttaggacaatctgaacgaagatgatcaagtgcaccacactcaaagcaacgattatgacctcctcttttcctattcctgacattattcaaagctcgagaaaacctgttagcagccaaaaccaagtcatcctcctcgaactgttcgagttgctcatcggacatggcattaatcaaagcaaaagcagtagaattcgatgatgaagaacatccaaagaagtcgaggaagaaaccaaagcactagacttaagatcaactttacgagaaagaatattcatcttatgtgtttttagttttgtgtaaagcgaatccaaagtcaaagtagacatgtcaacagactcctgaatagatgtaactttcatctcccaaatagacatgtcaagactattcaaaaagtgacgagaaatctcaaattgtgtataattaacatcataagaagaatcaacagatctaagatcactcaaaattttgttaaacctagaaagatagtcatccaaagcttctctaggtttcatctcaaattttatgtactccttttttgaaaagatctcgacgaagttctttaatattatttgttccttgatgaaaattattcaaagcaacccaaatctcattggcagtttgaagataagaaacacgatcataatccgaacgagaaatcccactcaaaagaatattgcgagctttgcaattttcttcaaactcatattttaaagcagcagtattaatttcttcggggatcacataaggatgagaaacttttctccaaatatcacaatcctcagccataatgtaagactgcatcctactgcaccaatgagaaaattccgttccatcaaaaacatgaggcttagttgaaaacctattagcagccatggcaaaaactttagatcggttaaaatccaaagaagaaaacatggctctgataccacttgtaggatcgaaacacaagaactaagccaaccagagggggggtgaatggttggtatgcccaaaaaccaaaacttttagcggaaataaaagttaccctcaaattcgacggatcgcggtctgaccgaagtgtaagagccggtctgaccgcctgatgaacgtcggtctgaccgatgtagatcgatcggtcgaaccgttgagatgcctgctgtcgcttgcctgctgccgccggtctgactgccgtgtacccgccggtctgatcgtcgcttgccgccggtctgaccgccggtatcctgccggtcggaccgccgaacccgataaaacacaaatcgaagaactctcgaagtaaatgacaactttattgcttctctctgtgtttacaaagtgcaacaacagcaatctttacaaaaatctcgactaaactcgaaaccctaactaaactagcaactcaattgctctctcaagcgatacacaaagagataccaggaagcctcacgctccccctctatttatacatgaggtaggcagcctaaagccacgaaccaaactcatactagaaatcctaatcccaataggaaacctcctagtacaagaaacaaactctacataaccaatcataccaaattcgactccgcatcccatacgcacacaatacctccatcgtatgccatatggaatcttcaccaaccatgtgcatcaactctagcctaagtatcccgtatgatatctgaccaccacggacatcgtcttaccaccaagccgactcccgatccatcaccgcaaatactatcccgaggcatcgagtcacctacacatgaatcaaacaaagaaaccatattccgagaccaagctatcaccaacttgactcattgttagcaaacaatagtaatacatatgtatagtatccatctagaagtcataaacatgaaacaaactcagatatccaaagaaacaacccgaaaccgaaaccgacacaacgttggccgtcgcatagcaccggtctgatcagccacactagcccggtctgaccggaccccgtaaaatccaatcatctcaaaatccacttcgtagattaactccaaatatcaaaaccaataatcactgatgtcaattgttcatcacaaaaataggaatcaaaacacactttgatcttactggggaaatcgccaccaccgccgctgccgatctgagctcaactcctcgccaccctcgaagctcctcaaaacttctagaagatccttcgtagtccctccaagctatttctgttgtcccttcaagttcgattcccccacaatcgatctaaagatcgggtcgtcgtagccattgctgcttctcaactatctcaggctcctccaggaaagtccaatccgtggtaatcctcctttaatcctctccttctgcgcctgacctatttcttccggtcattgttgttttcagtcatgtagtgttgccgacacaccagattccctacgtctcctccgctcagcctgctgctgaccttccgtttagttaaaccaaatgttatgtagtagttacattttttagaggacacctggttgagattcaggcatccgaagctcgagggctacattgtgctggtttccaagaggactgaactctaaagatcaagaaattcatgtatggactgcacctaaatttatgagttatgatgcaaaatagttgtatctgttgtttttcattattacatataaaatttagctcaaattggaatgaacaatcaattctgtgacagattattttgttgcccaatttaaattggactaccaatgaaagttctgcaaatgcaagatgcaaaatatagaacatccaatggtgtgttaggaggaccatttccatgtatttacttctatctgcacattgactctagctgtgtgtgctgctactatccatgtatttacttctatctcttgaattattgtttccttaaatccatctaggttagaccagacatcagtgcatgagaataagtgttaagaaccagttcgatttgggtgagtgcatagccttaacatcatgtccatgtcctgtcgaatatattttttgtgagtcaaaacgtgagggaaaggccgctatattagacaaacaaataagaggtgagctaacaaccaatgtgtcataaatttgttagcctttgttatatatttcgtagtgttatttttctttctgtaccatgaagtccttccgccacgaatgccccctatatcagactgagtacccaatccctgctcaattcatagagagccgtaaaggttaagaaattaagcatcccactctgattctccctttttttcccctgtggttttgctctgcctgaccctgattgcttgatctgtttcctgcagttgacgctaagaaggaaaaatcagatcgtgaagaaggaaaagtcagaagagccataaactctctgatagactgaggggcctgtgctattgcgtcccatgtatccaagaagagaggccaaagtcctagaacccaagtgagatgaatacacaaatgcacaacacaatattgtaatagtgagatgaatacacaagtgcacagcacatattgtaatagcttacgagtagtcgcatgagcagaagaatccaggacgatgggcacggcttgcttttaagtgccccgttcgaatctaatgaaagatgaagattaattgcacacgcaaaagacaagtccttaacatgattagttgagttttaattattaaaaacttgtaaaattaacttatttgatttttatagcaacttctatgtagaaagttttcgtatggaacaaaccgtttagcagtttaaaaagcgagaaacgcttggaggttttccggctagctccacaaggtgatagactagacgacctggattcgaaacctcaccccttctaattatttgatattaggtccttccctaatattcgcgtcttttttagacgtttaaaaagcgtgctaatggaaaccaaaaaaaaaatatctcgcagatggcaccaggatgataaagaatgctttctggttgaacatgggagtcaaacatagagcatgcagcagacacaacattaccacctccgtccaaaaaaatattaaatatttaagggattttagcaacccagatggaggcaaaaaacaatactccctccggcttaaaatataagagattttgaccggatgagacatatcctagtaatggatctcttatattatattttgggacaaagggagtaataataagatgaccacaaatggtaggactattgaagataacaagtgtaccattgcaatagattgataccatacatacatagtacaaaaaggattacagggggagatctacgttcatgacaaagccctcaaaactatgagaacatacatgagtcaccacataaatgatgacctaagataactcagaatgacctaaattaagataactcagaatgtgacattgcgggaaacagtatcaccatgctatgcaaagcgcataacacagggagttaaatttatatcatcatactaagcgaagcaaataacacagggagagttaaatttcatgacagtactcaaagaacaatttgtctcttacataccaaagtgccaaaattattcagacgataatgatgggtaagataatacaccaaagtaagttattattcagaacaataccttaatgttaccatcggtgccataagacatgtggcattttgagttgtgcttgatcattcggagttccactttcccgttgctgccataagggttattgcaactgtcattgcaagaggcattgccagtcccattgccgtcatggacaacacattgcaccacatctgtaccggtcaacacagtaaaaaaaagctcacctaaatcagaaccaaataagcccgccgtgggtgtccaactgtggtagaaccttgcgacacagaatctgccagaccccaggttgacaagatgaggatgctgcatctctgtccactcttggggtgcctccagctccttccaagatcctactagctgtggctgagagtccatggtggagagaatggtggagaggtcagcggcaccaaattgcttccagtcattggcacaaatgccaaaccacagcttcagctccggtacatactcaaccttgccgatgaagggtagtgtccactccccaatttggatccaagtgtgtttcaccgtgtccaagcagtaggtgccagcaccatccaccgatatgcagatgtgggagccgccgtcgaccactgcgtatgaagtgatcttgtgggggctggcatgcttgtacttggggtcacagacgaatggcggtggcgggaggcgctggcactgccaggacttggtgaaggaggtcaaggtggacctacggtagacaaaagcctcaaactgactgctcagctgtatgttgtctcttggtatgtgattaagacaagtatccatgatgtagacgctgccacctccattactattgtcgtcgtggtcgtccttgtcatcggcactggggatgaagatggagtagggcaaacacttgggcttgtggagagagggcaaggtatccactttgcacgtatcggcatcgaagaggcaggcgcggccagattggtctgtgcagagcaccttgcgacctgcaagcggaatacagttgatataccaactcaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaaagagggttaagatcaagcggatctgcagggtactgacctgaggcgagctggagaatggagggggcagggtggagctcagctcccaagccctagcaccggagcagaacggcggcggcgtcgcgggattgagggacagatggtttctaggtctggacggaccggctgtgttcgtttcgacgttttcccagcgcgctacagtaacacggaaaacggaatagttaattaacacgtgattaattaaatattagctaatttttttaaaaaaatggattaatttaatttttttaagcaacttttgtatagaaactttttgtaaaaaagtacaccgtgtagtagtttaaaaagcgtgctcggggcaaaacactgtagcgcgctgggaaagtgctgtgccgaacacagccgatatttcagaggagctctcgcgaaaggggctctgtttactgaggatcaatgggccgcttttcacaaaccttgacaaaaagggtcacaatgggccgctatttgggctgtctctgtaaaggggctgtatatgtataaacaatcgtaaaaagttcattttgactccctcaacgatcgcctgagtataatatcatgtcctccaaccacaaaaccgggtatatcgacccctccaactatcaaaaccgatggaaactatgtctctgggtggtttaggaagcgattttggctcacgtggcgcctacgtggcgttgttgacttggtctctatcccacgtgacatcgacatggcgcttttgtggcattataataaaacaaaaggcaaaaaagtacgtgggacccatctgtcattcacagaaaatattgtgggggtcattggcatgtgggtcatacatgtcctcatcttcctcctctcatcccttctctctccttaccatcgcgtgtcaccccgcaccgggatgacgctcctcattgtcaccttcgaatggccacgacggggtcgacatcgtcggcgccgagctgtctcctctgttggcggagtcacccaacgacagcttgaggacaagagagaaggaaacggtgaggccggagccaagtacgaaggcgaggaaaaagtggcagggagaggcagttgggcccgcaggaaacatggagggaggggagtgtcggtgcggcggtggcgagcgaaggatggaggtcagtggggttgccaatggtgagggacggaggtcctgttgtatcgtctacttgaaatctcctgcacatcctctatcgccgctcaggccctcgctcaccctccacggtataaaagggacccctggggaggggtgaaaggcatccaattcaatcgccaacacacccaccatatattacgaagccgaagtacgtggagccaactcgtcgggagatctcgtcaaatccctcgactacgatctcaccggtatcatctgattcgactactctctttgtaacctattctcatcatcataaatcccatataacctggactagggctattacctgataagggggcctgaactagtataatccttatcttttgtttgcttgatgtcgtactacgtagaccctcgttccaacataccccaatactcaactcatccggtccacaagtatcgcttgtcgacagtggcacgccaggtaggaggacttggtgctcaaggatctaccagtatgacttcaagacttcctgacagcagtatcaacaccggcgtcgatcaaggagcctctacctcgacatcgttggtgtggactcaagtcagatccattttctttccggtctacaccatcacgccgatctcgactggcccaataattatcgggaacgagaaaggcacggttacgactccgagaaacgacgcaccgccgataattcctcccactcaagtggagaatggaacatcgacggccccaatacccaggaggaatctcaagcggccgaattttgtcctctaaacaaaaaatcagagccgacaagaacgaccaccctaaaaccgagatcttggtgtcctgtgcataggacatccaagcacactctcgaggactgcccggtgatactccacgtgaaagctgaactctatgcctgctgggaatgtgggattcagcgtgcttcaccgacaagagccacctactgtccaattcaaaaatctagatctcacgatctcacaagctgcaggattttatgctcataatttgatgcagagtgagatgctgagcgtttgttcgtgtgcttgctcgtcacaatcccttttgtcccttttgttttagttctagcacacttcagttacaacattttgtcctgaatcagagtgggtggaggacaaaatgaaagacaaacttgttgatggcgccggcgtcgatgttgtaatgcttcttgtcgtcaccgagcatgcacacgcgcatccatggcgtgaaggtgttcacaatcaacgacgtacggatggtggagtcggagaggtcctggaacgcgtcggcgaagctacggaagtgttgacgaaaaaatcgaacacaccggtctaggagatctgcttagctcctgtgcaggtccaaaacttaatgagatgcgggtgtgccagtcagtttgaccttgcaactgacaagatatgtaaacagtagatcaaacaactgatcggctaaacagccgatggagcaatcccagccgatagccgataatagccgatgtaccaaccgatagcgatagggtttaagcaatcggctatatgtctaatgtagataatgatataaaggcaatcggctgtcaataatataatatacaataacgtaatccaatagaaaacaatcggctagcaatgatatgatagaataagcactgatcagaagtttaaaatatacatcggctggaggtccgatgccataaaatccacagattagattaaacagtgaaacctttgttgtcatcggctaaatccaactaatatgtatatgtaatccttctaagccgatgcaacgtgcagataacttatcggctaacactccgataaaacattagcatgaacctatcagcttagcaagacttatattatcaacaacaatctagtaggtcgaacctaaccgatgcagcacgagattgtatatgataatctaatactcgataagccgatagatctgtctaatgtgatggatataacaaatctatttagaacagcattgcgattgtagagatatatcggctaagatagaagatcagacctaaccgagacagttccaactaaaccgatgcgtctctaaacacaatgcaattagagatagaattgagatatcaggtaggcaaatcaatcaaccaaaccagagtgatccaagagatcgaagcgatgtagccttgagcgacgccgacgtagatgacagattcaccagggtccgacggaacgtaggacttaccccttcgccggagatcgaaagccgatgcagccccgcgtcaggtgcccaaattccgccggaagataagtaaaacctcggtaaatagggtagcgatgcgccgagagtagttgtattgatcgagagattgattgcatagaccctgggtgtacatatttatacccatgggttgatacaagtccttgtcggacaagaaagaaactttcctaaagataaaaggaaaacataaagtacttatcggacactaaacacactttcctaaagataaaaggaaactaacaaactattcctaattaatagataaactgccacgccgcatccttcttgaaatcggactcttctagataagcttccttcaattgattcgactccactaagaacatgatagcatggcgacttgacaactcccatcggctgcttctagaactcggaagccgatagtgactttcagctgatgatgactttggacttaccaaatttcatcgttaacaggaagaaggcgtcgtagcagtcgagcggcgccttgccgtggataacggggagctcgtcgacggcgaagaagtggcagtcacggccgctggagcagtcggtgaagaggatgtcggggtcgccagagtggagcgtgacgcggaggctgagcccctcgtcgcgggccatgtcgacgacggctctataccccgcccaattgaacctatccagcgactccagctgcgctcaagtcgtccctcctgccgccgccgttgcagccgccgcgatgcgtctgcctgaacccgacccttgtcggcacaatcccggca

SEQ ID NO: 8295 - DNA, 5880 bp, Oryza sativa
gtcaccttcgaatggccacgacggggtcgacatcgtcggcgccgagctgtctcctctgttggcggagtcacccaacgacagcttgaggacaagagagaaggaaacggtgaggccggagccaagtacgaaggcgaggaaaaagtggcagggagaggcagttggacccgcaagagacgtggagggaggggagtgtcggtgcggcggtggcgagcgaaggatggaggtcagtggggttgccagtggtgagggacggaggtcctgttgtatcgtctacttgaaatctcctgcacatcctctatcgccgcttaggccctcgctcaccctccacggtataaaagggacccctggggaggggtgaaaggcatccaattcaatcgccaacacacccaccatatattacgaagccggagtacgtggagccaactcgtcgggagatctcgtcaaatccctcgactacgatctcaccggtatcatctgattcgactactctctttgtaatctattctcatcatcataaatcccatataacctggactagggctattacctgataaggggcctgaactagtataatccttatcttttgtttgcttgatgtcggactacgcccttcaaccgaaaaactagatgcaatgggtccttcaactgtcaaaaccagtgcagatgaggtctctcggcagttttgacgtcggttttcgctgacgtggcgcatatgtcgctattttgactcgtcttcgcatcatgtgccattaatgtggcgcttacgtggcaattcatccagaaaaataataaacttcatgggacccacatgttagtttacacataaattaataaaaaaatggtggggcccacgtgggcccacatgtcatctaaaaaaataaagatggtacgacccacgtagaccccacatgtcattctcatcctcctcttcttcctcctctctctccccaactccctgtattcatttttctcccttctcctctgtcctctccaccgagcgaggagggaggcggcgcgcggcggccgggcgaggcggggcagagtggagcggcggcggtaggccgcgtgcggcggaggtggccggaggaggaggtcgccggccacatgtgagcagacacagaatgaggagtgaatgagagaacagcgggacttggggaatcgggtcgacgggagatgccgatggagggcatcggcgccggcgcagcaagacggacgacgagaggcggcgtagggagctcgtccctcgcatcccggtgagggcgccgggccagcggaggtggagacgagctcggtacccctcggctgcgtcgtggcgggcggcggagtcgaggaggtggtcggcggcgagcgcaggtcgacggtcggccggtggagggtgcggaggagtcgagggcgccatggccggcggcagaaccacgagacgatggcggaggttggctagcggcttgctccaggtgccgtcggggctcggcgagcaagaccgtcggcgtgaagacgatgaacgggagctcgtgcccccggccaccacgcgtcgcctgcaaactcaccatgcctcctcctctcggaaatttcggatccgtgctatggccggggacggcgagcgcggtgcggtgatgccgtacttcgtgcccgtatcaagactcctcgcgccgcagtgcccccagcggaagaagctcgcggtggcgagaagggcggatcgtgatgtattctctgcgatagacctgtagagttggggagagaggaggaagaagagctggcatgtgggcccatcattttttattgagctggcatgtgggcccatcattttttatttatttatgtgaaactgagttggggagagagaggaggaagatgtgggcccatcattttttatttatttatgtcccgcttctcccaggccgggcacgcttacatctggcagctttcacacccaggaagaatttcccggtcggccacccatcctaaattgctccaggccaagcacgcttaacctggagttctttagaaatcggcttccggaaaagaagttgcaacttgttgatatgagtattctattaatcctattaagccctgggccgggatgtcacaatgctcacccccttaagacaccgacgtcctcgtcggtcaaccccaggccaggaacgtcccctcttagccacgtccgtgtgtcagtgccagtgcatgtgccatgctgtgtgaccactccgggtccacaccagccatgcgcacgtcggtcaaccccaggccaggaacgtcccctcttggccacgtccgtgtgtccagtgccagcgcatgtgccatgctttgtgaccactccgggtccacaccagccatgcgcaccatgcctgcgcaactgcgacaggagtgggtccacaccagccatgcgcacgtcggtcaaccccaggccaggaacgcacgtccgtgtgtccagtgccagcgcatgtgccatgctgtgtgaccactccaggtccacaccagacatgtgcaccatgcctgcgcaactgcgacacacgcgcctgtgaaaccgcgagagtcggctctgataccactttgtaacgtcccgcctctcccaggccgggcacgcttacatctggcagctttcacaggtcatagactgccctcacagaccaacacaagtcttttctgcacactttgtcactcttgcgcacccaggaataatttcccggtctgccacccatcccaaattgttccagaccaagcacgcttaacctggaattctttggaaatcggcttccggaaaagaagttgcaacttgttgatatgagtattctattaatcctattaagctctgggccgggatgtcacatgtgtgtcccatgaagtttattattttgaattgcaacgtaagcgccacgtcatgtgaagaccaagtcaaaatagccacccaggcaccacgtcagcgaaaactgccatcaaaacctccgaaggacctcatcggcattggttttgacagttgagggacgcgttgtatctggttttctggttgaaggacaaatatcggattcgttgacaagttaagggacctcgaatgaacttattccactcctcattgattcctcagcccagtagttgtaatggttgagcccaattgatattattttactgggtttagaggcccaaccatccataagtctacctctcgacggcttccgattaattgttcatttatgttccatcaattctcctctatttatgtgtgcttctcctgcatatatgttagtagcataggacatagtggaagtatatattttatttgaaaattatgcattgcaagcatagctagtcttcattaaatggacaatattaacggtcgaaattggtatgaccgtgccatcggcggatggccttgaagaagaagaccaccttgctagcgtagatggccgcggtgacgcacatgagcgcgacagaaagcgcaccagagcacctggttcaccttggtagtgatgtgaaggaatctcatcggcgttgacgtcgccactgtcttccacaggatctcctggctgctcatgccgaggcagataccgaacgccgacaccgggaacagagcaggaatggccacgttttgtccgacagaagcaccagctcctccgatgactgatgcgacacaacacacaccatgagctctctccagtgttccagcaaatcaaagcacatagatcgatgtgtagttccggaagaattagctcaagaaacttacccggagtttgtccagtttagggccctccagtgcggcgaagaagcgatcaacctgaggcatggacttgatgtggtggctgcggatggcatcgccgtcgcaaccgtcctcctcctcctcagggacctccgtccccggcgctagccagatgggtgagttgccgctcaagcttcccggaccacgtcttgaacgagtcgtagcgcctatcccgagacagagatgaattcatgtgctttgaaacttgaataaagcttataccttagtccagcagcagcactcctctcatcctctggctcaactccaagccaatttcatggtttaattttgggttcccgtcggctctaattgcctaatagcatggatttttttttaaaaaaaatgtaatacagataattgttcattctattgtgctaattttatactgctccacaaaataaaattcagaagtaaaattgtacatgaccaccaaaaacactatggatatcatcaatcagtaactcccctaatctcaccatttttctcatgatttttttttctatctgactgtcttacacgtctccgtttactgttctctgctcctcggcctaacttgcatgtttatgcgttgccggtgcgccggttgcctgcttaattaggccggttgattggtaattagttcatgcatttggggtttggatgccggtcactgtgatggttgtttccggttgggtggcgcgttgaatggcgcgtggcatgctgccatttcttgttttggtccacttgtatgttatttcagatcggtctatctgttctgcactctgtgcctttgtgattttctgtttaggcccttaacttttttgtaaattgaatgtgaagaaggcaaattactttactagccaaatgatttagaggaagactggtgcttggtcaagttcaagaatcaaaacaaggttacagtaatacttcaggacatgagaatccattgcaaaaaaaaccttaccaaattttggtaatgccaaattttggcaattatgccaaaattttgataagatttcttatatagttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcatcgacggggccggccgtcgccgtcgccgccgcggtggttctggacttctggtggtcttgacgtggctgtggacggcgctggtgcagctggtgtggagcccgtcgccgtggcgagggcgttcggccggcaggggatccgcgggccggcgtaccggctcttcgtcggcagcgacgccgaggcgaacgcgatgcgcgcggcgacgtgctcgacctgcgctgccacgacatcgtcccgcgcgtgctgccgcactaccgcgcgtggatgtggcgctacggcaaggtgttcgtctcgtggagcggcgccacgcccgcgctctgcgtcggcgactaagccatggtgaagcagatcctgtccgaccggacggggctgtacggcaaaccggagcccgggccgagctttctggcgctgatcggcaacggcctcgccttcgtcaacggcgacgactgggtgcggcaccgccgcgtcgtgcacccggcgttcgccatggacaagctcaagatgatggccaagacgatggcggagtgcgcgcgggaggtgattcgggcgtgggaggcgcgtgccgccgccggcgagcggcgggtgcaggtggaggtcgggcagaagttccaggagctgaccgccgacgtgatctcgcatacggcgttcggcagcacactagtggagaaagtgtttttcctcccggttggtaacccccctatactcccggttttgcaaccgggagtagcaatctgggactaaagatactcatctttagtcccgggtgaaataaccgggactaaaaatctatctttactcccggttggtgataacaaccgggattaaagatagtgatgccagcgctagtaccggccactgttttttttattattttctcccaaatcgagttggaactgcacaaatcttttccaaatcaaccaaatcaagttgctccctgtatccccaaat

SEQ ID NO: 8296 - DNA, 1347 bp, Oryza sativa
caaccgggactaaagataattggggccctgactcgtccggacaattttttgaaccgggactaaaaatgatctttagtcctggttggtgttaccaaccgggactacagatcaaaaagtttttaaccgggactaaaaatgatctttagtcccggtttaaataggaaccgggactattgtggattttagacgaccgaccaaagatggtttctctagtagtgtgcgcagctacagggaagggaagtaggtgttcgtcgcgcagcgcgagctccagtccatcgccttctccaccatatacagcatccgcttcccgggcagcgagtgcatcgcgacgaagacgaacctgcgccggcgacatctcgccaagaaggtgagaggcacgctcagcgatcatacgcgagcgcgccagaccgccgccaccgccaaggaggacagcggatatggcaacgacctcctcggccgaatgctgaaggccaacgcggcggtcggcggcggcggcggcgagaagagcctactagaaaaaatatttttgcaggcgaccaaaagtagtttttccaggcggggggaaggaccgcctctataccaacaactgtgacggcacaatcgtccgcctgcgaaaatgcactggatgaacaaaaaaaattggcgccccgccggccctgcgcctcgcctggccgccgccgccgccgccctccccttgtcggagtgtaacatcctgaaaattcccgacaataaaaaacactaaaattttgaactttttaaaacttttgcatcatgctggttgttatggttactattgcttgccaaactataaactgtcacaatggaaaattaaactaaagctatacaactaagtaataattataataataatatatttatcatgaaccctataaatatttacgcacaagaaatcaaagtcagacaaaagaagtaatttaatttatggattaaatattaaatacttgaaccatgcgatgagtgtcatgatatctgtatacacatgaaatgatatccattcaaataagtcgagctctatctataaaatagttttactgggaataatcaattcgatattacataatttgtattgaatcacaaatattgaattgtagaaatccatgttgtggtaaaaccaatctaaaaagataaaccaatatgtgtgaaaacagataaataccaaaatcccaaaatataggaaattataaaaatctaggataatattaaatattggacaatattaaatttggagaaaattcacatttgaacacttaatattgtcactcaaatacttttgattaaatacacatttaattggcaaaatttcctcaaattataaattaagcaaaa

SEQ ID NO: 8297 - DNA, 3641 bp, Oryza sativa
tcaaacaggaaaatcacttgtcaacccacttaaatcacatatactgtacaatccatttaaaatcatacataagaacaataatctaccttttgcatatattaaaccaaggagtctatgacaaacatttgtagtggataaatactaattatagtggataaatactaattatagatcttgacctaatataatctaagttcaattgtaaattaggattattcattgtaaatctacgtgatgggataatctgtaaccataatatgattaacctaaacaactctaacatacaaagcatggataattgttaaccttttataatttattgtgataaataaaatatgttaacaattaaagtaaagcctccatcaataaaacaataatacaaatgattcactgtacttatttgattgatcctaaatccatctgacaacaaaacctctagtatatgaccattttatttagatagatgcatgtgtagccataatctttccaaagtcattagctagactaaaccacatattagccagaggtatatctcatttatacactattggttactcctaaatagaccacgatgacaacataaagattaagaaactttagtccttatcacgattggaatcccttagcaagcacgaatagtatgagcaaccctaggttcgaccccaacaagtacattttgttgtgcataattgattggtgtttgaatattggtttttcttgcatattatagaaattgtatatcggttaatcgtgagacaacgtatgcagcttctaggaggagaaggttgatcaagaattatatcaagaataaggactatcctgagcaagcaagtcatcactattccttgaacatgttgatccaattgcgaaattattttgtctataaataaaattgcatgcaatgatgaacatcctacatgtgattatgccatgccttgattattgtttaccccttattccttcgtaaccatgtttacgtatgaagtccctagtcaattatgataaatgcttagaaatgctattctagaatcatgcatacttatatttatcaaatgctatatgcttaggtaattacctttgggaaggtaattgagatgcggcatataaagacatgagcgccacattgccatgatattgatgacatgatttgtaaaagatgaaataaaactaaacaactgttttcaactgggcggacggaggatttgggtggtatctggaaaaggctactaccgtccccgtcaattaaggatcaagccatgaagttaagcatgaaacgacccccgtataaccgtacctcttgaatgggtataggcctagcggattagatagccgagcggaggcagtatccctgcatagatggttcacccctaagtgaggcagatgcgctacggtggggcagccgttgaggtagggccgcgaggtgtgccctacatcggtgtcgccattggtaggactgccatgagagtgtgagagagaacttaacgtgtgtgtgagacttcttccccgggagcgccagaactcctctcactgctagaaatatagacgcctagagtgcatgaggatgtaagttcatggagcgggtactgccaatgcgaggttatcgaaaagttttgccgtgacgcgtctcatgtgttgggacgagactcatgtgttgggcagtcgcggagtgcgggtaaagtgtacatccaatgcagtgtgagtaaaacaaatctattcgaatagccgtgctcgtggttattgagcaccaggacgtgtattacacttggctagactctaaattcttaacttgtgtgggatggttttgtgtgggtttatgtatgtcttggtttatatgagttaatttccgttaaataccaacaatataggaaaatgggttatttaaaaaaaattgttcgactaggaaccttaatttaatttcctctagttcccagctgtcacccgtgcaacgcaacacgcatataatatcaggtcccctagttgctacgttatgcaaacattgtcatatcattttagtaacagataagatcgtacgtatatatatatataaattcaatctgacttgatcgaaatacgaagaactaataaaatctagtgatatgtctccagcgaaaaaaacaattgtaaaacgccatcatacattctttccccatgtaaaagaaaatgaaccggtgaaacgttgggtctgtttggtacagctccaactcagtcaaacagtttcagctccatcaaaattggaagtgaagctgagtggagctttctcaccaaataaactagagttatagagctgggtttaggtaactttacaactccacttcagacctaactcctatagctaaatttaggagttggagctataccaaccaagcccgtcatcgtgttcagctcgaaaccgaaaatttcgacgaaatttctccactgctgtaacagctatagctcaatgtcagtgtgtgtgtatatatataatcactgcattttcacgcacacaccaactaatttatcactcaaaggtgtgcgagaattaatctgccgttgcattgcatggggatctgccgtcccataaaggatgcacataaatgaatctcatcatgtactacctccgttccaaattagtagtttcttgtaatgtttaaccactcgtcttattttaaaaattagtgcatatataaaaatgtagaagtcatactttaaagtactttaaattacaaacaaaataaataataattctataaatttttgaataagacgaaagataaaaagttacaaacaaaaactaaaagcgacaagtattctgggacagagatagtactaattaagggacctaattaaattccaaactgttatgttatattatgctactatgtagttaattcaaaatttaatttgatcatgtaaattaaggtatcatatatatagagaaatttcacaaaactcaataaaatataccaaaactttacactgatatctcgtgataccagtatctgaatgtatataccaaattttacgctagaaaatatataataccgtcttaagaattacctcttacatcccgttacctcttctctagctactaactcgatctctactttgattaacttatttgtgggtgattaacttatgctagaggtacgtgcatgggttgtgttaatttgtgtatgcagccgaagaccttatcaagaacgcacaggtgcaggccatcatcgtcaccacggaagcgcatacggtcgtggttgcccgccttcgccgccgccaccgagtccccatcctcgccttccccatctccggcggctctcctccgccgtcacatcatccaccccaccatgcaacggcgacggcgccgccgttcggagccgatcacacttcagccaaggcggcgctcaccggcatcctcaccgccatattcttatcagcacggcgcgcaggcggctcgccgccccatggccgccgatacaacgccggcgctccgagtggttgtcgtctccaccgccggcgattggcggggaaaaggtcatcatcgtcatcgtcatcaggagaggttctgaggatccccgtgccgcgaaagaccgggttccaggctttcgtcgacgtgagaataacccggaccccaagagacagaacatcaccggatactgcatcgacgtctt

SEQ ID NO: 8298 - DNA, 2567 bp, Oryza sativa
ctttgacggatcgtatgatatgatgatcttgtacgcaatgtatcttcaggggtaagccttgattactcccacaaacttgtttatttttagttgaattttttagtccttaagaaattaactcgagatacctaaattttacacgaggggcctcatcttttcacttgtgcttatatttatcagctaaaatttgaaatttcaacattaaatttagaactgattttggtgtttcttcattgaagtttatttttcagcctttgtttttagatcattaaaaacacatataaaaaagttttattcacaaattatttttcgtttataaatatgccggggctgtaaattttttggtactacatgtaaaaaatatgatagctctccagggtaccttattaaaaattatattatctatactccctccattttaagttatttgttcattctagttttgtagtcctaagtcaaactttggtctttgactatcaatatttctaaaaatctaaaaactaatatagttaacacaataaggtttatgtttccagatttaacttgaataatattttcataatatataattcacatgtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaatggccgagcaagcaaaggcgcatgacctctctccgagtgtgagcggcgacgacggggagccaaacccgcgccatcgagctcgtactcccccacctcctccgcgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgatgtagtgatcggcgtgctccccgcgcaacggagggtgcctcttcgtccagggtgtcacctcgacatggacgtgagggccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccct

SEQ ID NO: 8299 - DNA, 10027 bp, Oryza sativa
agtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctctggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacatgaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcctgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgctgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaggctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccatcctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgagaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcaccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctccgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctctcttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccaagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgagggggggggtcgggtgtcaggtttcgggctcgggctaaccacgcacccccctcgggtgtgcagggttagccgggggctaccacacatgcacaaccttacttttcttatttcagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggccccgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgagttcggcagctgcgaggcgggcgactaagtcgctttcgcccgtagccgccccgccgctgcgcttcctcgcatccagctccttttctcgcgtctcgaggttagcagcctgctgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacgagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttacggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgtcctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctg

SEQ ID NO: 8300 - DNA, 10141 bp, Oryza sativa
ccaggcttcatcccaaccattacagccaagatgctacaaaaagaagggtgatcatccagatcgctgaactgacgcatagaggacaagaatgaccgatctgtgaccggtctgacactggtcgcgtcagcaacagacagccacgatcccacgttgcgcctgtctccgccgggagtgaaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctctgtcaacatgtgtggtaaattattacgattttccataaattagttgatgttcaaagataaacatatttggacttaagacaaaactaaaacaataattaatttaaaattgagatagtagtaaaaaatactttttatgtttcgaaaacatttgttttttcctaacaaggctgattatattaaatataagaaaactaaaacaaatcaaaggcataagcttcaccaatttaccacgaaaagagcactttatatttttcacttttatatgggagatatcagatttagcagtgttatatatcatttggaattgaggaattttaccgaaaattttatataaaataattagtaaagtccgtatgttccttgggaaatctaagtaagaagtatcgtataatatcgcagcctcaaaataagaccataaaaatgtaaaacaaatcagtttaaaactagagtttgtaaagttaaattataatgaattgaaattgtatattttttataaaacacaaacagaataactcattcaattgctacaaatacattggcatatttagatataaagatttctggaactagaaatagctagtttttttaaacaaattatatttgtgtcaattgtcaaaaagggcctaataatttaagccaagtccctttgaatgacgacatttctaagaaattgtgctgacatacatcttctgtcttatggtatcttcagaagttcagcgcagcagtgggcgacgtgaccatcacagccgaccgagaaaacctcgtggaattcacgatgccatacacgtcgtccggtgtgtcgctgctggtgccggaggagaacgactccaagccaatccaatggattttcgtgaagccactgaccagggatctctggcttgccaccatcggcttcttcttctacaccggcttcgtcgtgtggatgattgagcagccaagaaacccggagtaccaaggatcaagtgtgaggcagctcagcactgcttcctactttgctttctccaccctgacgttttctcatggtaatatagttactacttttactcctccagttcctaaatatttgacgccggtagtattcatgttttatttggatcgctgatcttgtcttaataaatacttgaaaacgagttatattatcggactgtgttgcatcgtaaatataaccatataacttttcattcattacaatatgatcatttaaaaataatttatggtcaaggtaagacagttgtatagtcaatagtgctagttattcatgaatggagagagtacagcttgttgtacattttttccaaacataaataaagcacatagttattataacgagatctttttttactttgaaaaaggtaacgagacgtatgacatttatagtgtaaattttggtctcctttaggtatatttttagtattttagtataaaagggtatggttatttcataccggaaattgtggtacctcaccaaagatcataaaattgctcctttgtaattgcatcattagaggtttacttggtttctttcaatgttcaaacaggtcaaattatcaagagccctttgtcaaaaattgttgtggtgatatggtgctttgtagtgctgatcctagtgcagagctacacggcaagcttgtcatccatgctaactgcaaagaggctccgaccatcggtgaaaagcttggatcagctcctccttaccggtgactatgttggatatcaaaatggatcatttgttggctcactcctgaaaaaacgagggttcatgccatccaggttaaggtcttatggaacacaaaaggagtatgctgaagctctgagaaaggggtccatgaatggaggagtgtcggcgatcgtcgacgagatcccttatttaacttcttttttatccaacccccaatatcagaaagaatttcagatggttaatcggttctacaagacccccggatttggatttgtaagcttctcaatcttgttcactttggtagattcagaattcttcaattttcttttctttttgcaattagtatatcgcgaaaagtttttgcgtgttctcggaaaacattcagatgtgtggtgcttacatgaagaaattcaacaagttattttttttgtctaattagtttgcatcatgtttttgtattcaggtatttcctctaggttctccactggtgcatgatctctctacagctatcttgaaccttacaggagagactgaaggttcaaaaattgaagagaagtggtttggctcatctgaacagtccacaggaggtgatgcaaaccctagcagcagcagcagcagcagtgactcaaaccctctcacactccaaagtttctctggcctcttcatcatcagtggctgcatctctgctctgatgctcctgataagcgttgtgaatagggtaatttgcgccaaatgcgcaaaggaagctcgtgttcatgatgtggagcatggaggcagtactagtagcagttccactgaacaatcaagaccacttcagattgttgttgacagcaaccctgaacctgatcaagctgtccaagaagttgcaaatgatgggtgtcaggatgcccaactgatgcaggcaagtgttggcaatgaaaggcatcatccagtgcagaattgcatcaatggcccggtacctgaacatcatcctcagatggagatgaacactggatgatatgtgtcagcgtggttatgtacagtacccctttgaaattgcaaaaaatcagatagcatttgggctttgttttgggacccgggaatttttcctgattttgcagggtctgaatagttgtatctgaatgtttttgcaatccaaattagggccttaatttggttggatatagttatgtaggagtagatattttagtgggtttattcaccatctagagttgttctgttttgacggttttattgcgtcgatgtaaatatgtaaaatattgtgtaaattaccagttactgagataaaaacatgaaccgatgatgaactttgtgacttgtcagatgagattccccaatgcagatacaggctgtgataagttgaagcaatgctaacttttcttgttgatcatttgacaccgtgtttagatccaaagtttttcttcgaacttccaacttttccatcacatcaaaacttttctacacacataaacttcaaacttttccgtcacattgttccaatttcaaccaaactttcaattttcgcgtgaactaaacacagcctgaatcagggaatcagtacgtgtgtccactcttttctgcttgcaagaaagtcaggttgcttcgcttggaagatatactgattgtagacctaaacattgacagctctaaatagcgaaatgtgcagaaccctgaattcttcgagggaaggaattttcaaacccaaaatcaaccttctgcgtaattatctatgacgcatcggatcacacaagctacgtagcaagagagaaatttctcagcagttaggatgtactccctcgttcatagaagttactaatgatttttgaaactaacttggttagcagttataactgactagactctttttttaacctaaacctatatgctttgaaaataaccaacatatattttgctagaaaccaatgtatttaacatgttattaaacttttgatgtttgtactgtcaacagtaactattagccggtgtaaccccatggatttagcaaccagtagtactaatcacctcacttttttcttctgggaattactgtacaccactcaactgaaaattttcagatgtgcacggtgcatccatggaggaattcaacaagtttttgtgtaattagtagggtaattttaccatccttgagaaagtacctagagttattatattttctagtgcaaaatttgatacctctaggtaccaaagtatctcaagataccaaaaattttactgtaaaatttagatacctcaagatactttctcatctcaaggaccgtaaaattgatcgaagctcatgttcatgatgtggagcatggaggcagtactagtagcactgccactgaagaatcaaggccacttcatattgtcattgacagcaaccctgcacctgatcaagctgtccaaaaagttggaaacgatgggtttcagggtggtgatgaaaggcctcatccaataatgcagaatggcatgcacaatggccctatgcctgaacatcatatcagatgcagatgaactcatgaacactggatgatatatacttatgtacagtacccctttgaaattgcaaaaacagagagcatttcggccttgtttgggatgcagctaggaactgatttttgcagggcctgaatagctgtatctgaattttttttgcagtccaaatagggcattaatttggtttggtatgtactagttatgtagatattttaattagtgaatgcatttattatctgaaattgctctgtaccggagcttttgttgcgccatctcatccttcactgcggcgacgtggacaacggtgcggctcgtcggggcgcggcgtgaggatggccgtggtcgtggtttcctcgccgacgccctggccgccgcttcctcgccgtctctggcgatgaaccctgctgccgccgcctcgtcctcctccttcgagtctctacccttcctctcttgtttttcccacgattcttctgacaaaagctggtttctttcgatgaggttatcggagccaaacgaggctacgcgaaccagctcaagtcatgggagccccaccccttcctctcttccacgtatgcactccgcctacgtggctctacattgccacacgcctcgtcttgcattgtaaatgatcttaggctgtgtttagatccaaagtttgaatccaaatttcagtctttttccatcacatcaacatgtcatacacacacaatttttcaatcacatcatcttcaattttaaccaaaatccaaacattggatccaactaaacacagccttagtgagacagagaactggaccgacagtgaactttgaaacttgtcagtgtcagatagattcaccaatgcagatacaagttgatatcaattcagatggttttactagggccctgtttagtaggggtgaaaacggtacggaatatttccggattccggactggttttcgaaaacggaatcagccggtcggaattttttcggaatttttcgaaaacggaatcgaaaataataatagcagttttcgacggtactcggaatcggtcggaaactttccgaaaactttctcggaatttccgacattacaaagtccataaaacctcctgtgtccaaccggccagcccaacacactagtactagcagtagtcactagcccagcccaacactgcaacacactagtaactagtgtactactccactgtctagccggccactaactagccgagagagtgagagacacagccgccgggtgaggatttgcagtggcggcagcgacaccacgcgccagatctggcgctgccggccgccgtcccctcacgccgtcgccgtctcgtgccaccgccgtcagctcgtctcgcgccgtcccggccatcgccccctacgcttcgtcctcgccagtcgccaccgccgtctcgcgccgtcctcgaccccgccgttgctcgccatccccgcccccaacgtctcgcgccgtcccggccaccgcgtctcgtgtagtcgctcgccgtccccgtccccgcccccgacgtcttgcgtcgtcccgggcaccaccgtctcgcgccgtcctcgtcaccgccgccgactcaagccccactggtggagtggtggtgactggtgaatggagaacctggagcgaaatttttgtgccttggtgtccctggtttgtgcttgttttactaacatatgtttatatagtggctgactttatacttctactattgctgaactatgtaattctcagcaatgttttgtgatgaactatgtactatggctgacttgctgttgttgcttgttgaagttatgcaactccatgcaatatttgttatgcaaatatgaagttacagactgcatagattgtgtttatgatggtactgctgagagaaacaattggatttgatatggttgtgttttgtgatgtattgttgaatgttgagacttgagatttggacttgacaaagtttgaccctcagtttgaggggtttgtgtattccgataaatttttgttaccgtatccgcgccggttcgttttcgctccgttttcggtttcgataatattcgtttccgtttttgtttccgggggtttccgattccgatttcaattccgaaaaaaatatgaaaacgaaacgataaaggtcgtttctgtccgtttccgtaccgttttcacctctactatttagttccaaaatatttcttcaaacttccaacttttctatcatatcaaaattttcctacgtacacaaacttctaacttttccatcacatcgttccaatttcaatcaaatttccaatttcggtgtgaactaaacacgccctagatgttaaagcagatgttatcgtcttttattgttgaacattatgtttacacccaaatttggcacctatggacgaaatagggaaaaattgacaaagtttggaaagtgacgggtttccttcataggaccggtcagaccacaggtgtgtgggcggtctgaccggctagtagggccgttctgaccgcagatatgtgggcagtcagaccgtcagggtccgagtccgagtctgttttcatcgggtctcgggtttccttgctcgggaaggcatgtttcgtatttcctttggtttctatcccgagttggacgtggagaagagcctgtagagggtaagaccaacccctatttaaaggataaggccggttcattgtaaaacccccgaatacaatctacttgaatcgttcttttactatgttttctattttaccctagttttagtccatctttatcggtttgcgccgtaaaccatccgccgccgctgcgagagtgtgacacctctttgtaggtttgtcctgaaaaccttccgttttgcccacaagacgggtagttatcctcatatcgatctaaatcggcctagaggctgattttgatctctaaatcggctccgctagccggtttagcttttctttttgcaaaacccatcttgatttggccctttggctagatcgaggtggttagagactctatatcaccgcaaggtgtttaggtgttgcaattgtgcttgtcgacttgtcaaaaaagttgccaacacattaaatccgggtaggcttgacaagtatgccctctgtttttcttacttccagaatcagaatgaagaaaaccagcttgtttaggttgcaagactgtagacctgaacttgcgaggctgattgtgacctgaacgttgacaacgttaaagagccctgaattcttcgagagaaggaattatcggcctaaaatgaagcttctgtgctagtatctatgctacattgaatcacacaacacaaggtagaaaagaaagagacatttctctgcagttaaaagttagaaagcgtagctactagtgacatcatacaagtaagactctcgtgcatatgcatatgcactcctccagacttgattcaagtcagtgtctcccagttcattggagtgcagctctgaagaagtcctggatttccattgcagataaccaggaagcaattttacgatggtttctagtatttctactagtaaaaagcctgttttgctatggttttcagctagatgatttgacatgttgcatgagaatggtataatgtttcttctggacagtactaaaataaacaagcgtttactagagtatgtcagtgtcacactgtcatatcagttcagaccaggagcgccttgccgataaaagggttgagtgagtcggtgctcgccgtgagatgtgtttgtttattttagtacgaaaggggcagtaattaaagtaatgaaccgaactgttttttttttacgcgttcccgaaaaattgttctttattgcgtgcgataagattaaccggaccgtgagagacctaagttatattcatggttgaatacttagcaatgtcaataggctactggttataataaatgtgtaatgtatccttaattagctagataacaaggcttgacaggtatactctctgttttctttttggtttgctcacaagaaaatcattttggtttgctcacaagacgttgacctctttcttttcttttttttttcgatgatgggaactgaattcagtctctacatggagatgtatcaggccataaattaagcgagtgtaggcctgagcattgacaacataagtaagaacgtccctgaattcttcgacggaaagaatttttcagccctaaatcaagctagcttcttctcgtaattatctaacgggttttaatttattaactcaatagcaaaatgcccatacttccctacgggtaaaagttactgttaaatactagaagacataatcaaacatgtataagagcataagaaattattttaaaacaacaaaaaccaattccatatttattaaaataaaaaacgcaaaaataatcctctccctctctttaggtcaaatgtggtccaaagtcctcccttcttcctcccaagtcctcccaagtcctcttctcctccccctccctctcccttctcttcagcccacatcactcccccgcccgggatagattgagcaaacaaataaagaaggatatgacaaaagtaagatatgacaaaagtaagggatagtaactggtgtgatttttaaaaactatttaattagaaatacgggggtgataaggtttggtctttcaaaatcttaagacaacaaggtatctatttaataatatttaagtaaaatcatactaaaaatatatgattttgtttgggtgctagccgcgcaattgcgcgggccacccagctagttatttatataactatacgttataattctatcacaatatattgagatacgtagctaaaaattttagggacaattgcttatttgatcatgttctagatcttaactactaatctgacttacttttttaattttgactatttcatacttatttttttaactttgactatttcaccctactttttaaaatcgaagctaccgtttgacctatatctccctactccctccgtcccaaaaaaaaagataacttctgagatgtacttggacacatgcttgtccaggtttatctacagaagttggttttttatgggacggagggtgtacaccgttaggatttcacttaaaaaataataataataaaatatttcatcagtttctaaatttttgacgccgttgactttttttaaatatgtttgaccgtttgtattattaaaaaatttaagtaattattaattcttttcgtatcatttggttcattgttaaatatacttatacgtatacatatagttttatatatttgacaaaaatttttgaataagacgaatggtcaaacatatactaaaaatgtcaactataccaaatatttggaaacagagggagtattttatagctcaaactggtcaaaatgcccctcaaccctatccccaaaattcctcattccgtggtc

SEQ ID NO: 8301 - DNA, 3050 bp, Oryza sativa
ttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgacactgaatgggaacggaaacggattgaagaaaaggatggagaagatttgtcttcccagcccaatcttcaacttgggagcaccaggcgaacggatacacatgttccctgctttggagcgcagggctttctctttggaccagtcggggcgtggcctccttctggaggcagacacatcccgtctggtggtgatgccaaatctccacaagcccaagttggaacccattgccctctacatccccggcgctgagatagatctggatgaccttgatggcggcggtggcggtactctttttatcatggatagaattgcgaaaccacaggaggctgactatttgttcgaggctttggtgtaccgcatgttctgttccagctacttatcaaagtcctgggactgccaactcctcccaccaccgccgccatacgtcgtcaaatgtggcgttgactttctaaagatcatctcatatggtttggttaaaggtggctctgagatctgcatatccatcgacggggttggtacttattgctttgacactgtgaaacacacttggattgaagtgggcaagtggatgctacccttccaaggcaagtttgagtatgtccacgagctcaagctctggtttggcttcactcccaacgatggccactttgctgttgctgacctctctgccatggacgagtacctgcaaccacagatacgccactgctggaacgaacttgatgagtcactcatccaaggatggaagcagatacgggaccctcagcttgtcaacctggggtctgccaagttctgcattgcaaggttctttcacactggtgactttggcgatggattgagtggccagaatgtttctgtcctgactggtgtagagtttacccatgccaatgttgaccatgagaatattggattgatcaagcacaaatcgagatgtcacaagtctagctgcggtgaggagaccatcacggcagttttctgattaatttaagggctgactccccatcctttgaataattttctgtctctctctttaagagaacttgtgtctcgtcctaattttactttagcataataaaaatgatacttcctccgtttcataatgtaagactttctagcattgtccacatttatatatatgctaatgaatctaagcacacatatatgtttagatttattgacatctatatgaatacaggtaatgctagaaagtcttacattatgaaacagaggttatgaaacagaggtagtaccttcgttgtccgcatgttgtaattgtctcctgcacttaagtaactgtaccatttactactactagtaactactataaacttactcttaatttatgtgttgtctactgcaatggtaaaattcgtttcaaatgctttcttggttttggttggagcggaaaccaagaaggaatggtaatcttgtgtgcttcctctgtcccaaaataagttaaccgtgcgggacttttccagaggaagagaggatgatacgtgatgcggtgtatattccttttctgaaaaaagtctaagttatactacggttaatttcaactttttcatattctatcttgatcttaaaaaatatatttggaaattatcgtgacctcagttttcatcttctttcatagactttgattttctaaagaaaattggtttcttaattctaaagatgccagtacgtcactgttcattttgtagttaactctggtacatgtttatgtgaaattttgattattcagcagttgaaaggaatggaggattgctttgtgatttataatcacctgtgctgctacttgtgctgcagtcaatagtctgatgggaaaaatggaattgaaccactgcaagtgcaagatatactgaaatcaaatcagtgggtaaagtctgacaagttatctgctgcactgaaatctcctcatgcgtttgtgagcaaggtatccagtagcattattatctctgtatattttcagagtatatattagttgcaacagatagtcgtcacatatataatctatagatggccataaggctcgcccggcacggcccggcctaggatcgggctaggcacggcccaccagcgatcgggctggaacggctcagtcggcacttcgtgttgggccgtgctggcccatgggctgcacctccggcctaggcatggcctactagcaatcgggccatgcagtgctagcctgaaggcacgggtggtccatcgtgccttctttgaaataagtctatttctcctctctcctctttgggctgtgacatatatgtagctaaaataagtctattttatgtccctattctttgggccttgttatataatacgtctatttttgctccctcgtgccctacatatggttgaaattaagtctgttatgcatccccacactctcgtacagggcctagtcgtgctgggccggcccagtgtgtcggtggggaagcccaggcacggctcgcggtaaggccgtgccgtgcttgggctaggccaaaatgccgtgccttgggccgggccatcgagcctcgggtctatggctatctataataggaaaaagt

SEQ ID NO: 8302 - DNA, 50716 bp, Oryza sativa
  unsure (1)..(50716): unsure at all n locations
tcctgcagcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgatgacgatgaaggcaaagaaagaagagaaaaaaaaggaaggggttgtgaagtgggagcagggaagggcagctggcgcggtagtggggattgctagctaagagcatctccaacagcctcactattccactctccattctagccaaaaaaacaccctccaacaacctctccaaccgaatgactaagtcatctagctggctaaaaccttccctccactagccaaatttggccagccaaaagtgactagccaaccatgggccccacacattcctgctccctatctccactctcgcatcatccatcgtccttcgcgtcgtctgcctcacgccatcgcatcatccatcgtcctccgcgctgtcggcctcgcgccatccatccaccgatgccgcccgcggccgcagccgccactgccggtggtgacggcgctgcgcctgcccaaaagacgcccccgagcccaccactgcctcctccgccgccaccgcctcaaccgtcgccctccctggcctcaccccaggagaagatgaagggggccaccgaaccagccgcggaaggagaggtgggtctcggcgttggaggcggtgggggcaggcgaaaagggggtggtgggctcgtgacgccagcgagcgggggaaggaggtgggtggcgctagtgagataggagatgaggcagcagtggggccggcttctcccatttcgctgccgccgcagtcttcgtcatccctcaccgtcgcccccatcgtcagcctccatcgccggagcagaggcacacaaaccgtgcccccccacctccgccggcgacaccaccgccacgcagaggagcgccactagcacggagacgaggggtgtggaggaaagaaagaagtatgaggaataagaaagggcggacgtcgcgtggacttagctccctgcactcaccgtcgcgtggacttagccccctgcactcgctgcctccccttgctgtccgccgtcgtgtgcatgtcgccaccgcagcagagggagagaggtggggaggagctcaggaatgtctcgccgttgctgctcacggccaccgccgccccgccatcgccgcgagtaactaccactaccgcaagcaaaagggggcttggggaagagtgggagcaggatgatgagaaagaaagtagtatatagggtgacatgtgggtcctgctgtcatagactcagaatagagaggatgaatggagatgctgttgaaagaaacaacgaattgacttgccaaattaaatggagagttggctaaatagacatttggagagtggaatttggagagactgttggagatactttgagggtcgagagggagatcgcctccctgtcttgtccgaaatttctgaattggtaatggtttgccaagttataccaaagaaagtttgtcatactaaaatttatgaatttgacatgattgtttcatgaagagaacctatcttttcgagtacatgtgggacgcacgcgtatcacactcgcacctacaaacagatgtttttttcttttttttagaaaggaaaataaaacaatttcctcatctagatgtgcgatgtgaacggaaaacagaacaatgaagtgaaccgtgcaaatttaatcatttccctcatactggagtatgcattgatgcgtcgtccttgagtagtcaggattctcagttactcgtggcagggccgcacgggtcgtgcgagctactgtagctatgtattcgctccctcgcgaggccgaagagaaagccattaaggctgtgtttagttcagcgtaaagtttaaattttggttgaaattgaaaatgatgtgactgaaaagttatatgtatgataaattgatgtgatggaaaatgtctgaagtttggatccaaactttgaatccaaacacaacctaaaggggaaggcattttacctgcacagtcttaagagagttgtgttggtcctctcaggctggctgtgttggccctgtacttgcgccgtcacgcgcaagacgtgaaggacggcccggccataccacattgaacggcccactccccctacgtggccgcatccactgatccatattgcaagcgtatacgggctatataggtcgtactagtgttacagcctcatgtttttacttaaatttaaatttaaattttaaaacttatttcagagttattttttcctttttaatcataatttattttatagcatttgctgttgcatagttaagagtacatatgtataaattttacctacaaattatttttttaagttgctaatacgacttatgggtaagcatgaatataacccaaaagataggtgttagggttatggataccacatatctaatagtagttgactaaatctcggcaggacccaccacataccatgtcttatacggaaacaaccttcggatataggaggagttccgcataaggaaggatgaatagagttctacatggaaacgacaagaactactcggattgtatccatattggtttccctagttctacttggacaaggggacacctacgggtataaatacaagaccccctagaaggagaggggacacggaacaatagatcaaacacaagatcaacatacaagccaacatacgccaagacaagacgccggatatcgacttcagagataagcatggctagtcccctacggtgtctacggatactgtcaggagagacatagcgctgtctttgatctcgccggacacggattcgaggaggaagattactctcttgtcgactacgagatggttttatggccgccaagtcgacgacagatagatagactaccccaaatattgtactggtgtgattatgataaataagagcaacgaccggcttcggccaacaggagtagggttattacctgacaattcagggccccatctcttttattacaatctcacatatatcctagtaccaatgatcctcataatatgcaaataccggaatcgcgacatcaaacgtcgacaatgggctcttaatgcctaagtacgaccttgtgagctcttttttatggttacatagaagattgtacacgtgtatacacaccatccacacatactatttttgttctggtctttatttcaaataaactataaccaattattacatactccctccattccaaaatataaagcacaaccaccttagctaaaaactaagaaataattattatcaccttatagtttggattaatctaataaatataatgcatgcacccaataaaattagagatctcgttagattttgccgatttatttcatccacgtgattgcagccgtacgcagtgatgctccactaagcaggttgacattagaaattatgcatgccactgaaaactagcttgcagtgttaatttttgtatagatctttattatatatatgtgcccatttctccaaagttatttaggcacgatatcccacagcaacgcgcggggtatcatctagtttcatttacgaggagacccgcggcatgcccaagcgcatctccaggctcatctacgaggaacatgtggcgtgatcaagatcttcctcaagaacgtcacctacgacactgtcacctacaccgagcaccaaatggaacagacgagagtggtttttggaagctcaattgaggcgaatgtgcaactttagtgagcgaattcacacgtaggatatcaaatcggatggtccgtatgtaaccactttgattgagatgctagctctaagttagtaattgacgtatgactatgcacataagagcagatacaatagcaggctataagccagctgcaaacatattttagtaagataaataaagagagagaaaagcagcggtctacagatttatagccagctgtagcacggactccaagacgtagtatgtatacgacaggtgggactatatattaatagtgtagtatgtaattattgtatgaatgagctataagattggctatagatgaattggagttagtagttgactatactattaaacttactctcatgttcaaagttttatcgtttctctcctatcttttaggcctagtttcccaactttttctttaaacttctaaattttccattacatcaaaacttttctacacacataaactttcaactttttcatcacattgttttaatttcaatcaaacttccaattctagtgtgaactaaacacatccttagtgtccatgtgccaaaagagaacatgctcgtgggtacgtattctgagtatgtgttaaatgggtaatttattatacgggtaggaaataaccgtcatgggtgtagccaagggccgaccacaacgggcaagtaccggggctccgcctcgtgtagtagtacgtcccctgcttgattaacaaagtaattagcaaagtaattaaggctaacataaaaatatattagcctagtccatgctaacattaatcgatctaacctctcatattggttttagtgtactaaattacagctatattctactccctccgtattttaatgtatgacaccgttgattttttaacaaacgtttgaccattcatcttattcaaaaaatttatgtaattataatttattttattgtgacttgatttctcatcaaatgttctttaagcatgacataagtatttttatatttacataaaaattttgaataagacaagtggtcaaacgttgattaaaaagtcaacggcgtcatacattaaaatacggagggagtattaattttacctttataaatcataaatagtctatgtccttatatagatcatgtggatgaagtaaatcggcaaaatcaactactcttaaaagtttggtcagaaacttgcaaactgtaagcaggaagaggccaggtaatgtttgtagttaacacatatggactttaggcctgaaagaaagaatacatgttcattgcgctttgctttggtacaaaacagagaccaatagttgcattgttcttttggtcgatatgatagagatggggttatagaatggaaataaatgatattgctgtaagaaaataaatttaaaaaatcaattaatatagtgctgaattttcggaaatcactttcatgcattttagaagagaactgaattctcttttggaattaaaaaaaattgaaggtaaaaattaatgatcagaatttatcttcccagcaattaccgcaagagctgttctgccaaatcgatcagcaaataggaatgatttaacattacagggaaaataacataataatacaaaacgaaaaagaattgcatcatgcaggggcctcaccgaaagaacacctacagcattgcagttttttgtacagggagaaaaagatgagtacagtcaatgaactcatccaaaagctaaaccaccctgtttcagtatggagagcccataattaaactaaacatgacaggatgagggatgagaaaatgctaccttatccacttgagggtagacggaatacacaaatcagctgttgtctcacgtgaagaagccgagatgaaacgatgaaatgatttgcacaaaataatccaaccaagatagagatcagaagcatgccagttgcaatagccttcacgaatgatgaacccagtgatcaatcctccatagcatgataggcacagatcgagttgggatttaaagacagcttatgaaggcaaccatgaatataccacattcgtatcctaattttgcttcgattttgtggcacaatagggcgagcaaagaatttaacgttacggcatggaatcacaacgattgggggagataggacgattgttgtttcattcctacatgccaaggagccgaagaggctggctcgcgctagggatgacgcgacgcggcacgggagaggaagcgagggcgtcggtggcgggcccgcgcctggcgcacgtgcgatggaggaagcgagggcgttcggcggcgggcccgcgctggtgcgcgcgcgatgggggagaggaagcgagcgcgcgtggggattggtgggaggaagcagtgcgcgatgggggagacccggggcggcggcggcggcggcaacaaatcagtggcggagggatgtgcgtgatggattgcaatcgaacggttggcgaggatttgatcgaacggctgaaaaaaagggtgacgtgccttaaccacagctcaggaaaatccctaataactgcactaagtggggatcacttgtatagtattataagattataggatcccatgaacaaaactggtgtactagccaagagagaaatacagaagaacagaaaattttagggccttatcttttcatttatgtttatatttatcagccaaaatttgaattttcaactttaaatttgtagctgattttaaggttttttcatcgaagtttatttttcaatatttgcttttagaccgctaagaacacgtatataaaagttttattcacaaagtatttttgctttgcaaatatgtcaataagcgaaacgatggctccgttaaccacgttcaccagatcccgttccgttgtaacgcacgggtttgtgactattgtagaggaatatgttgtgttcggcacaccctttttctaacccctctccctcgttttccgcgcgcatgttttttaagctgctaaacggtgcatttttttaaaaaagtttctatatgaaagttgcttaaagaacttaaattaatctatttttttaaaaaagtaatatttaattattcacgcgctaatggatcgctctgtttttcatgcgtatcctggttggaatagtgaaaatttgctacaagacatccaaaaaacctttaattagctaggggacaccgtaagaacccgtatttgctggagagcaccataaaaaattggtaattagctgttggacactcacagtattattttattatttccagagaaaatggagagagaaatatccattaaagacaagtttgcccctatggcttcctcaccggctcccccggtctgctcctcgtcgtctccggttccggctgcgtccacggccccacgggcctcttcctcgccaccgccaacgcctgggtgctcctcgtggtctctggctcttgctcccagccggacgccgtgagattacaggaggccgcgaaggcgcttgacggagaggtcctcgaggagggggcatgaccggaggacggtgacgaaggccttcggcccaaaactgatggatgcgacggacagtttacggatcaccggcgtggccccagcgagcgacgcaatcccgtcgtcgaagagctgccggaggccgcggagcttgagcctggcgagccattcggacggcagcgcggcgaccacatggcgtgccccgtcgtcagagaggctgtccgtcccggagccctgggcgtagcggagcgtgagcttggtgatggccatgaaccgcgcgaagatcctctgagcggtgtagccgagcgcggcacgggcgtcgagcgagaggcggtggcgcgtggaggcgtccacctccttccactgcgcgtaggtgagcgagcaatcctgcgtgtggtcgcgccccggcggcggcgccgtgaactctatccctggagccgcgatgggtggggaggggctggccatcatggaagaagacatgacgaagaaaggaagacgaaggagtacagtaggagagaaaaagaaaaaaaataatattccctaataggtgggtcccacaggagagtgagcctttattggggttcaagggtaaaaccataatttcacaactgtttctctctctattttctccagaaataataaaataatgtcgtgagtgtacatcagctaattaccagtgttttacgatgctctccagcatatacacattcttccggtgttcttcggctaattacatgtcctgtagcaaattttgccttatgttaatggctattctatatgggccttttttgtgtctctccgcactcctctaggctctagtccatttcaccacctctggaccatacatgcagctcctaggccatctttatcagcgacctactacgtcgagcccaaaattatcgtgccaagcccactttaattagtcgttctctagcggttgcactgggtcccacatactaagtcagccggtttggaccaggtcaaagtgccaattcagcgaagctgtcctccaaaactattaagggaatcatattattacataagttttaatagttggggttaagatatcaggtattacggttgaagtataagaattagattaaagctatacctgagggagtcaatgtggacatattcgttctctagctctgcagctatacacctgtctggtctgggtaacctgcaggccgtgcagcccaaccatagccgcaagttaagaacgccgcttggttatactgggccagaaactgtttacgaaactaagcttcaggcctatagctaagctattatttgatcgcagtttcaagaatctaagatatatacgtcgctttcaacagggacaattttggaaaagaccatttagaaatctgacattatttttggacgagagaaaatttggagttgtacacagggagtaattttaaaaaaacaatggtattaatctagcaaaaaaatggctgtcacctgttaggaagagaagttaatagttaattagatgatatgatatcggttggtttaagacagacacaacatgtgctggtgcatgtggactgatggactcaaaacagtcccctccagtctccggatcctatctcggaatataattattggttggtatggtaacgtttacaatcatcgagtatatatatgtatgtacaatgacttgatgatcatcatgataatgatgcgaaagaaatcaagaacagcatcttctccttgcaaatgccatggcaaacagtatttgaacgtgacaaggctagagcaatgtaacactatggacaagttgacagctaacttttctcttgatatctatttatattaatcataaaaagaacacttgttggccaagctgtctccgtactttttcgagcacacaataagtcataccaaacttggtttaaatatactaataacaatcagtgtacttgttttctcattttctcttcattggcaggggagtgtactttcttagggtattcttccgttccaaaatcaatcgacttgtccagatttacatacaaaagattattaaattttaaaaaatataaattattttaaaagaaagggagtagtaaattgtgcatatgtatgtatattatatatatatatatatatatatatatatattcacgtacgaaagaaattcattttaaaaggttcttcttcctctaaaatagtattacctccgttttagattataaaactttctacgattgtctatatttatatatatgttaatgaatcttgacacatataagtaccagtactatgtactctcacatgtgaactactccctctatcccaaaaaaagccaacttctggctatgtgcaagtagagaactagtgaactacttcctctgttaagaaaataaacctactacaaaacgtgacacattatagtgttgtaaatttgtataggaggactgcttaaatttgtagaactaggatgtgttatatttaggacgaaggaagtagtacatatcaaaattcccaaaggatgtacacatgtggacgtgtaaatgaagagattttatgacagtctctaccaggtaacaaaggcctttaaaattaatatggatccattcctcttgagacacgccttaaaaaattttgacattcagaaatactactagtggcaaatatgccaatataatgtgccctctaataacatataactatctttcaaaaaaagttgtaccaaaaaaaaaacttaccccatactaatactgtagtagaaaagtagtgctccatgattttgctattttcttcctctgatctgtaactaggcctaagtgtgcttgcaggtaccaaattgatccgtagtaaattagcattgatcccattatttggtgacccgccactgcacccagccaaaaataaaatgtggcagaaaaaatagacagcacaacgtgatcgtccccacacccctttgataccacagtacctcatgcggtctaccctggcacatctttacatactcatggagtcatggtctacacaggtacttcaatactcacatccataattccatatcgctaattaaaacgaacatttagtacaactagatttatacctgacctgcaacaaatccacaacaaaatttttagtattctctccgttttatattataagtcatttcaactttatatttaatcaagtttatagaaaaaaataacatctttaacatcatattagtgtaacattcagtatatcttgacaatatgtttgtttatgttaaaaatactattgcatttatattaggaaaaaaattaaaacgatttataatataaaacagatgtccacacaaattaagtacttcgcttgatcaacctttcttttgcaataaccaaaacacactcagaccaaaaataacgcgtcacctataaaaatttaaagttccaaagaaaaccgtctctttaaaattcgaagacaaccgtaaaaaaataaataaattgaagcgatatcaatacgtgtaagcatttgtccatacacctggtccacgcacaaccataacacccagaaagagaagcggttccctccaaacgcgggatataagcgcccacgatccctcctcctctccttcccacgttctccaccctctctccatcgatcgatcgcaaaccacctcccaagaacaaccaagaaagagatcggatcaccgatcggcgcgcggcgagcgatcgatcgaggtgcaagcgatcgaagatgagggagatcctgcacatccagggcgggcagtgcggcaaccagatcggcgccaagttctgggaggtgatctgcggcgagcacggcgtcgaccccacggggacgtacaccggcacgtcgccgcagcagctcgagcggatcaacgtctacttcaacgaggcgagcggcggccgccacgtcccgcgcgccgtgctcatggacctcgagccgggcaccatggactcgctccgctccggccccatcggcggcatcttccgccccgacaacttcgtcttcggccagtccggcgccggcaacaactgggccaagggccactacaccgagggcgccgagctcatcgactccgtcctcgacgtcgtccgcaaggaggccgagaactgcgactgcctccaaggtaacgtacacgtcgattttatatatacatatcctcttgttctttaaattcactgtgtttcgttaaaaaaagaaaaaacgaatccttgcgttcatggcattcctctgcattttctctgcatacgtgtttctcgggcctctgtaaaccgtcgctgaaaatttagaataggatcatatgattctttaactttttttttggcaagatcattttagacggtggcatcctaaaagtggacaaggtttgtactttctgtgtgtatttttaggtaagacagtattatgctacacattattagcctatcaccgcagcgtgttaagatccgcatgaaaagaatctggagttttttttttcttttgttagacaacagagtaatacgccaacttggcagcattgataatgagcaatctggtatgaattgcttgtgggtctcagaaaaaaaataaaataaaaatgaattggtggttccagttatgagagtgtgaattgttcaatttgaggagcaaaacaaaccagtagtgctgcaaatttcaaggatgaatttcagtgtgcaaacttatcataccattttaggttggatttgaataggaataccagcagcaccagttgttgaacccaaatttggacatacatggaaaagaccatacatgatacatagtagtactggttggatcgggttaatcagacagaagcacaacatctttactcgtggttgaaattgggaatatcttcaaaaaaaaaatcgaataagatgaaattattattttcagtccccatcacattacaccacttccacctgtcggaatgagacattcatcctgtgtcaagttgatccattggcatgatgggaaatcgggatcaacacaggctagaaattgaggcgccatatattgttggtttaaatttcagtagttctctgtgttagatctgtaaatcttatatcgagttgaatcaactgcttaaaaattggaacactatggatacatgttatgaaggttctaaaaacttcaagtgcacaaaaaattcacagaatacttgaggtacagagtactgcttatgtgcgctgaatactatttttccctctatgcataaaaggtgaatctgactattatgcattcattcattgccaagatgtaagatatgcatgttaaaaatgttacccagtaatcagtaattatcattgttttcttgaaaatgcgaggtacaacgtatgcccaaacgaattgaacccagcaacaaactaaaaaaaaaaatcccctaactgctactttctggcgaatagaattgtcgttgagagagagttttcatcagttcctcaggtggcaaacaactggtattgtcggtcagatgcgagttttcggtacagaaatacatcaccatcgcatctcaccatcttcttttgccggtgaaggttcatgaggttatcatcatcacaataataatgtactactagtagtagaaaaacaatcatactgtgactagtgacaatgttgtacgacctaacacaagaaagagtgaaggaggaggaggatgtatcagctaatggaacagagccgtcggtggtggttacagcggatgagacactcagacaggctgttgccagtctctggtggttgggttacatgatagatcgatggatggattatattagtgatgatgttctgattacttgcatatgtacttagcatgattgcctttggacgtatttgggagatggattttagtgcacgtaatcatcagaaacagaatataaacacattttcggattcaacttacatattattagaaacacaaattagtactacaggaatatgattagtccggagatctgataggacagataatgcggtgctagtttcttgaattgtttgcactttcatgactcttaacaggggcatctgaactttagctcggttaaatgtctaaacctcaatgtacagtagagttcagatcattttcattttcagttaagatgtctcatatacttatcctaatctgagtaatgtcctataactactgatggatagttggtttgttttgatacggagggagtatgtagtaacgtgagtgacatgcaattttgtgagtgcaggattccaggtgtgccactcgctgggaggaggcacggggtcgggcatgggcacgctgctcatctccaagatcagggaggagtacccggaccgcatgatgctgaccttctccgtgttcccgtcgcccaaggtgtcggacaccgtggtggagccctacaacgcgacgctgtccgtgcaccagctcgtcgagaacgccgacgagtgcatggtcctcgacaacgaggccctctacgacatctgcttccgcaccctcaagctcaccaacccatcatgtaagcgaagcgatcatgcaccttgaccttgtgtgtgtaatttgcttgaaattaacatgatggaaataatgatcaatttgctgttgttgtagttggtgacctgaaccacctgatatcggcgacgatgagcggggtgacgtgctgcctgcggttcccggggcagctgaactcggacctgaggaagctggcggtgaacctgatcccgttcccgcggctgcacttcttcatggtggggttcgcgccgctgacgtcgcgcgggtcgcagcagtacagggcgctgacggtgccggagctgacgcagcagatgtgggacgccaagaacatgatgtgcgccgccgacccgcgccacggccgctacctcacggcgtccgccatgttccggggcaggatgagcaccaaggaggtggacgagcagatgatcaacgtgcagaacaagaactcgtcctacttcgtggagtggatccccaacaacgtcaagtccagcgtctgcgacatcccccccgtcggcctctccatggcgtccaccttcgtcggcaactccacctccatccaggagatgttccgccgcgtcagcgagcagttcaccgccatgttccgccgcaaggccttcctccactggtacaccagcgagggaatggacgagatggagttcaccgaggccgagagcaacatgaacgacctcgtcgccgagtaccagcagtaccaggacgccaccgccgaggacgactacgacgaggacgacgacgccgccgccgccgacgaggcctgatcgatcgatcgatcgatccctcccgctttgcctctctggctctctgctacgctacgctacatatatttcgatcggtacaaacacacaatgtgccgttgccgtgtctgctgctactgctgctgcttgtgtactgtgcgctactacttgttgcatgccttcgttcgttgtcatcgttgttctctgtctaaatttgtttattcatgtacatgaaccgtggtttactcttttctatctctgtatatgttaggaaatgttatctacttcattttcatgggactaaactctactgtgttcatcatgcatctcaatgtgcagtttttttatttgcaattttctcgatcggttaccatcctgcattggtttttctctgttttgaagggagacatgaattgacataagcaaaagttagtttacacattgctgcaatgtatcagcataggccgctttaaattactctacaactgtgatagctttgcatttggagagctttgccaaagggggctctagcatgatgcccgttgctctgtcactgtcatagtggcacaaacaaaagacagggtcctagtgttggaagcacttcttattcgaaaaaaagaagtgttggaagcactattttttatttaaagtaagttttaggtgaatgcagagacttaactttagtctctatatttagatactaatttagagtattaaatatagacaacttacaaaactaattatataaataaaagctaatttgcgagacaaattttttaagcctaattaatccataattaaagaatgtttactgtagcatcacataggctaatcatggattaattaggctcaatagatttgtttcgcgaattagtataagattatggatgggtttttattaatagtctatgtttaatatttataattagtgtcaaaatatttgatgtgatagggatttaaaagttttagtcccatctaaaaaggtctagttgttcctgcaaatgtggtgatctctctcctatccatctactagtaagatctaaaagccacatcatgacgctttaagtgtatatatgcccaaaatatttctgtcttacgtgttgtgcctatctctcacccaaatgaaaccccctatgatgagatggtactgctaatatactaggtgtgaccttttggcattctgaaagcaaagtcattgtttagtggtgactttcaggctaattcttgtcctagcgcacactgaattctgacctcatacagtcatactcttccatcatccctactccttatttacaacaagatgcggtatatagtacaactacaaatcctaagccgcaaaccgagatatatcctctcttgtgaaaatgtttacagtacagaacagataaaaaatatgaccagccaaactgaatgacatctctctctcttctttttcttttttttttttttttgccgggttggccgaagagacgaccaatcaaatattgttaagactgaaaggagagttttacagattgcaaatgcatcgacggtagaagctcaatgacattatagctagccacgaaatgctattcttcagctaagccaaaaggcacaaataacatatctgaaacacacatatattctgtcagaaagtatcattccccggaaatatgtggatcgatcgaccagcaatattttgtgaggttcatctgtgacgcgagggcgacatgaagcaacaaaggtagctagtgcggctattttctgaagctcaagttggcgaggaattcgcacctgctttccaagcacagggccacgcaaacccgtatttcacaagttagggcaggttccaatccaattatattaggggtacaagacgcaacttttttttggctgatgagatttgccttttgataacaacaacaacagctagctgatgttttcagtgaaggggacatgcacggtgaaaagaagaagaatcaaatggaagatcacgaagaggcgaatattcacgtgatcatcagtataaggacgaaatatatgcagtggataacctttattcttagaaggacgttaaaaaggggaaaaggcaaaaggaaacaaatgaggctgagcttcttttttccttgctaaatttgactctggaaaagggcagcaaagaaagatgatgctgtgcagagtattctagccttctaggttctaatttctattcgcctgatgagtttgttgctgaaaataaacaggtgagattctgctcagtaactgggtacagttcatttgacagtgatgcttggcgctacgcaggtgacacgcaatatattcaggattcaggacaacgatatgtatgctaagacatgtatcacgcatgaaaagtaggtttaatcagtcagatcatgcaaaaaaggcaatggctgggtttgttgtttgggcatcctacaccacgtaatctctattatttgatattctcattggaatgcaacaagtagctaggatcaatgttgagttagaaagtgtgaaagaaacgcaatggaacggacgcgcaagtctcaatcgcattactcacgttggagaaaagcttcagaagttgccctgtttgatggtaacacaaaaattgcagtgctcctacgtttcttcatgcatctcatataatggagtactccctcactctcatttagcgcagtcatgagtttccgtgtccaactttaattatccatcttatttgaaattttttatgattaatattttcattgctattagatcataaaatctgaatagtactttatgcgtgacttatgtttttttaatttttttcaaataagacggacgattaaagtttgacacagaaactcatggatgcgcttaaaatagaacggatgggtagctttttaaatgggctgtaaaacgtcaattaaccctatcgaaaaaagcattagggtttcccaaaccatcggtaaccacgcggttaccgcattgaccatatttgcagtgggggcaccatagggttacttacaattgggtttgacaaaaattgtttgaattcaaattttgaaaaaaaggagggggggcgggggaaatagcaaaaaaaaaaggtccaaagtggttctacatgatttataatgatatttgttgataaaatttgtgaaaaacactaagctaactctgtattttggcatgactataaggtgaaatgaagatttaatgcttgagacatatatattgtggatgtcataatctttgtaatctatctattaacttattaaaggaatagaaaaaggagcctccacgttcgctctcacggcctaaaaatttccacattaatcagagaaaaagaaaaacagagttcatatagaaatataatttagaaatagttgaaattcagaattaaaaaataaggaatattggaagaggagactagagtccatatagaaatacaattgagaaacaatagaaattcggaattaaaaataaggaatattagaagtagattatagagtccatatagaaatacaattaagaaataatagaaattcggaactaaaaataaggaatattaaaagtagagtatatagtacatatagaaatacaattaagaaataatagaaattcggaattaaaaataaggaatattagaagtagagtatagagtccatataagaatttaaaactaactaaaattcggaataaacacaataaaattaaaagtagagtttagagtttataaaaaaatacaatttataaataactaaaattcgaaattaaaaaacatgggaagaagagtctaaagtcaatataaaaatacaatttagaagtaacttaaattcgaaattaaaaattaaataatattaaatgatgagtttagagtccacatagaaatacaattagaaataataaaaattcataattaaaaataaataatagtcgaagaagagcctagagtccatataggaatataatttacaaataactaaaatttaatattagaaataattaataactaacacgtatataaaatacaatataaatattatacattagtagtttcgtaaaggtagtacaaaattaaaattatgttgtcattttaatatatttgaataatacattaagaaaacatatatgttattatatgacagaaaatataatgatgctagccgcgtaatctgcacgggtcaccatgctagttatattattaaaggaatagaaaaaggagcttccacgttcgctctcatggcctagaaattctcatattaatcggagaaaaagaaaaaacaaagtccatatagaaatacaatttagaaatagattaaattcggaattaaaaaataaggaatattagaagaggagactagagtccatatagaaatacaatttagaaatagttgaaatttggaattaaaaaataaggaatattagaagaggagactagagtccatatataaatacaattaggaaataactaaaattcggaattaaaaataaggaatattagaagtagagtatagagtccatatagaaatacaattaggaaataatagaaattcggaattaaaaataaggaatattagaagtagagtatagagtccatatagaaatacaattaagaaaaaaaaaagaaattcggaattaaaaaataaggaatattagaagtagagtatacagtccatataggaatttaaaactaactaaaatttgaaataaacataataaaattaaaattagagttttgagtccatataaaaatacaatttacaaataactaaaattcgaaattaagaaaaacatgggaaaaagagtttaaagtcaatataggaatacaatttataagtaactaaaattaaaaattaaaaattaaagaatattgatagatgagtttagagtccacatagaaatacaattagaaataataaaaattcagaaataaaaataaataatattggaagaagagcctagagtctatatagaaatacaatttacagaaaattcggtattaaaaaatatatattaaaagacgagtctagagtccatataggaatatatataatttacaaataactaaaatttgatattaaaaataattaataactaacacgtatataaaatacaatatgaatattacacatttgtagtttcgtaaagttattgcaaaatttaaaattatgatgtcattttaatatatttgaataatataatgagaaaacatatatgctattatatgagagaaaatataatgatgctagccgcgcaatctgtgcggaccaccatgttagtttgttacattattgtcagtgtgaggttgtggttttcttttatcctcgtcttttttattccaagtcaaacgaaccatgcctcgcggtaaccattatataaccattatcttcgatgagatttgaatattctgaatttatctttttaagatggaattcacatggtttttgacagttaccatgatgttattgcaataaccgtcttagcaagggggacgataacctctccacggatgctatggaaaaccctggttagcatcgcacgccactttacactgctatcactgtgtcacactgtcgcatgctatttggaaggttctccaaagactaatgatcaagcgagcacttgctctcgccacgcgttcctgccgagggttcacgagataactaatttcatgaatttcgagcgaatttttgaaattcactaaattttgtttgaaatttgacccaaaaaaaacagagcagattgagggagagcttcaaattttaggcgatgaattttgaacaagatgtgaaccatgttcctgccctacgaaatccaactagctcactgctgaaggtccctagcccggggtctaacgaactttgcaacaggatttgaaccgttccatccaaaaaataaaaattcaaggtatatatactggacaagacaaaattcaaaaatacataagggattgaaaaaaaacgtaatgggacgtaaagaattttatgacaaacgtcattatatttttatttgtatgaataagtattattaattgggtgccgcccaaaaactgagagcatacggactacagagtagtacacgtatgtacttttggaagttggaaacaatatttccaccgtgaaaagcgttgccacggctggtactgcacaaaactgaaggtggctatgccccgggagatcggtgggcggtgggcggcgccgccgcgcgcacagcatgcatcgttgcttgctgcacagcgcgctcgactcgagccctgcgtgagcacggagatcgtgaacccctcacaagctacctaaccacccgcgtgatggggactttgcaagttggagtagtactagtagactggtagtagtacggtagtaccctcgaaatcgcgtcacgtacattggccgctttggctggtcaggggagaacttgctagttgctgcaatgatatgctacatctatccgtcgactctagttaataaaagggaaaatctgtttcgtaggaagttataatacgtgagcttaattagtgttaatcaattggacggaagacagtagtcttattcaactcgtccaatcgcattcctatattgtgaagaattaacagtggaaataccgacgagctagtcgatctgcccatgcgtatgtacgaatatgatagttcatcttcgctagagtgaatctagccaggttgaggtgtttgaaacggatgaaaatggagattaagttggtacatttaaaatgagaaaatcattagcacataattaattaaggtttaattattacaaatttaataaatagatatatttgatattttaaaatataaagtttttcacggaacataccgtttaatcgtttaaaaagcgtgttaacaaaaatcgaggtaaaatcgacgcgttgatgcactgtacaattcgaattaaattttatattgtgtcctttgcctcctacaaaaggatttaacaatttttaccaactactcccccttacccaaatataaggtattttaacattttgcttacattgtttgaccactagttttatttaaaaaaattgtgcaaatataaaaaacgaaaaggtatgcttaaagtactttggatgttaaagtaagtcaaaaaaataataattcaaaaaaaatttaataagacgaatgatcaaacagcgcaaacaaaatgtcaaaatcccttatattaggggacgaaatcccttatattaggagacggagggagtaacatgtaacacttatattaggggacggagggagtaacatgtaacagtgattaagcttatgcttataattaagcaaaaaattaattcacttatgcccattatttcacttctaattatgcttataattaagctaaaagttaaattttagagcttagttttagttctagagttgattttgtggttttttcgttatagattattttacaatatttgttttcaaaacgctaataacaagtatataaaacttttactcacaaactgtatatagattactaataaaccatacagataagataagcataacgaaagcaataaggctaatagtcttatatgcattacaaaagaaccgacttgcaggtaaaacttggcccactttagttgatactactgtaattaaggtcccgtttggcacaactccagctcctaactccaacttacttgaagtcggagctgtgtcaaacagtccagatccttcttttttggcagtggagttggcatagctactcctaataaatgaactacgggggtggagctgggttttactgctccataactccactccacctcaaaagacccactaccctttaaatttttaatgtatttacataaaaatgccactgaactaccccttcacacctctcctcccattctctctcctccccatcctcctccctccctacagcagcgacggacggtgacgtcggcgtcagcggtgggcgtcgacgggctgcgttggcggcggcgggcagtggtggcgcggcaggcgcgcgggcgtcggcaggcgacagcagtgacagccgatgccaacctggtgttcaacgaaatgcctacaaggaacgtggtagagtggagctaactaatctagccaaacactttcgtacccacttcagctcctataggagctagctctcactgcagttggagttgggagctgggagttagagtttagagccctaccaaacggggcctaactaaactttatttttgaagtctaaaaagtgattcatagttcattttagaaaataagtataaattaccccctaaccatcgtgatcgaccgagttatcccctgaactcgaaaaccagatattttacaccctcaactatacaaaccggataaaatacccctaactcaatctgaaatggttttgatcctacatggcagtccagtcagcaattgttttttaaaaaatcagtgggccccacatatcgtactcacccctctcacctttttctctctactctatccctctcttcctcaatccccatcctctctctctataatcgagctgagcagggaggagatggcggatcccataacctggcgaccgtggtagccagtggcctccaaggggtggagctacacagcggcggggctctactcacgacagagctcgtggatggctcgccttggagagggcactaaaggcatcggtagaggtagcggagcttgcacaaaggtgatggctgcggtggcagagttggagcttgcatgaaagcggcgacgagcccactgccgtctaccagtctaccatcgccactgggcttattcggtcaaccgcgcatcgttgctgccataagattctctggccaaccatgctccactgctgacgccgcgggggactagtctccgccactgccaccctaggcttgtccggtctgtaggatcgaatcacaagaactaagccaaccagaggggggtgaatggttgatatacccaaaaacccaatcttttagcggaaataaaagttaccatcaaattcgatgtagatcggtctgactgaggttgatccgccagtctgaccgagctcgtgccgccggtctgaccggtgttgatccgccggtccaaccgcctgaagattgcctgccacgtgtgaagtcgctgccagtctgaccgcctctcctccgtcggtctgaccgccgcctgccgccggtctaaccgccggtatgtcgccggttagaccgctgaaacccgatgaaacacaaatcgaagaactctcaaagtagatgacaactttattacttctgtctgtgtttataaagtacaccaacagcactccttacaaaaatctcgactaaactcgaaaccctaactaaactagcaactcaattgctctcaaaagcgataccgggaagcctcacgctccccctctatttatacataaggtaggcagcctaaagccacgaaccaaactcatactaagagtcctaaacatcttaggaaaccctatagtacaagacacaaactttacataaccaattgtaccaaatttggactccttccaaattcgactccgcatcccatacgcacacaatacctccatcgtatgccatatggaatcttcaccaaccacgtgcatcaactctagtcttagtatcccgcatgatatctaaccaccacggacatcgtcttaccaccaagccgactcccggtccatcaccgcaaatactctcccgaggcatcgagtcacctacacatgaaataaacaaagaaaccatattccgagaccaagctatccccaacttgactcattgttagcaaacaacagtattacatacgtataatatccatctagaagccataaccatgaaacaatcacggatatccaaacaaacaacccgaaaccgaaatcgacgtagcgtcggccggtcaaaccgtgggccggccggtctgaccgcttaatcaccaccggtctcaccggtatacaccacccggtcggactggtcacataaaataacagtgaatccgatcatcacctgaaaattgattatctccaaaaccacttcgacgataatctccaaatatcaaaaccaataatcatagatgccaattattcatcacagaataagaatcaaaacacactttgatcttacacggtcgaccgcactccaccaccggcaccccgggggactagtcaccgccgccgccgccataggcttcttcggctgaccacactaggcttctccggccgactgcgctctgtcgccaacatcccaggggactactcttcgccgccaccttgggcttcttttgtctccatctcctctcagttcaagggtagagagagatggagggggaaggaggtagaagagtgagagtagatatagagaccgacatgtgggcccattatttttaaaaatattttttgccacgccggagtgccacgtcagccagtttatgccaaaaccgcccaaaacaatgctcgggggtagtttatctagtttgcatagttaaggatgtaaagtgcttggttttcgagaacaggaaggtaattcataactttttttccttcattttattgaaaagtgttatgaggattgacacagttggagcctctcatgttgtttttttttaaaaaaattattccaaggattatcgggtggccgacttgcgcccttccctaattcgtatatacattccattatatcttatattagctcatgtaaatgttataaattgatactttattttttttcatgttattttgggaatttctatatttgttatcaatgtgataatttatatgctttttcttgtccttttagaattactaagaaaattccttctcttgattctttgttcaatcccttgcacagacatgagttttgctcgccttccagtttttatctatgaccctctctagaccagtgctgctagttgaccactctatcaagtccgtattaagtctaagacttaccacatgaaacctaaccagttgagctattaacaatttagtcacgagtgctcgcatttacagttaattactctttcagcggtatgtgagacgtactcgtcaacaacaagatgcctaaggtggcttcatcattctcaggatatatatgtcaggctaacactggtggagaagtagtttttactcctggttcgtaacccccctttagtctcggttttccaaccggaactacgaatccgggactaaagatcgctatatttagtcccgggtgaaataaccgggagtaaaaatctatctttagtcccggttggtgtagatagagccaggccgatccctggctgctcctttattatattcttttcttcattgtttttaatatattgatttcactccatccccatccccaaaatcccaaatcaattatcacctccaaatcctcaaatcgatcatctccaaatacatcacaaaatcttttaaaaaaattacatcacaacttctacaaaattcatcacaaatacatcacatattcatatcacacacaaatcaaatacatctcaaatccggatcacaaattctcaaaaaaaaataaaacaagccgccatcttccgcctgccgcccagccgccaccttccgccttccgccagccagcgccgcgcgccggccgccgcgcgaggccggtgccgcgcctgcagatcggggatgagtggggggagggggaggaggagcctcgcgtggcgccgccgcctgcagatcggggaggaggggggagggggaggagaaggagaggagggggaggaggagaggatcctccgcgtgtaagatagcgaggagaaggggaggagaagaagagatagaaccgggagggaggaggggaggaggatatatgtatctcgatcccgcacgccttgatctctccgcgcctcgatctctccacgcatgctgatcttttttcctggttggtgttaccaaccgagactaaagattgatctttaatcccggttggtaacactaaccgggactaaagatattagaggggtttgacatcacctaccgttttttaaccgggactaaagatgatctaccaaccgggactaaagatcaaaaagtagctctaaccttttcaaccgggactaaagataatctttagtcctggtttttattgcaaccgggactattgtggaatttggtcgaccgtccaaagatggtttctccaccagtgtaatctttcgaatgtacttatgaggatatggtgtgcgtgtgtacgttttatagggatgagtgtgcacatctgtttgtattgtttctaataaaaaggttgggtgcacttgtccagcacatatgtggtacttgcactcttgtaagttagtctcacgtatcaaatacacgtaagcaacaaaagttatagttttttaataaaatagtttgttatttttgtaattttatgaaatgtttggcttaagttgtagctaagtgatagttttgataaaataattgtagttatgtgaaatttactttataaaacttgagtggtagacctatgccctgatccctacgtcaaaaccttaaaagggcggttattttttaagttgtgtgaatttgtttgtgaaattagacgaatccaaatcaacaaaatgtgaaactacaaaaaatttctaaaatgaggtcaactaacatgatttgtacatacggatgagaactgtgaggtagtacagctataaagaaatagagcaaaactttgggatgtagaagtgattgaaaaaaaaataaacacacaagatgaatttccttagaattactatatgttttagatagcaacaagatagtatttttgtagtattaaaagaaggatttgggggtttctttttttcttttttttgagaaactatttgggggtttccgaatgggcttgcatgcctacatagctacatgggatgggaactagggagacaaacagtacaaccgcgggtcccaagagaatatagtctgttcttctcgttaagacacagcatcaacaaactagtaactaattagattacgagacatacacaaggttaacaaactaagtaattcgcatagctaagcttattttcacgtgcaagcatgtgacgaccctgttaagagaattgacctcacatcaagagtcatgatcgaagcttaatttttactagtacgtactttaacctcctgagacccaaaaggtcctataaacctccaaaaaaaatgaagaaaacaccaaaataaaggccccaaatgcttagcgccttagccaatcgatttaatatacacttgattagtactaatcaatccaaagcaatgatgcattaattgactacgtggaaggttagcgagggcgctgtcagccactggaacgttgtgagaccggcacgagacagattagtcaagcggtacggttgccggttggttccggcagtgagaccaattcattccccctctccctctctctctctctctctctctctctcctcacgtcacatgaatctcgagaaagtatgtagaaattggcaaagttcttgtgacggattaatcaggtcatgtgaagaaacaatcccttcccttctcatcaaggagttgctaaacccatcatcaaccttatccaacaaaactttcaaatttagccgttctaaaattgaaaccctcttccactctcccaggtccctttttttggacgagaaaacgcatgcgaaacgggggaaatttggatggtttttatttttcttttcgtcgaaacgcaccactggctatcgcgtcgtccactactattctcgctctcccctctaccaaggcccccacgccacgcacgcgcacaaagtctgaggcggaactaacccaccaatccgccaccaacccagagcgccgagaagcccaaccgcggcgagcagtgtgccacgggccggcgcgccggcgaactcctcctcctatgctcgccgccggcgatgcccagcccgctgaaggagcgacccgccggccgactcggccgcctcctcgccgcgctccgcccggcgcgcgctggcccgctccccgtccagacaggcttccccacctccctcgctgacctcgtcgtcaagaaccatggccgcctcaagaagccctccgcctcggcgtccaggcgcaagaagcgcggcgggccggaggctcccccctcgccctcgccctcgccctcgccttcccctccgccgcagccttcctcgccaccaccaccaccaccatccccgccgcctgcggccgctgtctcggtctcgccgccaacccagccgagaccgagaccggaacttccgccggtggaggccgtcctccgccgccagcccaagggccgcgtgttcggccttgggctggggttcgtctcgctcgtcggcgtggtgtcgctcgccctcctcgtgatctggagcaagaaggtggtcgcggccgtcaccgtcgcctccttctcgctcttcctgctcgagtccgtcaggtcctccgcgctttcccggcggccgcggcggccggcggcgaacaacaagctggatttggacgggcgcggctacgtctcgccgatccgggaggtggagccggcgagggcaagcttctccgattcctccaggcgaagcgagttatccatcctcaccattgaggagagaagcgaggtaggcgacgattcgatagtcgccattgaggagagaatcgcggcaggcggcgacgactcaagcaacgccaaggtcaagaccaagaaacggtcatggaggaagctgattccccgcaagttacagaagggcatgaagggcaaggaggcggaggattcgtcgggttctttccgcagcagcgaaggcaaccgaggtgacgccacggcgacggattcctcggactctcgccgtggaatgcgcaccaaggccgcggacgccttcgtcgccagatcgatggattcttcgccgtctttccgcgggaacggaggcgacacggacgccgacgcttacagcaatgccacgcgggtagaaatcgacgcgccggccgatgtcctcgccggagacggcgacgccgtgggagggacccggtcctccgtcgcgctcctcgtcgttgccgtcgttctcgtaggcctcgtcgccggcaagctcccggccgtcgtgttcaccgtgctttgcggcgtgttcattagctcggttcagagattgccggcgggcggtgacggcaacggcgatcggagctttacatggtggtttaggatcaaacccaaagatgtaaattagtggcagaagaaaggggagagttgagtgacaaaagaaagaagcagcaaatacataaatatttgttcttgttgctcgtgtcgttcgtgctttgcattcattccttactgaatcggaactcgaagtgcaatgttaacttaacaacgttatgtagtgtttagatgggctaaaactttttagccccagtcacatcagatgtttgtacgctaatttagagtattaaacatagattaataaaaaactaattttataaatgagagctaatccgcgagacgattttttaagcctaattaattcataattatcaaaagtttactgtagcatcacattgtcaaaattatggcgtaattagactcaaaagattcgtctcgcaattagtccaagcttatggaatgggttttgtaattagtgtatgtttaatactccaaattagtgtccaaacatccgatgtgacagggacttggaataagtccctggaaaccaaacatccccttagagtctcgcccgaaatctgtctgcagttcatccttaggattacagctttctttgcaccgtgttgtttttttaaacaatccgatagtgcgatgattctattgattgagcagaaaaaattacaagcctgtataaccctcgaaggcatagcctcgaaaagaaaacaaccacatcatgcttctacaaccaaatcgcgctactgaagggtaaatgaacacgacacccctaagaaaagaatcttctagacgatgccacccaaaagtatcgccaccgcctgtcgtgagaatccaagacaagattttcactcgaagaaatccaacagggagagcataggagatcatacaacaacacctcaagggaaaagcggtgcccgcagacgtggtcattactggccccaaggctgggcttttgtccgtgatctttctgctctcccgagtcgaggtcaatccggaaacagcagcccaccacccgtccaccttcgacacgcagccaccgtgccagcgcctcgtcgccagtcagccttcaggagggagctcgaccactgacgcactccgaatccatccaggtagttgggctggagagggagagggtgagagagaagaatggatcctccctcccttgcactagcccaccgacgtggcaatcttatgacgacaaagcgtcgtcgcaagaggacaagcgtctatatccaagcccgttgcaggcccacagcacccacctcacaacaccaccatcgccgctacctcggctggatatcccatggcagcacccccacctcaagccgtgcgcccgccgcgaactcccatagcccccgccaccacaccactctcgacaatcacctttatcatgctggcgccccatcgtcgctgcctgttgcgcactgatctcttaccattggccatgcaccgccgtcgactgtgactacgtgtcgcaagtcctcctactgctaccagccatgtcctgtggccttctgctgttgccacttgtgcccctcgccgaccgggttagcctcgccaccgtcgccccctcgcccactgccacaacaacatccgtctcttccggccaaatctggtgtggaagggcctcgatctagccattggggccggatccacgctccgttgtcactgcgcctgctccttccccacctcctgccacaaacctctcctccgctgccatctccggaaccgcggggtgggcaccggatctaaggtagaggacacaagatccgccgtgcatacctctcccccacctcctgcccgtccctctgcacacaccgcctccacgccctctaccccgcagccacatctcctccaaagcctcctccactggacttctcactagctctgatggagaaccggggttgggtggtgcaaccacggaccccagctgttcaggctttctccgggagggggaagcacctctctgttaccattcttgtgaccgttcggctttgtcgatgagccactcgggcggtggcgaggcgaatgggaggggggagggggcgactgtggcaagttttcaccatccaagtcagccctgaggtgggagcgacgggaggaggaaacttctcatgatcataggaaaaacataggaattttggaggatttcaattctataggaaaaattcctatgaatgcctttaaagcaaatgattgaatccttcctatggaatggttaatcctataaagattttgaagaaaacttagtaagagctcaaacttttggaaaattttctttgagtctatctatctcatttgattcatgtgttttcctacaatccaattaaacagtcattcatgtgtttatcctatgttttgtaatattctgttttacacttttatttctattagaattatgtgtttttcttttatttttgttttttttctcatttctgcgatttaaatgtgaccttggtgttgttggtggctgcactagtgttgttgatgatacactatttctttttttttttatgtgatgcaagaatattctcgctgccattcaacggaacacccctccccgtcgaatcgacgattacccaagtggcaatcgtgaacattttcgtcattttttcttcaaacttttaactttttcatcacatgtaaatttttctatacacacaaacttccaacttttttatcacatcattctaatttcaaccaaacttctaaaagtgtgaactaaacacacccatcccgaccatggctgttgcgacttgcgatgatcagaagctgcattggattgcacagcaccgtcccactgaacaggagtactgatgggctactactgctgctatggccgccggcctatgggtttcactcggtcgtagagtaaaatagtgctggctagtgagacaagcacaagctgcagagttcggcatcatcccggccggtccccatgatccaagctgagaactccatgggatccatctgatccgacggccgggtggaccacaatgctgcagcctgcgcgcaggggaaaagcctgggagcgccatcattccaaagccggcaagcaaaggcaggcaggcaggcagcagccgccccggttcgcgggcttcggctgcactagtttttcgctaccaccaaattgaaagccacctcgcgcggcttctcgcctctgcctcaggcctcagccgtcgaggagagggctcatgtgagaacgcgtagccgcgcacccggccgggctggcaccgtgtgtccgtgtctcgtcactctccgtgctgggtcttgtactggcattcatgccgccgcaagtcgcaaatggacttttcccagtggtgaagcccgtttttccagccgtactgttaactgtctatgcacaagaatgtccccccaattgcatgagaaaaaaaatcaaaaataaaaagagaagatttatgcgtgtcaccgtttggttgcagctaatcacacagccttgggcgatctgaaattctgaatccgtcgtcatttgttgattgctgtggactgcttggctcggagagacgtactggtgcagacatttggaagatcgacgagggaacctagcagcaccgctgagacgctgacgccgataggggacattcttgtgcaaatttataatcagttaatattcgttcggaaaaaagaaagtgaaatcagctactagcatctgccatttgactgatcctggagggaaacctctagtttagccacacagcaacactcatgtttgtcagcggtttattataacttctctcgccaaacaaacatgacatcttcttcttggagtttcttgggctacgcgtttcttctccatggagttacggccggtgattgggtagtacgtgggttgaaatatggtagagttggtgatcccggcagatttggttggagttattcggaattttctatcattagcgcagcttcttctggtcaaagtctactcttgattctttttttcaccacgaaccagacggttgagtgttctcaaaaaaaaaaaaacagacggtacgttcgaggaaattcttcctgatgccacagcgggaatcaaattgtttcgctctaaacaggtatgtgtaaaattcattggtgccacgagcccattacggggcttatgctattgtgcatatctaattgattcggggtgtctagaaatgaagttatatagaaaggttttcttttaactacagtaagaaaggtatattcactacggcacatagtccctctatctaaaagtctaaacatatttcattttttggttttttcaaatgagttagatatatttttagtctttatgtgttaaattaaattattgatcagaatccataaaattattttaatactcattggttgcatctatatatattgtttagataatgaagatgatttatatcttcagtctctgtcaaagtcaataaaagataaaagaaatatacatgcatatagtttcttggttttattatatgatggataagttaatttctccttaatcttgataataaaagaaatatgttttaaagatcaagggagtatgatttagtgctagatttcagtaatttcgtaggattgaccgatttggcgcggacaaaagaggagcaaagaatccaagtatgatcctgtgattactgtgattcacgttttcgatttgttaggtgctctttccttggcatctagtagtgtagcaagaaatgtaccacaacgaagaaaaagtcacattagaagctggcctgggaagttttctccgcgtgattcagggacttttggtcttgtcaagttaaaacaaaactaagggtgtgtttagctaacgctaaaattcgaagtttggttgaaattaaaacgatgtgatggaaaagttgaaagtttgtgtgttaggaaagttttgatgtgatggaagtttgtgtgtaggaaagttttgatgtgatggaaaagttggaggtttgaaaaaaagtttgtaactaagagccccgtttagttccccaaatttttttccaaaaacatcacatcgaatctttggacacatacatgaagcattaaatatagataaataaaaaaactaattacacagttagggaggaaatcgcgagacaaatcttttgagcctaattagtccatgattagccataaatgctatagtaacccaaatatactaatgatggattaattatgctcaaaagattcgtctcgcggtttccaggcaaattatgaaattagttttttcattcgtgtccgaaaaccccttccgacatccggtcaaacatccaatatgacattgaaaaattttattttcgcgtactaaacaggccctaaactcggcctaactgcagcatattagctgtataagagtactatactctattggtgggattagttttagaacaaatatattgtcccatcaatcctttcacttatcagctcacatggagaattattctcttcgtacgatctgattggtgtgggtgtagagtcccatatagcagagcagggcaggttatgaatttcttttaacattttaaaattttaaaaattaatataaaccttttagtcacgccagtctcattggtgtggtagtgtggtgatataaaatacattgacaatataattgtgttgtttcgtcacgctagacgaagtggcatagccaaaagaaaatatttttttactataataaaaaattaaaattgttcaaagaaaaaaaatcaccgattataaggggctccaaatacacgagcaagcgtgagtaaaccaaattgcacgcgagcccctccaccttatactttttgtccatagttcaagacaatcttcacgtgtaagttgcagctgagattataagatgactggcgattgcgatggtgctgacataaaaaacattccccgctcctagtctcccacctctcctccctctaccctcaccctccagtgcttgtcatcttctcttcttcaacagtgaaaagttggcaaactcaattcccgcaaatgcaatgctaacaaatctcatgacgacctctcctccggctagccagtcatggcaactaggtgagctatttgtctcatcttccctcctcctctaccccctcccaccttctatggccaatagcgccaccgtcttctcaccacagcaacctccctacccattgtcctagctggtcacgctctttcccatgcaatgaccttgcacaccgttgtttaccaactgcggctgagccacgacggtgctcccgcacatacctataggtttttgtttgtcacacatgagggttcattcattaagattcttgtggctatgggggctttgtggcacacaaataaaagggatcagttgtgcatgggggaagacgttggatgttgtcatgctagtgagctcggcgaagcctcctttgttaaatcctcatagttctcgattgtaatcgctcgtcctccagaactgcgtagccaagcctaaccgacgagcggacccatttacactttcatcttcgctttgtgtaaaagggtcctccagaactacgtagccaagcccaaccggcaggcagacccacttacactttcatcttcggtttgtgtaaaagggttaacctatgagtagtatggttgccacacatgtatacgttcgtacatccaatactagtgccatatgccatgccatgtgccccacatgccctagcctaaccgatggacggtcccacttacacatatcatcccaattacattttcatcttcgtttcgtgtaaaagggttaacccgattgtggtatggttggagggaggatgccttataaattggttccagccttgataaactagcaacgtggtattaaatgtgcgtgcactgctcttatagttcacacatgccaaatcctaattaagtcaggatgtcacatcgatcaattcccccagtctcttgggcctccaaaacactgctggcttgagctctactaatagttatatctaatactcgaacaagctgtaagactgtctgaccacacttaggcctaggaacggatataggagtagggtagttagggctagagcctctactccttagcctaaatacccattgaaattgtgatttaaaatttgaaaacaattaaaagataaaaagataaactaatgtaaattatactagttcagccctacttttgagaaaattttagctccgtcactgcttggggcaagggctgggcagcatcaccgattttttcacacccaaaagtgaaaacaggaaacaccagagatttcccctgaaaaagaaaaaaaaacacagtagagatttgggccgaggttgcgctggatgcggccttattcgggccgagtttgttgtacagtctgcccttttataggggaataagttcatctgagatcccttaacttgtcaacgaacccaattttcattcctcaaccggaaatccagacacaacgagtccctcaactattcaaaccggtgcagatgaggtccctcgacggttttgaggccggttttggctgacatggcgcctacgtggctgatttgatttggtcttcatctgacgtggcactgacgtggcgcttaagtggcaatttgatccggaaaaataataaaacccatgggacccacatgtcaatttcacacacaaaataataataataaatggtgggacccacgtgggccccatatgtcatcctcactcctccctcctctctctctctctctatcctctcccttctctctctccggccgatggagcggggccagcggcggctggtagaagcgggaaacgggcggggcggagcggctggccggcggatcggggcgggcagcggccggtgcagcggcgaggctggatgcggcggtgcgacctggcgactgggccgaggcgacggcggcgcgagccttggcgatggcggtcgggcgccagtcggcccagtgcggtagcggcctgagggagcccaggcagtgtcaggcgaatggggagagaaggccggcgcgagagccagccacgccggccggcgaagttgtatgcggcaatatggggaggagcagaagacgaagtggctggacgccgtccatggcggctagccggctagggttcactgtgtccggtggcgagaggggaacacgagagtggtaggaatggattgacccgagaggccgagaccagagtgagtccacagttctgcacctggtttgccttgcctctgctctgctccctccaaactccaaattaacagagagaggctctccgctttgcaaattttggaggagatggagctccatcaccatggaagcagcagcgtctgaggttaggtacctaccattgtctcccccttccctgttaatctctagtattagccaatgcgcataaatctttctcttgccggaaagagttcccactgtgatgatgatgatttttggcctgaattttggtttctgcttctgttcttcaatttttttttctcatatcgttgtgcttatctaagacccacattgctgctcttctcgaatcgctttttttcttccccactttggatttgaactgaatcttgaggagttttagcattgtaggaattgaatctccagagttcctgcagaaactcaaaacatgcaggttcttatagcaaatcaatacaacagttctagtgagttgtgtctttgaatttgttcttcaggcaaggcaagctgccgcccagccgccgtcagccgggcacggccacgtcgacgcgcccgctccgagcaccgccagcggctgctgtccttccccctgccgccaagctccctcctcaccgcgccggccttctctccctcaggcctctgccgcgctgggctgactagcgcccgaccgccgttgcctcggcccggtcgccaggtcgcgccgccgcatccagcctcgccgctgcaccggccgctgcccgccctgctccgccggccagccgctccgccccggatagagagagagagaggagtgaggagtgaggatgacatgtggggtccacgtgggtcccaccattttttaattattttatttgtggaactgacatgtgggtcccacgggttttattattttttctagaccgaattgccacttaggcaccatgtcagtgccatgccagatgaatatcaggtcaaattagccacgtaggcgccatgtcagccaaaaccgccctcaaaatcaccgagggacctcatctgcactagttttgatagttgagaaatccgttgtgtttggtttttcggttgagagacgaaaatcggattcgttgacaagttaagagatctcagatgaacttattccttttataggtggagcgaaacgaaacagaaggcaaagtgctctctctacataccagttcgaacctgcgagctgcgactctgcgtggtgaggaattcttcagacttggatggcgaggaccagaaccaaccaaggaagaatttagaattccaaaatcggtcgagccggacggttgcgtgctcccgtgcgcccattattcgcgttgaatggaatttcatttaagatttccgtcatccgttcaagatcggctgcaacgcaggcctcgatgacccgatctgccgctgctgctggccatgcatttcccgggcaggagggaacgaggaacaaggaggaggaggtcgcgtgcacgggtagcttctgcgtgcatcgtgcgtacgtacgcgagcatctcttttctgttttgtgcggtctccactctgctgtttcatcggtactacgtgccagctaactcagttgttgcacgtctctagaattttttttttttttgcagaatggaagtcttttcttcgtgatataataataagttctttgacagattaatttgctagaggatctatgcttgctcggtccactactctagataatgatagtggaggctcttgaccgcttgaatgtatgaaagtatgatgactttctcccgcacaatttaataatgtagtttactccctccgttctaaaataacttaatttaaaatgagatgtgatgttcagattctttgttttaagatgaatcatatctcattctcggttgagttattttgagatggatagggtatatatctgcttgggttagttaattccattccgatttggcacgtggaatctaattacaaaatccttgactttccatgcatgcgtagtcgattgagtgctgttgcaagtattgggtgggtccactcaagctgaccgcttttggcctggatattggatttaggataaatccagtgctggatcaggtctattaacagagctatggtattcttaaaagttcttaagcactaaggttatagcatgtggtgtccaaaccgctaaggtttaaggattcgacctgactactgttcacagttaatttcttgttaatgcgccgtgatagagtggtcatggttatttgttgggcgtgttcgtccaaatgtattaatcgcgcgccatgctagtataactcaattaatttacaaccgtacacgtcctcgactggaatttggaaatgttggagaaatcatagaattgaactccgaagcatagttatatatactatagtgtattttaaactctcgaggaaacatcctctcattatttacatgtcacttaaatagtcatgaaagatttttaaaaaaatatattggcatgtaatatattactcaaaaatatgcaagttaaaatttaacatctacatgtcacaatgaaaaaacaaatttaactgtgaatatacattaactagatgtctagatatagtttaatttgttttttggttgatatttgtagaagttgaatttacacttacatatttattgattgatatatcacatattaatacatcttcttaatttttatagttagaatagtttccatagttacacgcataataacatatggctgatcgaacacgtaattaaccgtgtttatcttactgaaagtcatcgttcatatatatcaattcataaacccagttgtttttacttattcaaagatcgataacataaacttatcctcgtttgcgcgtgcaaacttattcttaggtacgtatatcacggttacatccacacatgcatcgatcatacaaatcccaagatcatcagagatcgatcgatcagccgcgcgcgcgcgcgcgcgttcgatcatgggcagaagacgacctggtagttggtgccggccgggcaagtgtaggtgctggaggcgtcgtccttggggtagctgtaggcgtccgggcacagccgcttgaagaactccgagtagttggtcgggccgcagctgttggccgccgatccggtgcagcagtacctgtcctgcctgaacaccgtgcacgcgttgttgcacccgccgggcgccctcagctcgctggggcactgcggcgtgatggccgtggcgcaccgcggcccgcctttggggcacccggcgccgctgccggcggggaggaaggccatgggcacgttgaagccgtcgatgagggagatgtcgaagaagtcgaggttgttccactggttcagcgcgaactcggccagggtgttgggcgccgcgccgtacgccgtgcaccgcagcttcccgccgcagtcgcccgtctggcactgcccgttgccgctgccgtagaaaccgcagcccgtgcgcgcccacaagcgcccgcccgtcgtcccggccggcacgttgatggtccacgtctgccccgggtcgagcttcgtgccgccgcccgatggcacagccgccggccacaccgtgtactggcacctgttggtgatggcgaatgtcgcggcgtcggcgatggagacggcgacgaggaggaagagagcgagggtggaagaggtggcgagggaaggcgccatggctttggtctttttggtcagaagaggacggctttgttgtttgaactttgaagtgggcaaggatcgagctaagctgcgggtggatatttgtagggttgggtggagtgcaattgcatctcttgatttggcattgccaacgtgcactacttaaattgtattatccatgtgtaattggccatcgctgtggtcttttccgtcagaagagctgaagaggagggctttgccgcttgcagtaaggattgaggaatctgcggcctatagggtggacaatttatagggctcaatttcgtattcccaaaacaaatcgcaccctcgaattggcattagcaacgtacattgctattttattacgagtattagggtgttgctcttccgggtccagatccccctagagttagctacaactccaccaggtggatttgactaaatccataccatcaattatttcctatggctaagatgaagccacttattaacttgtcctaattaactccctcaatcacatatgcttgaatgaaaattacttaccttttcttcctttttatgttcctagtgagtatgtttctgccaacaacattaacaaagtatgcacgctctcttctccaaataagaagctatggtcatgtataaaaaactatgttaaacatttagtacgtgcaaacatacataaaccatatacacacaaaaatgttgctaaaatattatagccacaaagcccaatacgatttttatactgtggatgaaccatgaaatttctaggttatgcaagtaaaatcagtttgtatattctctagatatatatatagtattcgttagatttgttacaaatattaagatgcagaaaaaaaactattaggaattagttacttcatcccaaccattcttatatagagatgacagagatttcatcaaatccttcggatggagttggagtgaactccaaagcatccccacccgtactcttccctttccattcccaactcatatttcttgtttttcgcgtgcatgttttttttaaaaaaaaattctatctgaaagttgatttcagaatcgtattattttattttttttaagttgtgtttgctaatacttaattaatcatacattaataagccaccacatttccgtgcagaacacaatcttagagtgtttatctcttctctactattataaaaatttgagatatttttatcaaaattttggtgcgtagtctgtgtttgatttgatttttagctggttgtaagtcgcttgtatcaaatttgatcgatgtgaatctaaaataactatcacacaccccttcccagctcaactcaacccaaccgacccaaccatcccgccattctgtcgtccacgcctataccgtaactcggattggattgtgcttattccgcagcaacttcaagcctcgcgtttctccgtaaaagggcatagtctatccccacttccacaacccccaccttaggtcttaggtcttgttcggttaactagcatggtggcccgcgcagattgcgcggctagcatcattatgttttctcttatataatagcatatatgttttctcattatattattaaaatatattacaatgacaacataattttaaattttgtaataactctacgaaactactaatgtgtaatattaatattgtattttatatacgtgttagttattaattatttttaatatcaaattttagttatttgtaaattatatatattcctatatggactctagactcgtattttaatatttctttttttttaattctgaatttttattatttctaattgtatttctatgtggactctaaactcatctttcaatattctttaatttttaatttcaaatttcagttacttctaaattgtatttctatattgactttaaactcttcttcccatgtttttcttaattttgaattttagttatttagaaattatatttttatacggactctaaactctacttttaattttattatatttattccgaattttagatagttttaaatacctatattttttaattccgaatttcagttattttctatttgtatttctatatgtactctagtctcctcttctaatattacttattttttaattccgaatttctattttttttcttaattgtatttctatatggactctatactctatttctaatattccttatttttaattctgaatttctattatttcctaattgtatttatatatgaactctatactctacttctaatattctttatttttaattacaaatttcagttatttcctatttgtatttttatatggactctagtctcctcttctaatatttcttatttttttaattctgaatttcaactatttctgaattgtatttctatatggactctagtctcctcttctaatattccttattttttaattctgaatttcagctatttctaaattgtatttctatatggactctgttttttctttttctccgattaatgtgagaatttctaggccatgagagcgaacgtggaggctcctttttctatcctttttataatataatagatagatccttgtgagagagagattggaagggatttattccacacctattatggtgtgaaaatattctccatcaatcccctctaatcattttcaatcccctttaaaccaaacaaggtattagggatgttgagatgctctggacccatcgttggagcgcggcgtgcaggccacccctgccgcgcgtgcagctccggtagcatattcagcggtggcgccatctacgagctctgccacaatcccacagagcgcggagacgcatggacctcctgattgtgcattgcaaaatcctcgccgctggtagtgttcgttttcttcctcaacaggaataggtttcgtccgtcgttgttttgtctttgattccaattcatcttcgggtgtccacgctagggcacgggccatagcagtaggccagtagcaggttgccgccgttgaaaaaaaactactacgtctgtttcaagttacaagacgttttgactttgatcaaaatcaaactatatcaagtttgactaagtttataagcaaatatagtaatatttataataccaaattagtttcattaaatcaataattgaatatatttttataataaatttgtcatgggttgaaaatattattattattatttctataaacttagttaaatttaaaatagtttggctttgatcaaagtcaaaacgtgttgtaacccgaaacgggtagtaggacatatgccagcgccataaagcaagctacggatctcgcctcgaagcggtttccggctttccgccggctcaagagggtgcgctggtgcaggagcgcaggacacggctcggggatgtcaacgagggtggcggcagatggcgaggattatggtcaggctggaggagcgtgcgtgctgaaccggaaaagataaccaccgtcgccacctcgtagtttgataggggcaagggccgcacgcgcgtgcgcatgccggagacggatcgtagccgtgctgctgcatacgccgcgccgctgtgatctcagatatgtgtcgcggtgcggtgcggctggtcccaatccaaggaaagaagggtgcaaactccacgtgaggtcagtgtgtgagacgttgaactccttatcctgatgcgatattcatagtttgccccaaggtaattttgtggttctgaattatttcttttttttttacttttccatgatagaatatgtggtctttttccaaaggcaagatgcaacggtttccgcaagtgaatgatgcacttccatccccagatgctggtgctggttgcaaatgctggcaatctgttgcttggtaaggggtcttttgctctttaaaaatgctgaacaactcttgattgtgcatgctatggtaaaaattccttcagggtgatgatgtttctttctttctctctctctctaacagaaatacattcttcatttttaaaattttggggagccagaagagagacgagtacatagttgaatagtaatcagagaaaaacagtagcctggggagggagagcctctcccgcagttcatagagggtttccaaatctaaattgctagaaaaggaacctggtatgaaagtttaatgaaaacgagataagaaacatctctgtttgatctttctgcattccttcgttgaattgttgtccaaagggagcacgacatggccatgttgtcgagcagcaagagcaacgtgacaatctccacgcattacctcagatcctccgatggtccaaccataccttagcatggtcgtgtaccacgtcgaccactgctcttcatccaaatgtgctgccacctattcctcacggctagctcgaagtcgtgtctgagcacgatccagctctacatagcggagcacgaatttgcccgagtgcaaatcctgatcgagtgcttctaccacctgtcagctttgagcttcgtccgtaccgtcttcacccatcacaacacatgggtattctcttcccaaccaataacaaccctccactattcacttttctcaccaacctccactactcatccaataatagccctctactacttacttctacctacctttttaataaccatgtccaactctaaaacttcttatattctgggacggattgagtaataaattaacaaaatcaacaaaccaaacaatttgaaccacagcaggcaaatcagtgcgattccttcacctgacgagatcccgaccgaaaattcacacaaggataggtgtaaaaccgcaagaatgtggcaagggactaatgggtgcaactgcaagcacacacttggaaacccaacaatagaaatcatgtatcaagaccacgaacagacttgcagacatcagagtataaccagccagaccaaaaactttgaacaccactcctcttaaaagacttcattccttccaacatgcagtactaacttgtcgtctcaccatctcttctgttcgtcaggaggtcgccatcgagctaacacaaacatcttgtcagttcatgaacggttcaacaaggaaaacatgaaaattgataatgacacgatatgagaaataattgttacctcagcgaaagacttcaatatcaccagacaaccgtactgataaagtgataaatcttctggtacatttacgcacatgaaatagaccaacctattaaataaaaaaaaacatttatcgttaagagttgtaatcaataacaagtgtacgaaaacaatatgtacaagaagtggaatggatgcctcacaaaaaagggggcaggtgatctctcatatatatatatatatatatatatatatatatatatatataactgagttacaatgaatgctagagagttaaaaaaaacaaaggtctaggagattaactatctaggagataaacagcctatagagtaataaataatcctaatacccgcccgcagtcgcaacgggaggatgacgaacgcaaagactggactgaaattcagtaaataactgaactggtaagcctttggtcatgatgtccgcgaactggtgtgatgaaggaacatgaagcacccgaatttgtcccaaagccaccttctcacggacaaaatggatgtcaatctcaatatgcttcgtccagcgatgatgcacaggattcgttgtcatgtaaacagcgctcacattgtcacaatagacgataatagccaaagcaaccgggacatgaagttcctggagcaattgccgcaaccggcagcacttggcgacggcatgggcaacaacacggtactccgcctcagcactggaacaggagacagtagtttggcgcttggaggaccaagaaaccaaatgtctccaaggaagagacagtagctggacgtagaacaacaagaattggcacaacccgcccaatccgcatcggagtatgctgtcagggactgaaccggtccggagccgatgtggaggctggtggagactacccttcacgtagcggaggatacgcctgaacaaggcgagatgctcccgcggatcatgcatgaagaggcagacctgctaaacggcatatgccaaatccgggcgagtcagcgcgaggtactgtaggacgccagcgatgctcctgtactccgaagggtcggcaacgggcaagccgtcagtggtggagagcttggcacgagtgtccactggtgtcgaggtagagtggcactcggccatgccggcccgctggagaagatccacagcatctggcgttgcgagaggaagaggccgccaaaggaaggcgtgacggagacgccgagaaagaagtggagggcaccaaggtctgtcatggcaaactcggtgtgaaggcgcgccgtaagctgctgaagtagtggtgtggtggaagcagtgaggatgatgtcgtcgacgtaacagaagataggcaatgtgatctccatctttgtaaacaaagagaaatgtatcagacgctgaaggcataaatcccatctgtcgaatgtacatggcgaatcgttagtaccacgcacggggagcctgcttcagaccatacagggacttctgtaacagacatacagcatcaggggcagcagggtcaacaaacccagagggttgctgacagtagacggtctccttgagctgaccatgaagaaacgcattcttcacgtcccagttgatgaatcggccaagcacgggatgcagcaatgctgagaacccgtattgtggccggcttgacaaccggactaaatgtctcgtcttagtcgatgccgtgctgctgtgaataaccacggaccacccaacgggccttgtggcgggcaagggagccatcagagtggaatttgtgcttgaagatccacttgcccgtaacaacgttggccccaagggggcgaggaacgaggcgccaagtgccgttgtcgaccaaagccttgtattcatcggccatagcagtacgccagttgggataagccaacgcgctgcgatagttggccgggataggagagacggtggcgtgggtagctgtgtaggtcagccggtcgaccggccgcagggagccagtctgggagcgcgtcaccatggaatgcagctgtggagcagcagccgtcgcagtcacagtggctgaagatgatgactggaccatcggggcagggcgacgggtgtacacatggtggaagggtgacacgatggtgccggctcaggtggcaccggccaaaggggcagtgccggccaaggaggcaccgaccgagggggcaccaatggcatcgttgaccgcggtgaccgtgccgtccggcaagcggcggccgaagagggggaaggtacggttgctcaacctccacggagggagccaccgtaagggatcgcggttgctcgggagccactgtgagtggttgcggttgctcgacctctgaggagggagcctccgtgagtggtcgcggttgctcaacctcggaggaggaagcgactgctggagggaatccctgtaacaaaaaatcaaaagacgaggcagcagtgggagtcgccgcaaagggaaagcgggattcgtcgaagacgacgtggtgcgaaatgatgatgcggcgagtggagagatccagacatcggtatcccttgtgggaggccgggtacccaagaaaaacgcaagctgttgaacgaggggcaagtttatgtggagtcgtggcactcaagtttgggtaacaaagacagccaaaaacccgaagatgggagtagtctggagtggtgagatgtaggagctggaaaggcaaggagtggtgaacggaggaagagggtctccggctgagaaggtaggtagcggtggcgagagcctcagcccagcaggacggaaacatggaagcctggataagaagggtgcttatggagttgttgatggtgcggagcatccgttcggctttaccattttggggagaggtgtaagggcaggagagtcgtagctgggtgccacgattagtgacaaaggaagtggtggcggtattgacaaactctccgccattatcagcctgaagggatttgagcggtaagccaaattgggtggaaacatactcggcaaactcaacaatatgacgatgaacatcagatttgtgtcggagtggaaacgtccaacagaaatgactgaaatcatcaagcaccacaaagtaatatttaaaacccgaagtactcaacaccggagatgtccacacatcgcaatggacaagctcaaagggaatgaaagtgcgagacaaagacctatcaaaaggtaatcaggtatgtttgcctaactgacacgcatgacaaagagaggtgtctattttattataggaaatggaggacatattccgaagactctggatggtggctgcactaggatgaccgagtcgacggtgccaaagtgtggataaagtggcgagggagcagtgggcgctggagggagtggcagctggaagggtgtagagttccccgtggctattgcggcgaagaatcacgcgccgggtcagaaggtccttaacagagaaaccaaattcatcaaactcaatggaacatttattgtcacgagtaaactgacgaacggaaagtaaattacgaactaaggagggggcgacaaggatgtttttagtgcaaatttggtggtgcctatgggaaggaatgaagtgccacgacaaataacggggatggtgtgaccatttccaacagtaataaaagtgtgggagttaggcaatcgagtaacgaggataccgtcagtagaggacatgagatgttgcgccagtgtccaaaacctagttgtttgggctttggaaggccatctggttcaaggattcaatgaggccagcttgctcccaattgggctagcctggaggaacagatgtgggcgacatcgatgggccaacgaaagtggtgctcgcctgagtagtgggccgccggagccggcccaagaaggccgggccctgggtctggctagcctggaggaacagatgtgggcgacatcgatgggccagcgaaagtggtgttcgcctgagtagtgggctgccggagccggcccaagaaggccggcctgagagtagtgggccgagtggggtggc

SEQ ID NO: 8303 - DNA, 12569 bp, Oryza sativa
ccggccggcctccagctagggttggccaccccctggtagccaccgccaccagcaggaggaagcgggcagccgctgccaccacccccactgccgctaccccatccgcctccagttccggcccctccattcccgccaccgatccagctgccattgcccttgccgctgcggcggctgttgttgccgccagtgcatgcttgacctccggaagaagcgcagccgccgggagggcaagaggagccggagcccgagctggcgccggtgaccagcgccgtcgccgcggccaccttggcctggttggcgatgcgcaactccttcaacaggagggtgttgagcgccgatgtgaagctcgggaggacgtccgcgcttgcgatctgatcggcggtgttggagaagcggtcgtttagtcctcggagaaggttgagcacgagttgggacttggagacggcgtggccgacatcgcgaagggcgtcggcggctgtcttcatcttctggcagtagtcggcaatggaggagtccccttgaagcatggaatgaaattggtggctgaggaagatcgctcggggttctttgttagcgtgaaacatgtcctcgatggcgacccagagctcccgagcggtctgatctagctccatggcgaggtcaacgacgttgtccgtaactgatccgaagatccaactacggatgcagcagtcggcctgttcccaggccgggtcgtcagggcgtggaggagcggagccgtcgatgtgagccatcaacccgaacttgccgcacagggaggtgaagaaggccctccatttgttgtagtttgggtggttgttctccagggtgatggggacgtgtgatttgacggcgacggtggcgtagggatgaagaaactcgctagtgatgttggaagaggatccaccactggaggatgatgaggtagaggactgagtggattcagttgacatggtggagaacacagttgcgacgacgacgtgctagagcagaggaaaagaaggtaagggcctatgctctgataccatgtagaagaagtggaatggatgcctcacacacaaaagagggtaggtgatctctcatatatataactgagttacaatgaatgctagtgctgagttacaatgaatgctagagagttacaaaaaccaaaggtctaggagattaactatctaggagataaacagcctatagagtaataaataatcctaataccagtatatggttttaagtgtattcattaagtacacggaaatttaccttgatatcaaccttagagctggagtcgttaccctcctcaagatatctctcaccaatactgagcaatatattctccaactaacacaaaaggattgagtcaaatttgtattaaataaactaatgcacatgctacctatactttatgcctttttgtttgaaagagctaatttagattttgaaatattcaaataaagtcttaaggatgtcaattgctacctggattatacttgaaatgctttctccctggagagagagagaataatatccccaactcgaatgccaagtttctcagcagcacattcagctgaaacctaaaatcaatccagaaataatacaatatatacatgaaaatattatattatatacacataaatataaatagatgtcataaataaaaaagttacctctcctacaataagaccagaggtaatattgtatttacgagacagcaactcaataagcgtcatctcttgaaaatccactgttttaaacttcaaaccaagctgaggtcgaacaatttgcctatatgaaattattagactattaaatttattttatataagataattatatctaaagtgaaatattatacacaaaaaaaaacagcagttgatgtgttttctgtaaacatgatggtcagatggtaataattactaatttatactagctgctgaatgccacttggttgctacagatggcataatcataccacataataagtccaatatacaagaattatagtgtatcacatgtttagggttgtagaagtgcatgcctaaaacatataaatacatttcactttgcatctcagtcagtacttgttgatgttgaatagaggccattacaaacctatccccacattcttaacctgaatctaacagtctcacacctatcattcttaattcagcacctcacttgtatgtatctgtctgtgaattctaccgtacatttggttttgagagcaaatggacagaggtattgtgcatatgcatattaagttggcactcatttttatattatataaaatataacatactgtacaggtttaaatgtaaacttgttgaatggaagggaaatagtttgtgctggcagcataagtgcatatctcaaactaatgtcctaagtttctgaattaagcaagtgtatatagccaactaggatgaacaaaaataaaaatgcctacccaaacttcttccacaatcttaggcacgtgaggatcagggagctcggtaggaatgcaaccatgggcaaggtgcagaataacatcccaacagtgtttccactgaaatctgccaatgcacctccagtaccacactgcaagcaaaatttaaataccacattgagattatagacaagtgcaactaactatttagaatttaaaattttaaataccatcattaccttgggaatggaaccaccaatgaacatatagtgattgtgttggtgctcatacggatctaagtacttcactttgactgttgtgcaaatcaaatctatatttatgtctctggtgagcacacagaaatcctggccatattccaaatcagatttcaatggcataatcggtatagttagccctcctacagtttcaaataaggcaatatcgaaatgcttgctgaagtacagcaatcgacacactgagatcgtgtcatccaacatgtgaacagtgacctaaaataataaataaataaaaagagtaggttaaaaacacttaatgtggaagatatatcacttatactattatgagctatacagtttgcatgttcatttcttttacaaatatagtaaagcaaacaacaccaagcaggatagagcatatatggagcatgtgacatgtctgagtttaataataaaggagcaccaaatatacatggagcatgtctgagtttaagaatcaagtaacaccaagcatatatggagcatgttcgagtttgagaatcaagaaacaccaagtatatatgaagcatgtctgagtttaaaatcaaggaacaccaagcatgaagtaagttaaccatgtggagaatactaagtgcctggctgtttccgtggattattaaaatcaacagggggagtcctttgtattgtatatacaatgctcctacactaatacagttctcaataactaatgatcccaaaggtcaggtcagctctaaaagacactagtttcatgtctatgctaattctgcacaaaagattctcctctagtttaattgttgattctgcatgtaagattttactatcaagattcacgactgattctgcaatctgcatggaagattttggacgttgttcatgtgaagcactattctaccatacaaacacatggctagctaacataagaaataaaagatctttattatgctgggtactttatataaccttgtacagcaagtagagtcaatgtctaagctttaaggtaatgtgcaattatgcaaccaacaaaccagggtagaacatcccaaagtttaagatcaggtcatctctcaaatatactctagtttaatggctaggctaattttgaagatgattttccttcagtttcatgattgattctgcatgcaagactcaagtttcatgaccgattctgtgatctggatggaagcttttggatgttattcgtgtgaggcactaatctgccatgcaaacacctggctggctaacatattcaataaaagatttttgtgtcgggtactttacataaacataaacaacaagtagtgtcgttgtctaagctttaatgcaactatccaagcagcaaccaggatagaacatccctttagcagaattgaattaaaaatcaaggaacatatcaataagtaaacacgaagtaaactctgtgaacaaagagagcagctagacagactgcaaatatgatgcgtaatttggatagaattaataatgcataaaacacagcaacacaaataaatgttggagagactaaaaatgtgcttgattggcggggatcaagatggattgggtgatacaattagcttgtttgtttggctggatagacgataaagtacttgcaataaatttttggtcaagtgaaatttttaattatgtataatatgtatcgtgtaatcaaattttgtataatttctatgaaaataaatttatagagtatttttgtctttggcagtaatatccgctaaattttgttgcctcttgtatgcatatactccctccatccacaagagttagacatattacttttgtcaccaaaaccaagaagaaattaactcatcttacatgtaacaaagaactcatcttacatgtaacaaagatcaaggagcctatgcatgcatgcatgcaaccaatgagtattaaaatggctcattaggtttcgattaaacatttaatttatctcttcatttaagtcttagatacatgaaaactacaaatatgaccaacttatttggaaaaaaacaaaatatagaataagtctaacatttgtggaaggagggagtacatttttttctcataagtgaggtactgaggtacgattttcttttgcaggtagttgtgacatagtgagaagcaacattaacgagtaacctccttttcttcctaagcttcccaacttatcgacctatatgaccaacacgcaatgcaagaaaagattgtttttttcctgtataaaatgtaatctaaaggttatttctaagttctaacttaggaccaaaaacctgtgtgcaaatgcacagatgaacaatcaaaagaaatagatagcaacatatacagggcaatggcgggtggcacacaaggtgagaaggggaggtagctatggcacacaaggtggatacaaacacgcaaggggttaggagcaacagcatctatgcactgtgtcattgttttttttgggagggggggaggttgagacaattctgcatctagagagaatatcccctaaaattagaacttaagcaacaaaatgcatggaacatcattaaaaaactggatgtgaccatcctattcatgctaacacctccaactaagcaaacaaaaatgttatagctaggagcatgttgagattgaagtgttctaccttagcctcaggagcataatctttatgcgaccaatcatcaaaaggtttctttatgcaaatgagccaagcagaagttaaaatgatagcagaattcttcacttcatcgcactcgataattataccagttccctgattaatctctctaccatctacatatacacaaaagaagttagctaaaaagcaaccgacactaccatcaaataaaaaagattagtcgaagaatatataataccgtgataagctgaaaggctcacgatggatttggaagcatttatttgtgttttcttctgctcgggattatagtgttcaatagcagcagagattgacgaccttactgtcggtaatagttcctggcgtgctataacaaagacatgtgaaattcggtgagcttgaataatttttcaacaaattgcacgttgcgcttggtagtattatcactttgtattaaaatgtgtcacataacaccaggataaatcatcaaacctatagaaatttcataaattctgaacgaaacttcatgaaatatggtctaaatttaagaattccataagtttcaatcatattttacaatatcactccaattttgtgaagcaatctggtgcatagtagaacttatataccctggtgtaaagcgaaagcataaactaagcctggtgcacagttaaataaggtatgctttacccagtgcaagtgcaatttacacacaattttttgcaggtaattccaattttgttttgctagtttatcctactactaaaggacagcatacaacttatacctttcaacttggataccataaggcaaaccttggaaagttttttaatactagagcagactgtggattgatgcagttcagccttacattaaaatagtacttggtgtaattattgtgcttatcacaattttggtaaaaacagacggacaaaaagcgtacctctcttgttcttgtactcgtgaaaagcccaatgataggcttctgcagctgtgggatcatcggtgatgccatacaccacctctccagaaggactcgtccacataggcacaagtggagcttgcggttcacgcagcggagagctgtatgaggacgacaccgagcccagatgctcttgtgctacctcttgcttctcttggctcttgtcctcggagccgccttgacctctcttattccttttgccccgcttcttcttctttttcttcttcttcttcatgctcttcaagacgtgcagattatactctggtttgccctcggttgcctcaggatatgatgcttcccctggacgtgatacttgcacggaattggcttcccgagagcgagcaaaccaatacattttcttctttggcagagatggtatcctctccgggcatgtcctctcttcccaggggagctgctgcaatgacgatgatgccctcccactcatcggcgacgatcgtaccctctccgggcatgccccctcttcccaggggagttgctgcgacggcgatgatgccctcccactcatgggcggtgattgtatcctctccctctccctctgttcccaggggagcagctgcgacggcgatgatgccctcccactcgggggcggcgatggtgtccttgcctggcacggcggcgaagggaggtgctccgggcttgactccatcccagtgccaccagtcgactgtagttggcatggcacagacgacggcggcggcatacctgcaagggcccagaaggggttctcccggtcttcgtagttcgccgttcttctggtccgttccctggaaatccacagcgccctgcgcgatttcatccttgccggttcgaagcgctcccgcaggccgacggcagcggaggcgattccggtggaggcggcggatcggagctcgcacaggccgcaggccgacagaagtgggattagggtggaggcggcgcttctgatgagttcgcgcagcctgcacgccgacagaagcggaggggattagggtggaggcggcgattcggagatcccgacggccgaagctttacggcggcggaggggaggcctttcggggttttttttccccctaggcaaagacgagaaaattacatacctaatatcatagcattatataaggttggattagctagaataacgttatttaaataggtttcgccgaaataacctccacaacccgagcgccttcgccaaaatactatattagacagaaatacacttggatcttcttccttctccctccaatgttccaatgtcggaagagctcgccggtggctctccccgtcaagcgtctaccctttttttaagcactacgaggcattgaggcttattaggtatgggcgtatggcggccttgtacaaaacggcgtccacgtgggttgcagccactgagttcttctccatgctgagtttgccaatgatgttatcgatgtcctcggttacgccatcatcgacgacaaggaaagggtaagcgttgaagccgtcctcgtcttcgaagtcaaactccccaaggtcgtcaacggtggcgtcagcctcgggtgttcggtcgccctgcctttgtctccacccatgctcgccgccatcctcgtccctcttcgccccgccgccgtcctcgcctccctctccgccgatgcttccacttttgtccccgctctcacccgtcgtcgtccttgttttcccctccaccactgcctacctgccaacgcccccactgctgccctcagctctccttcggcgctgcctccgctcccgcccgccaccctgcctttgtctccgcccatgcccgccaccgtcctcagctcccctctgtcgctgcctccgccccgtcgccgtactcggctaccctccccattgcttaagtgatatagagagagagagaggaggtgagggagagataagatagataggattggggaaagagatagaaaggatgagagattgacaagtagggtcacggatttaaaaaagaattgctaactggactaccgcataggatcaaaaccactttgaattgagttgagttgggaggtaatttatcatgtattaatagttgagagtgaaagatactcccttcgtcctaaaataagtgctgttcaagtccaatgtctgaccgttcgtcttatttgaaaaaaaatatgattagtattttattgttattagatgataaaatatgaatagtactccatgtgtgactattttttttatttttttcataaatttttcaaataagacggacgatcaaaacactggacactgatatctatggatgcacctattttgggacggatgtagtatatgattttcgggtctgagaagttaattcgtactcactcaatagtttagggacgtaatccagacttttccctttttttggctgatgtagtatgcattactatatgggcgaccactggcaacatggtcccacgtgcgcgcaacgaagtagacaatagatggccatatgacccgaggcccgatagccccgcccaaagcacggccatttggccccggcccaagcatggcatagcccaactagtgtcaagcctgtgccggcacggcccgacagttaggtcatgcctaacccgaggcatggcacgataaaaaaatactagagggatccaaaatatacttaataaaccatataaggcaaagcaaaaaaaaagaggaataaaaaatagacttatttctagccatataagacacattccaaagagttgagggacaaacaatagacttattttaggaagaagcacgatgtgcggtcgtgtctttaggctggccgggcacgacccgaatcttattgtactgtgtctgggccatatatgcagcccgtgggttagcacgacatggcccgactgacatcggcccaggcatggcctgggcggcccgtttggccatatatagggagaccatgagatgggaggccccgtagaactttccatgctccgatggccggttcgaaacggcgaccattggcaacatggcccacatatcagcgagtgcaacagagattaatccgccactgctctaactaccctctaaagtctgggagtcttgtcggttcgtcctcctctgcaagtcctctccggcgtccgcttcttttctcgcttctgctccccgccgccaccgcctcctgctctctccgctcgggtttctccgcggcggttgttagcgaggggaacgaggtatcgccggcgccgtggttcctgcgggtgagctctcttctctaaccctgcatgcttagccgacgtgccctacgagtgcttgcttgcggttgcggggttgtgggggtgtacccgtgacggggattcagttcacacattgcgtgggggcgcgggtcgattttgctgtcgcgggatcggttctgcgctgatgcgaccgcgccctgaatctagggctcgtgctaattagtttgtttggttcggattgttgaaagagagatacatctgtgtggttcgcctcttaaatggagtccttgttagaatctggttgcttctagcgccctgaatctagggctcgtgctaattagtttgtttggttcggattgttgaaagagggatacatctgtgtgtggttcgcctcttaaatggagtccttgttagaatctggttgcttctagttagattaccactttgatcgcaggaacacgcagttacttctggaatgtggaatagtttagtgcttgcctcttgatgtgtaggcagagtggactttaatttatactcttttaaacacaattcgttgggccctcggattcctagactgcttgtctccagacagtggcattgtggcaattagtctccagatatgtaggcaggagtgacattttttaacagagtaatctgttgatgcctggtattctagtttttctctgggctgatggtatgtttgtttacaaggatcattgaatggtggtatattattaaagcatgcatctgtcagtggtacaaacttgtatcaatcttaagcatatttggttatttgtcttaacatatttattcctcataagaatttggtggtcatgcgtagccaaggttaatggttttaagaattaccttcaatattgtggtatcagggccttcttaggcatatgcttgattccatcattccggagtcttagttgttttttctaagtctacctaagtgtaatcctcttttcttttcctctcctttggcgcctgctgccagtaggatgccgggtgtaaactcatttgctctcttgctaatataatgacacgtaagccttttgcttgttcgcagagaaacattttgattcctaaaattgtatatattgcttacacacaacttgtaatcttgagaatatcttcttaatatattccgtacttgtttgttatgtactttgttttttttttctcaagaattacatatgttttgtgttatatgatgtataacatgcatgaactaccacatttaggatggcagctccagacatgcccaaccggttctcccatattgcccatcaactggtgcatgcagagaagagggaatcaatattctttgtgaaaatggttagagtgcctcactgccatgctaagatagtggagcacctgcagaataaattccatatgaaaccatctgaagcagaaggcacaattaaggagcccttctttgctactggatctatgatttatcaggatgagaattttggatacattttgacctgtgctcatatcctcgaggatttctattcagccaatattgtactgagtaaggagcaggccaacaggtggttcaagtttctcatcctctgcaagcacaatgaagatcacatgaagactatccatcctgacttgtatgaatctgagcgtgataagcggaattacactgtagcaactgttttgaaaattgatcagcgtaaggatcttatgttgcttcagttcaatttgtccacactctatgccacccagtatgctcaaagatgtcgcttacctcatcagtcattaaagctcgcagaaaatccatcctcagcaccaaatgatgtggtcatgatctcctggccacctaataggcctgatactgttgtcattgggcaagtttcaaatcaatgccgcttattcaaccaactgacaacagaaagagataaaggctataatatgcaatttatagagctaaagatcaatgttgaaaagggagcatctggctcacctatactcaatcatgctggtgatatccttgcagtttatcatggccggattgaacgaaagggatatgctataagccatgacgacatttacgaattcctatacacgcgcaaaattctatcacagaatttgcgttaatgagagtgttcataagtgagttgcatcgacaacaaaacagctctctgattcttctaatgcagtcaaagtactgatttacagctttggttctgaagctattgattttcaaggacaagaaagtgtctacctggaggtacctgtgattactgttaggccggtcagctggtgcatacctatttgcctggatcaacgggagcgttgtctgccttggcatatgcctcctttttgtccctatgaatgtgatacagctgcagttcagaatgtttttttatcgaatgctgatgctgcagaaacttcatgttagttgtattccttatactaggtctctttttcctgctgatacatcccaaaaaaccacagtatagtagatggtacatccttattcaactctggatattttcctcttttgtaatcagatgctcagttttcactatctttgttaattctgatgggtacaatgataccccagagagagatggtacaatggtacccacattttcctcttgatatatctctcttatgcattggatctccacttttcactgtgttgcaactctagagttgtactcttatttcgacatgaatatttgaacaattcacttggcattgaattctcttcacaacacaactgtatgtccaactgcgatatattctgagttctgaacttattgtatgtcaaatccagaacaaattgtcctgtgcgcagtgtgcactttgttcttctgcagcttattgaaatttgtcgatgctgaacattatgcccctaaatgctgcgaagtaggtaaaagttatctggcaaactgtcagatttgatttggttaagcacaactatatatcgtgggggcagctgcctcttttatacagtaactagaaaaaaaaacccgcgcagatgcgcgggaaatttatttattgtttataaaaagaatactaaaataagtcatatctcaccatattttataagaaaattgattaataataattaaagaaatatttatat

SEQ ID NO: 8304 - DNA, 17331 bp, Oryza sativa
  unsure (1)..(17331): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggcacatgccacctttgcatctgggcccaccgaaatgaggttcttgtgtccaaagaaggccaccggttcttgggagaaaaagtagggcgtgtgaggatggaaacagcactgtggagcaagtggcatcggagtgagcggcgccggcggtcgtgggggacaggcagggcgtgtcgccgccgcaccacccggagctcggcagccgttctgaggtcgtcccgtaccgccagatctgcatcgccggcctggggaggagagcagcgcagcagcgaccacagcagcggcgacgaagccacggccacggccatcctcgcgccgcacccggacgagccgtcgccactggacgccgtcgtcgagactcatcgctgccacgctgctgcccgacgagccacggcgcgcgaggaagacgcggacgaggcggcgagggcacgcgagaggaggggaggccaagaagttcgccaccgtcgagtgccaagcccgccgccccgccgagaccgccgccgtcgtcacctcgttgtggagcaagtggcatccttgctgagaccgcggccatcatctcctcctagccgccgccgccgcagtagtccccagatccaccgacgctccgctcggccacccctgtgccgtctccgctcgccgctgctccgcccggccccgtcgccatcgaggccgcagctccgctcagccgccctagcaccgtcttcgctcgagcgtgagaggtgagatagggaaaggtatgagagaggggaagaagcagcgttgggctcgaggaaaggaagagagagagcggaaaggtggagaaaagaaaaggaaaactatatttttgtggacctcacttgaggtactgcattgtgaagctagtgtctatcaatgttcctcagcccatatggcacctcaggtccggtattttacgtgacgcactgctattgcccttaaccagatgacacctccgctatgaccctatcctcggacttgcctcaatccgcaatgcaggagtggcggaggaatcatacctgctcgagtcctcgatcccctgccaaccggtgcctatcgctttgatgcaccgtgcgtgccgcacgagctgtgaccgttagatgcgagtgagactagaggcgtggaaggaaattacctgatcagcgagtaggtctactgctcttgccagtgctgccctgtccaataggccatttttaccttgagacttgccatgccagctaggcggcaacggctatcaaaaaacaagttaggcagttacggtcgtgcgttttgggattcacacacgaatttctggtttccttcaaattactttggatttctatcaatcaaatcgattaaatttctataatggaatcttaggaaatcaatttgagggttgttggtcgtttttctccaacttgtagagtagggttccaaattgggtcaaaattaaagaagattaaaacacacaataattaaggcataagatgccaggtaagtcttgattttggatgtgtattttttttctaagaaacatagtacaacacatacacactcgtctctataaacacgggcgcacactcactctctttttttatgattttgtcccaacgacctacactaaatacaagaaaaattaaggtaatttgaggcaactggtcaggagcaccactacaccatgtcgaaaaatatagtatgttgtagtgtatggtgcgtctatatcaaatgggaagatttggccataccttttttttccgtcctccgccactgttaattgcagctccattgccctttcattctcgccctgcgtatatgtacagcgtgcccatagcttccccgtgcccccccccccccccccccccgagtcgccgtcctctctttcctctcttccgctggcaccgcaggaaggcttggttgcgacgggcgccacccatcctctcatgcctccggcggctagctctgaactgggtaacacttcagctccggtcgaacacccatcgtcgggcgctcactgctccgtcacagccgccagcgaccatcgaccatggcacacggcctcgacgtcacgcatatatatctgcccgccgtcacctgtctgtgtctgctcagtgctcacgcttgccgtggacggagcaaccacttgctgcaccattctccctacccatccaccgttgcctatttctgttgtatgttctcatttgcacattgcatggtaggttattggtcaaatgcttactcagatgatccaatctatacgttctcacactaatcatctataaaaacttcagcagccaattcgtggtgttagaattgttgaactggcgtctactactcttcattaaagctgcaacaacaatttcagctaccccttttggcagtcttttgccgtctttcttgttaggccccgtttagttcccaaaaacatcacattaaatcttttacacatgcatagaacattaaatgtagattaaaacaaaaactaattgcacaattagaggggaaatcgcgagacgaatcttttgagtctaattagttcatgattagttataagtgctacataaacctacatgtgctaatggtaaattaattaggctcaaaagatttgtctcgcggtttccaggcgagttatgaaattagtttttcattcgtgtctgaaaaccccttccgacatccggtcaaacgtttgatgtgacacccaaaaattttcatttcgcaaactaaacaggcccttagtcacaatatattattatttgatcgtggatcccctcctatcattcctctctttcttctgttgataaaattactgaatggaagacttttaacaagctgaccatatatttagtaaaatgttgcctacacgttgctaatttgtttcattagttgcttcttattgttctagcaacttacgtgtgaaagcatcgacaaactagatcttttttcttcagattttcagaaacatcattgagctccatttagttgtgccaataattatgaatcatcagcgaaacatttgatgaatgtatagtactgaacttccaaggtaatatctccattctccacctcagcatagaaccgtatactatttgcttgccatgaatgcagccgtcgtcttcacttctttaaccaaaatgtttgtcattcagcatgcacaactaggggtggaaaaaaaaagggaagttgaaataaagtggcaatttttggtgagaaaaataaaacatgttcaccatttcaattcattaatccatggttctcttctccatttgtaaagaagatgcactgtagactcaacaactgcattgttccaaagttcttccggatataagcattgaaagtctttttcatggccatggtctcttacaagttaatttgtttctccaggtcgaacttactaaaagtagctgtgatcattattggaggataatttctaaacgtcaagacctgaattcttcattttttttctatatataatgtgtatcaaaattcccgctaataattgacatacataattgtttggttaaatatttattatgacctagatacccaagttatgctccccgatatgtactagattttttatttatgtaacttcaagttgcctgccgtactgctttgaaccaccatccaaactaggacaagctcttccaacagttttaatttaattcaggttggcaagtcactaaatcattttttatgaaataaaccgtccaaattaactaggacaagatcttccaacggttttaatttaattcaggttggtaagtctttaaatcatttttttatgaaataaacaatccaaactaggacaatttccgaaggatttacatggagttttggagccaagccccaggtcaagcctatgttgtcccaatcctagggccgcccccgataacaacccacgtatttatttgtaggcctaaatggtgaaatgttctgcttcctacaaagcattataatatatattgcattctatcttcattaggcctcgtttggttgtccgtgtatattatacatgtgtgaatagtcctacctgtgtattaagtgaatccacaccacccacccaatacacagcatgattcaatacacagtgtgggctggtggttcgactggtgatacccagggttgactccacagcaagtacgtagtgctagctaagctagtggcatgcatggagagtcatggagagttgggcacagagctaggtttaccttttaggcctcgtttgttaagaaaaaattaatataaaaaatacaagaaaaaccattataatatatattgcattctatcttcattaattggttgtagacgcaacaattttagagcatatatcactctattgatttttacattagcattacaaatggatgaggaagtaatatggaattttgtttatattttttaaccttctaaattttttattttaaaactaaaccatttcaaaacttattttcaaaatgaaccttttggccacaccagtccgcttgacgtaacaaaacaacactggcaagacccctgcagcgggcatgatagtattgttttgtcacgctagtttggttggcttgtcaaaaggctaagatcttgaaaataagttttggatagatttatttttaaaattaaaaatttaaaaggttcaaaaaaaattaaataatcttaatatggctggtgttcttccttgatcacacacctacaactttcccatgacacatcctatggcccacccacctccgttcaacaaaacaaataaccgtacatgcatgtactttgcaagcatattttgtgtgtttgaggctgcttattgtttagtttgtttggaacaagtttattggatcgtgtgcaaatcatcctggtagattaataactcatattgcgctttatttgctaatatgtttgaccacttatactattgcacaaatgttttgcttttaaaacacttgtatttgccagcttactctgattagatacaatttttttagctatgataagttacaccaatgcattaactcgaatattggtttaccaggtcggcaagtgtcagcaggtgaaagaaaaaatttattttgttggtgttaagttcactggaaatatttttaactgaacttttatttgcttatcaaatcctattcactgagcaacgagactgatagaaggcattcagtgggtacgaaatgtcgatctagctctaaagtttcagaaatcacatcttactatatggagggattgcttaatgtgtttttggtcactcactattcattaagttcttatcgtgttacagaagattggatgtacatatggcagaaatataatgttgtcatgtcttcctacttatccttggatgataattcacaaatctgcatcaaattcttaagcatgcagttcaagcgatgatggtggccacaactggagattccggtggtagttaataatgtaagaatcatagttgtttactgacaattcctataatgcaatacatcatcaaattatttagatagaaaagcatttttttgtctaaacaatgattattgccgtttatctctctaggttcaggccttgaggatcatgttcaggactctgctgccttcaatttgttccatcgataattgagcgctttaatttgtgcactgttgaactatatacgagagaattttcaaccgtccaattctaacattgcagagaagtctaaaatgtcagtagtatgcttgtaattttgttgttatacttggtttgctttattgacatttcaagtttaaatattattctctgtaattttgtagattctataaattgtaaattttatttcatgtatttttagtatgtttaaatatgttgttcaaccttttagaaaagaaaagacaatgaggattattggattgcaatcaaatggaatgtgcaaagtaaatatattattggaaggattagatgttttaatacgattatatatgaaaaacgtgcattgtacgtgcgtgagtactagcaatggaataggtaagggtagtaatatatacatgctgacactacggtattatttcgatgcaaatcaaattaccataagataatatatgttttattaaacgagattgatttaaaacatcaaaaaaaacagtaacagtgagaaaagttattttgttgttagtatctccggttataaatatttgacttttgctctcatataaaagaaaaccatacttacttgacctgcttgataacatgaaccatttgattgttttttcaagttccaatgaattcaagcaatattataatttttggatttctatccactgggatcccgtcgggagtcgggacgggacgggatccccgcattcccacatggtcagcaaatgacttttcacacggaagcacgaagaaggcgtcgtacgccttgttggcctcacgcgctcccagtccattgctgccaggagctagaccatcgtggtcgcgagcccgcaacccccatctaccgccagcagccgaatcgagaggagtgtctccattggtgcccagcgaactcctccatgacctccaccttccgacggttgcccctattcctccttgtgcttgctgctccttgtccttgttatctgcaattgcagggagggacaatgtaggggagcatcctgctgctccccctcttgtctaggattgcggtaagagaagatgggagattgtggagagggaagatggggagcgccgccatcgccctgggggaggacaaggagcagcgtcgtcttcgccacagcaatgctggtaaccatctccatcccttcttctcttccccctctcggctcagatttgatactcgattggtgccatgtctaatagcggtaggtataggcctaataccgatatgtatcaactggcaccgactggggtattagctagtaccgatgaggtattagttaatacctgacgagtatcgagtgatacatatgaggtataaaatctaataccaacatgtacaggaatctgatacctgcttggtatcatcctgtctggacgggatcacgctgtatagcagtctcctattatttttgataaaatttgaccattttctaccgtaagtcaatggtttcaaaatggttttagcgaaaaccagaaaaaactggtttttggatcgttaaggatttcccccaaatagtccgatttttcctccacgccgataaggagcgattcctgcttcattcaggcgagttgcagcctgcaatccgaactgaggacgggtttttggagttagctcaccctcgcgagatcgcgacagcagagtgctttcgccgttggtgttctttccgatctcaatgcatttcaccggtccaaaaattcttatctttagaccattctgagccatttacgaacattacggcaaatatgatcaagacatttatagctcccacataaataagaagttgtgccacagctataaagtaggaattcaataaaatatagaataaggatattattagaatttttttgttagaatccaaaagttctttactaactagaaagaaaaacgaatacctagtgcactaccaacccaaaaatcccaactctgccttacgtaaagttgccagagtacgattaacctctggatcgtaccattcgagccttttttttcatgcttttcccggcggtgacctcctccagaccagagaggagagcaatcaaaaaagaaatattactcaatcaaagatccaactgatccccatgtctgtattgcaaatacgcatggtttcgatgtgcaaaagcaaaccatttctattggaaacattcctataatgatcgtcgagaggaaaacagcccggatcaccagctaaggcccctaaatgaccgcttagtgataaaggaggtgggggaacaattttttctcagttgcaatatagaactaatttttttgttaatttaggataagataggtagaagttgtaagtcttattgcaggaatactgtacttttcataatagaatcccctttttttatttattatacggatatacgttccttttagtttcgactttagggataatatttttcgctatcttcttccgagaaccacctaaggttctgactaaaaaagtgaaataatttaattgaagtaagaagtctccccatctgagagacttcttacttcaattagtccccgtctgctttgcattttaaagaaaaagtacaaaaacatatttattccatttagctattgctattcttttcctgatcgcaggtcatatgtataggacccgccagcgttcatcctgagccaggattgaactccccaaaccaaagaaaaagagaatggaagaattcttcccttcaattcatagttttcgaaatctttttaaaagtggattaattggacgaggataaagagagagtcccattctacatgtcaatactgacaacaatgaaatttctagcaaaaggaaaataggaaatcgatcaaacgatcccaataccgtgaaagagaaactgcacgctctaccactgagctaatagcccgtcgtgcgggcctcccaaagggaggcctgctacgccaaaagcgagaaaaaccccacccctttccttttgacatcctcatgccgccggaaggttaaggaagttggtgaactgatgacagggaagccggtgaccgaagccctggtggggaggtcataagcgcctataccgtaaaatcgattttcgacggaatcaaaaagacatatctggtagaatcataaccatagaatccaaatagcctccgggttttttcagatttggcaagcatccggaataactattcactcatgggatccgggcggtccgggggggcaaaggaaccggacatgagaatttttcatcatccggctcgagcaagaatgaaagaaataaagttttgtaaaagcaacatgaagaattgctcagatgcccgtgagcgaggcttacttgggtcgtgtcggctccgaaaacttgcagttctccccgtcaatcctcgccatgagtggaactccgaccataacataattgacagatccaagatgtgctccggtggcgtatttttttaaaacgaggtcctcgataacgggacatgaagacgatctattacattctaattaattccaattatacaaaaggttcagatagactaagcaaaaaagggcttcatttcgttggaaaatcacatattcatttccttcgtatgaacagaaaaatatgatgacttaaagaagttcactaccacgaaccaatttgttcttaattttgtagcttgtgactagaaatccactgctatatccgattataagtatttcacatcatcctgcaatgcagcagattgaaaaaatatttaacttggaaacgttcgaggtggagtatttgtttacagttaggacaacattacgaagacatgtagcagtgataattaaaaaaacaggattgctatatggcattcgaataaaatttggggatgaaatcttacaaattttggaccattggatccatgccaagattcgtgcatcggcatctctcctccaactccggcgggctccccttcttctccggtaccggtgacaccccaactccggcgggttagggtttggggttggggtgagggtaggaggggggttgggggagggggaagagggagggggtttcctcggggcttagagggatggccgtggcgggggaaggactggcggtggccggtggactccggcgggcggcgaggcggcggcagcgccgccgaagctgcgggaatgtaggaggccggtgggccggcgttgccggtgggggcaaagcaagtgtgggattagaaggcgccggccggtggtgcggatccagcggcggggagccgccggatacggggaagacggcggggcgggggcacctcgtcgtcgccgccatgagaaagtgaagggaaaggggggagggggcttgccggcgccgttgaccttttccggccagccgcgaggcgagcggcggcacggtggggcggtggcggtggtagcggcgacggatcgtgcgtgggacaggaggaggagggtggcggcgtgatctggaaccgaggggaggaggagttagggttaaggggctgcacgaatcttaaagtacatccaatggtccaaaattcgaatgataggagttgggattttctgtcacataatatatagacagcctcttaaaaaaaaggacagaacagaaaataaagtatgattgtggcaaggaatgcaacacaatgcagttgttaacagatctagacatctcaaacaatatgtccttgctaaattgtgagggagaggtaactggaacctgaaaagatgtgaacttgagttacatgctatatagtgagggagtctactacgttgtgaacctcgtctattgctgttccctagattctgtccaagttattctctagtagactttcagcaataaagactgattagtacaagttaagtggttcatcttccctgcttgctccaaatcctcaatggtcaatcttcttccctactgtagcctgcctgttcatctgagaaataaaactgcagaaaagtcacgtaagaaatgaaactgcagaaaaggctatctgtgacttataaacaatacagatgatgaccaagcagtgatggccgtccaacatattgtcaggtaataagagaacaaaataaaaaaatgctactccatggaaatatgcaatccatcctactaactgctggctcattgcttttattttccgtctagtcaaaaactaattgcctgttagccttttgaactgcggttcaaccgccgggttcaaggttcaaccggtaaaccaaggagtcaaccaggtcatccactgatctggtttttcatactatggctgacgatgatgggggacgggtggggccaccttctactcgttgtgggacttcttcggggaggatacgacaacaatgggcattgcgtcccaggacaacatgcggtgcctgctaaagcagtcgaactaaccaacggtcataggaggtagtatttttattactagccccgtttcagtttataagacgttataattttagttaaacttagtcaaatttaaaatatattgactttaacttaaccaaagtcaaaacgtcttataaccttaaacggacggagtacaagttatagaatttaaatttaaattatatgtttgtgaaatgatatattaatttgaatctatcttgtttttttatttttttataactatttagttgatgtcaccagtggaagagatcagaccagccgctttgagctaccattttcagacggcaagaaatcgataatctgacttaaaatcccaaagagaattccaaacaaaggggatcagatattcagatgttcaagtatactagcctagttgcgtatagctaagcagaccagataagcttcgggaatccttgcgtcgggcacacatgcatgcccaatttaaaagaaaaaatagtttaaagtggtttgcacgcatgcgtcacgtcagcgcccgatttttccactcctccatcaggcgcccgatcctgagttgcgtccgataagcttcatctcactgaaaatttcaggtggcgcgtaaaaaggggttgatgaagggatgaagtttctttttctttactatgatatccttgccttgactacgccagcttgttacgatatgcatgtgcctgatggcttcctatcttctttcatatagagatatgaacagattactgaacatcaagcagtacagggcaacaaagctacagccagcaaacactcaagcaataagaataacataaataataaaaccaacacataaggagtaaacaattattaaagtttatttgtgaatctttattcgtagtagacaaaaatctgccagacattcatatataggaaagaaaggacaggtggccaagaccacatcatgctcagatctgcacgagccatggaatgttacctcatcactgcttctcagccatgaccttgaccagctcttcagcatcatcaatcgccttcgaacacctgtgtgctaacagggaggacttcccaacctggtaggccactcctgatgccttcacctgttcttctatcttgccaaaggaggccacctcttggtgtgcatacaccacactgggtacagttcataatctaagtgaccttttcctgcgatgaattcaacacaggcaatggatcttcttcagctttatgtgcaagcatgggtccgggtatagcatccccagttgtgtggacacgcttaacatttgtcatcaacaacgtccagaatactctgctctccaccagctgcaggctccacagttaacttgacacaactaccagaggcgtcaaccccaactaccattgtcttaagcatgaatttcattttctgcttctccagcatatgcttgaatggcttcctaatttgtccatccattgatgggacaatgtcagaggcaaattcgacaacactaacctcagacctggcccgttccagaaagaaccgtctctaaacctatgtatccagctccaacaatcaccaatttctttggtatttctgaaagaaaagagcaccagtaggcagtaggtgacaatctttttctcatctattgtaacttcagggagagattttacatctgaacaagtggcaatcattatattcttccctttgaagattgtgctacgttaccgtgcaagtccacaggtacttctgaagggtacaggaacttccaaaaacctctggcatactcaaccttgttcttttttagcaggcacattgtccttttgtgccatcatggcagccaaatctatttgataatttaatcccatggtgtgcaaaataagactttgcctcactatgaatgcagtaaagcctgaaatcatgaagaagaatcccaagtcaggtgcaatgcaatagcaagccaaacaatgcatttacaattagcaggtctcgaaatatacccatcttccaacagagaaatcaagtaataatttggtaactcagctgggtttccatcagcattttagcaagaacctcgtgatgtatttatctggctttaccaaggtttacagggaaattttgttacacctgggtaaaaatactataaatacaagaacaataccgaataaggtgacctcaaatctttatatgtttcaatcagcaggttgccagaaaaactaaacaattaaaatgaccttcaaaatggtaaccatggcacaatctaatggatgtgcacagtattatctacacttgaacactatttaaagaaaacacttaacataaagatactatttgagaaaagatcacacatcatttagaagaaagagcaagaaagtgtcaactctaaatgagagaaactgaaaccatgtaactattgtgtaattttgtgatgtgccttcttttcaaggataatacaattgatgttttttattccaatccatcccccacttagtgcaattaaggtattttcctgccttcacgctttgccacgtcaccccttcatttccatccattggattactttgattgacggcatcggattgcatgcccgagcatctatttcattcattactgtctcatacccagcaaattaaacccagcccaactttcctacttggcccagcccatctcactggctatcgtttcacttgcactatcagcgcaaaaggtgtcccccctgacctgaaacgatttgctgcgcccgcgctatcaaattctgtaacagctaggagttgaagcgacagcaatataatataggccatggccattcatttccctcaatatatatgccttttccttttcctatcaaatatgaggccatgaccaccaacgtgctctcaggcactcccagaccaatcaatcttcatcacagggagaaagaagagacaagatgatgagcttccacagctcaactagcctctcaggatacgccaccacaggttcaaatcaatatgttttagtcttattagttcaatcaggtttcttcatatatactggcccttccagttatgtgtatatcctatggtgctttcattgtcagatcctttttcttcttctcaagcaattgaagaatgcaggaaacaagatcatctgttggttcactcataggcgaagcataatggctatatgaggtggtaaaactcttaaatttgatggaaatttttagtttgtcaaacttctttgatatctgaattttaatagcgatctttatatgaatatgaattatcatctttatcagcttttttttctatctgtatttgaatgaccattttatctggtgaaagtgtctatcttacctttactgaacacctaaacactttatattcatgtgccactgatagagatgtattccatcatgcccatatttcagcttggtaatctttgaattttgaaagtagcctgctttgcctcctgagagagatgaagactgaacaagtaactgaaatattgcattcatgaggcacagatgtggggtaaatccttttttttccttttcagttccgatgacttacttgaacaggaccttctgctaacattcttataaagtagttagtgtttaagttatgaatcccctgctatgaattggttttgctaactctgttattcgacttggggagcaatgtactccctccatttcaacatgtagaataagacgaatggtcaaacattgtgcgaaaagtcaacaacgtcatacattttgaaaagaaggtagtatatgattttgaattattatcgttagcctagttctcacagcatcactaaacatttttctttcctataccaagactgatcaatgctagattttcatatttagatttttttttctattgcccacagcaatatctacactgtcagttaccaagatatatatatcatccgattccacaactgatttttttaaatgttgaacaaaaccataacattcacaccaaaaggttgtcctaaagcaatacaccgttttgctttccctacccactattgttccatgaattcccacagcaatgcgcaggataacttctagtatattataaacaagcgagcattgtattggataaatataatactgcattccccaccaacctttgaggccaattatctatcactagcttctaggtttattagaacaccaaaacaacgttccaacttttgtattgtattggataagttgaagccacgatatttctcctgccatacctgttccaagtgagatatgaaccttatcacctaaactgacacagatgagatccattagtaaacttcccagcaacatgctcaataataaacaattaaacatccctacgtctacaaagtctcaactattttagctaagaggaaggatgcatttatgcagactagcagtttaataacagaagaaatcacaagataaacagtcagtttactcaaagaggctcctatataatttttttaaaatttggtatgtttgtcaaacacctcatgtggctatcagcaacatatactagcagaccccaaggttaccacacactaattggatatgagagtttaaaaacaacttctaactggagtgtgagagctaaatggggaaaataaaagaacttcgaatttgttgtgcattgcaatcagaaatttgtctcccagaaataactccatcctatttctaacaaaatttatccctcattagcatccagttcaatcacatgatatgacaaagttaaacaattgggagtttggtacccaaggcatttgtcacctcccaggtgaatctattaactcagtaaaatctttctggtaaaagtgcgcattactacaactactatatatagtaaattgcagacaacactccatgcttatgagtagatcaagttatttaccagtcaatggactggctaaactctgtcttttctgggaatgcaattagccaattacacattgggtgtttgggacccaaggtttgtatcacctctcaggcttccacaaacagcagcagagaaaaagaaactgaaactacacccacagtcccacaattagtgctactccaaaccacccctagcgcaagttatcaccatgaagagttaagaaattgcataacctaatgatcacaataagtagaaaccataacagaattcacatctgcacactaataaatagcttggtgagaggagccaaacgtggcatttagatggtcgaacttttctttactagtatttcagatggacaattaaaatgtgcaaaccgtcccactcttctacccctgtaccgcatcaaacaacactacagcttacgcacctgtacaccgcaaaatcctaacccccaagattcgttgtaaagtgctcaacacggtcacggatcgacgtgctcgaatttttaccaatggacatatagatcgcgcccggagccggcgaatggagaacgcaataccttgaaggggaataggggatgcatccaacgttgaggcaggtgcccccgagcttgcacctaatcctaatgcgcggtaacgtcggcaggaaaacacagttcgtggtccgcgttggacgaacgcatcgcctcgccaagcggggtccgtgtggtccgtggactgacagatctagaggatggaaggcccgcgtttgaggggaggaagncgggggtgtgaagggtgggaaggcgggggtgtggagggtggagaggcggcagccggcagggccgggtcgccgggaaagacatgcccggaggatctcgtcgcctggccgccgaccaggaggacgatgacaatgacgtcccgccgcctcattaaaaaaaaacaaaaacaaaacttgggtttcatgtcgatcgtccgtattatttgaaaaaaaaaatataaaaaaaattaaaaagacaagccacgcataaagtattaatcatattttatcatctaataacaataaaaagtactaattataaaaaaaattcatataagacgaacagtcaaacgttggacatggaaactcaggatttgtcttttttttagacggagggagtacttctctactgctgctaaaatgggccaaagcctgagaattttgttccatcaatagagaattttggtcggtttaacgcgaaacggctaatgagcgattgctcgtctggcaatggg

SEQ ID NO: 8305 - DNA, 1007 bp, Oryza sativa
tgaatttaaattccaatattagtttatagacccaaagtttataggtccaaagtttacatacccgtttctaatttgaatttaaatttaaacttaaatattagtttatagacccaaagtttacatacccgtttcaaatttgaatttgaattcaaatatatatggtgtagtagcaagagaagatggagagataaaatagtaagggggaggggcgggtgatcgctaggaaggggagagagcgatcacccgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctattattattattattattattattattattattattattattattattattattattattattattattattattattattattattattattattattattattattattattatatactaaaagtccatgaaacttactacaaacgctctcaagccgccacatgatgctcctaaaaacactcctaagtcgtaaaaacactcctaagtcgccacatggtactttaaaaatcatagaaaatctaagaaaaaaacaaaatatctagccattgattttcatttaatctggtgggaccattatttttaaccattagatctatcttctaaattaacaatctaatttatattatatctccaaagatctacatccttccatatttgtacgtgagtacgtgcatttgtatcccgaaacccacacccgaccaa

SEQ ID NO: 8306 - DNA, 780 bp, Oryza sativa
  unsure (1)..(780): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaatagtacatagttacataccacaaacttcgcaaaccacacaacatgaagtgcagcgccattttcatgctcttcctcgccctcggaagccttgccatcgtggtacatggtaattaattaagtgtggtcagagggcaataacctcaccatttctttctcatctttctaccgatccatatatatgttcatcacacaccgaataattaatctctgtaaatttctttggaataaataattaaccccaggtggccgcacacacgccgtcgtcgtcgtcgagccggcgaagaaatcagctgctggtggcggcgtcgtgcagccggagatggacccgatcaccatctgcagcccgtccaacttctgcatcccggaggcgtggagctcctgctacaggtgnnnnnnnnnnnnnnnnnnnnnnnnnnnnnnnnn

SEQ ID NO: 8307 - DNA, 359 bp, Oryza sativa
  unsure (1)..(359): unsure at all n locations
tacatcaatacttcaaactatgtcattcggtatttgactcaattggagcatgtgggtctgcgatcatgtgcaggggcacttaaagaatatccattcagtttgctgggatgctacgggtggctacctagcctctgttagtgaagattctatcaaggtttggtcatttactacaggaaatgatggtgattgtgtgcatgannnnnnnnnnnnnnnnnnnnnnnnntattcttgtgtcttccacccaaaatttccatacttgcttgtgattggttgttacgaggcaagttctcttatatatcatattcaagataatcattttatagtactttaaaaatattttaaattaaatttttgtatgg

SEQ ID NO: 8308 - DNA, 299 bp, Oryza sativa
ttatattgtgaaacagagaaagtatatatatatatatatatatatatatatatatatatatatatatatatatatataggacactcatatggggcaccatggtgcccgggcaccatggtttcaaatgcacaaaatcactcaaatttttcaaaatttttaaattgtgagtatatacctagttataagaattcgattcatacctatacctatcaacaaaacaactcaaatttaactttatttcccaacccatgattacatacctaactaattatatgtatggatgctatatacctagaatc

SEQ ID NO: 8309 - DNA, 24823 bp, Oryza sativa
  unsure (1)..(24823): unsure at all n locations
ttcaacgtgatctaacgtacgcacacaaagaaacgaccaaataagcctataataaaaatactacaaataaatggtaaaataaatattgtgaatcagagcccgaacaaaaaaaaatgataaattgagagttaacttaatttggaatggcaaacgatttatcctagggttatgatttatggcatgtgtaatagtggttgcaatttgagagtaacgctatagacaacaaaggtgaaaactgaaattgatttggtgttttagagcttgaacaggaggaaaacaacctaatagaagtgtttggactggttttattgtggttgggcactatttaggtggttttgatggggttggttgggttcaaccaataggaaatagtgctggccggcactgtttatcttcttcccgtggcttttctcgtgattaacagaagtggagagaaaggctccagaacttaagtgagggaacggcgacggagacgatagcatgatgtgttccacaggctgacacccccacaggacgtggacgctgggctggaagacaacaaagctagccggaacgcaagttctagatctgcagctatggtgacatcgggcatggaagtggcagccccggtggcgaacgcgggcgggtgagcgcgtcaaaacatgttcccggatgagaaggttccatttttgtggttagttgatagaggtgaagcgtcggccatgccgaccacggtggcagccatggtgacggacaggagcacgatgggagctcgacacaagcaaggaaagaaggttggggaaaattctcaccagtgagaggtgatcctgctggtgctatggggaggaggcagaaaagtcgacgacggcgaaacgggtgcacagccggccttggccctggcaggagaaattttgggatgaaaacgtacgagattagcacttgatgtctacagaggaatagcagacttcggctcgttcactttgaaggagagaaggactggaggaggagggaaaacaaaggagggatggctacgagcagctgcgtggctgtttcggagccgcacggcacgacggccattggagatcggcgcgtggttggcgcgaggcggcacgaggctgcacaaggcggtcatgagttgggctcagggtggcacaaggagcagcgtaggcaggtgcaaggcggcacgcagctagcgcgtgcggacacgagcaggacacagggcggcacgagcggcggctagagcgaacgaagcgagcagcggcttggctggggtggctgcctcggctgggccaggacatgagctagaacagcccaacacagagagtgacaagggaaaaagaaatccgggatatgggctggaatgcaaggaactcggcccgagaaaaaacacagtgatctatttgaatttttggagagatttttgcatagaattttggtaggatattttttaataggaattgatgggatttggggtcttagaatatttgcatgatgactctgggataacttaaaataaacacgagctcttctgatgattttgggaattttctttgggatatctcggattttgtttggagagggaaactaaacaaggttatgtgggagtaggaaacttagagcgaacaaaagaaatataaggattgggagactccaattcgaaagaacgaagaacatcgactttaaatattttcgcaaaaattttaccctgaaaaatctagtatgttacagtatgtgatacaatcatctctatgattgtctctagggcatatcactaacactatgagccgcccacatatatgagtcccatcctatccaccgagttgatcaagcaagaacagacttgcgcctcttgttcttgcccgatcagctaaagaaggtgtggttttgctccttttttttttaaagattgaagcctgcaaggtaaatattcattatttctcactccattcctctcttactttatgatttgaattaccatgtgctatgtatgcatgtaaaattatgtgttgtttttagagataattcttatcttttttggtgcccattaatctcattagatctattctcggatgacatgctaaatttgaattaatgttttcttccatatgtaggatcgaattactagaactaagccaaccagagaggagtgaatggttggtgtacccaaaaaatcaaactttttacggaattaaaagttaccctcaaatcgatgtagatcggtctgaccgcgcctgtgctgccggtctgaccgatctggatcacccggtccaaccgcctgaaatcgcctctgcctcttgacgctgccgccggtctgatcggtgtgtacccgccggtctgaccgccgtgatgccgtcggtctgaccaccggtgtttcgtcggttagaccgccgaacctgagcaaacacaaatcgaagatctctcaaagtagatgacaactttattacttctctctgtgtttacaaagtgcaacaaccacactccttatgaaaatctcaactaaactcgaaaccctaactcaactatcaactcaatgctctcaaaagcgatactgggaggccacgccctccctctctatttatacatgaggtagacagtctaaaactacgaacccaactcatacaagaccacactttacataaccaattgtaccaaatttggactccttccaaattcgacttcgtatcccatacgcacacaatatctccatcgtatgccatatggaaccttcaccaaccatttgcattgaaccctagcctaagtataccgcatgatatctgatcatcacggacgtcgccttatccccaagtcgactcccgatccataaccggcaatactctcccgaggcatcaagtcacctacatatgaatcaaacaaagaaaccatattccgagaccaagctatctccaacttgactcattgttagcaaacaacagtattacatacatatagtatctatctagaagccataaacatgaaacaatcatggatatccaaacaaacaacccgaaaccgaaaccgacatagagtcggctagtcagactgcgggctggccggtctgacagctcgatatatgccagtctgaccgctcggtatatgctggtctgaccggcagcacttacccgatctgaccggtcccgacaaagcagtagtccctgttcaccgtctagaaatccatcatctccaaaaccacttcgccaataatctccaaatatcaaaaccaataatcacagatgccaattgttcatcacaaaataataatcaaacacactttgattttacgccatatctatgctatcaccgttagtcaattgttagtcaatctccgttaaggacaagaaattgtttgtcttttcgttatcccatatcccgtaagtggtaacctcaaaatattttttttctagcatatgtggcatgagtaatagcataacaaaattgcagagaatccctgtgtggtggagatggtactattgggcaaacccagttgcctggagcctctagcgtctgacttacatcgcagttaggggatcgggatggcatgctggacaccggcgaacccataagggcattccttctgcggtactttggtttcgagatgggcttcttgaagcttgccgccatggctgttcttggcttcaatctcctctttgctctcatattcgtagtgtccatgaaagtgctcaactttcagaatagatgaacatcattgaccatctcccctctttcatgtacttcctgggcatgttagccctaaaatctaagctccaataaaaagaagaaacaatcttcttgtcttgaacgagagctagtctatcttttcaggccaacttgtgttgcaaagatacttgctttacttgcacaacatttcggattgattcagtgttccaggacgcatcagattatggaatacatcaacacttgcagcatccacgaaaacgtacacaaacagttggtgatacttaataaaaatgggagaaattaacatccaaggctccaagccattgaattcggaaatcctaattggcgatcgatcgtctgggacgggggtagcgatcaattcccctcccccctccctcactccactggtttccttttttggtaccgcattacttttctattttagtaaatttatgcacctcaagtttatacacctcaagtttacacatctaaagtttagagacccaaagtttacacatctaaagtttagagaccaaaagtttatatatccgattcaaatttgaatttgaattcaaaattttttatatatagtatttctatacatctaaagtttatagaccaaaattttatagacccaaagtttataagtcaaaagtttacatacccgattcaaatttgaatttgaattatatctgatttaaatttgaatttgaattcaaatattttctatatatagtatttttatgcatctaaagtttatagacctaaagtttataagtcaaaagtttacatacccgattcaaatttaaatttgaattatatccgattcaatttgaatttaaattcaaatattttctatatataatatttctatacatctaaagtttatacacctaaagtttatagacccaaagtttataagtgaaaagtttacatacccgattcaaatttaaatttgagttcaaatttgaatttgaattcaaattttttatatatagtatttctatacataaatttttctaactttttgtttttttaaaaaaaattatgtggtgtactgtagtaggaagagaagaaggggaggagaaaggggggagagaagggaggaatgtatcgagtatagggggaggggggcggatatgatcgctggatcgatcgcccgcccattagggcccccccactgaattagatcaagggaagggtttctttgcatcctgtttggcgatggcccaatgtgaagccaggaacaagcccaacatctggtgggcgttggccttcggagaatgattcggttttctgggctgcatctaaactttgaagagttttttttccccttcttttgttcaccttgagattcgttttgaaacatattacaatcgcagtcgcttacaatgcgcgcacactcaccactataaaggcacatatgcacaccctacgcctatgacgcagtcgctcataacgcgcgcacactcacctatataaaggcacacatgcacaccttatccctatgagcacctccggaagactgagccggcatatattgagattaacgaagtcaccataggtatctcactgtcgacgtgtatgtcacttactactaaaagaataaatagccataaatgcgagcacctatatcaagtttaaaacttgaaccagttgaactatactctgaaaagctagctattgagactttttttaaggggaaacattacttaaggaaagttgtttttctcatcttctagatttagggttatcttctaaaatctgtaggtagtaattgtaaaaaaaactagagattttacagaaactacatgtgttataggattcctcaaaaggggttcaatttctaattattttttttctttgcgaagaaaagggttacaagatttagggtgagtttgaggagaaggagattgggaaaatatgcaaaacgaggtgagccattagcgtattattaattgagtattaactattttaaatttcaaaaatggattaatatgatttttttaaacaacttccttatagaaaatttttgcaaaaaaacgcaccgtttgttagtttgggaagcgtgcacgcggaaaacgagttgttttctcaccctatctcacatgaactaacacagccttacagctcttgcttatcccttcctaagcattctccccttgtctaaataaaaggattttttttatatggcagtagattataatttggtagtgcaacaacttacaatttcggtacagtttagtcgtaaaggtctgacggctcatgtttattttggcggttgaaaaaccatggccgaataatgccagtgaagaatcaagcataaatcatggcctcatgggtgcaacaactatccagccttcttgtgttgtgagacagatttttgcatcatacagttaggtgttcagccaacctaactttgagagctcgattgaatgtgtgctttttctataacatagtatgattcttctgtcctctaaaggaacatccgttcttttcccttttatttttttttgaataaactgtattttgttgtacggcacacggggtacacagatgcacctaacagtctatctatcaatcaactatggctggttattatacatacatggtgtgcttagctagagcaacctaatataaccaccgccgtccaaggttagatcgccaaattaagtgacggaattccacaaaacagaccaagcgtacgtataatccgtactccctctctcgatcggtcataaaaacatgtactccctctgtttttcaagccattcatattagaattagaattttgaccaccgattagatcattagactaaacttaacaaaagatttactattatatctaagtacatggtacactttagtaacataaaattattttaagtatttttaaatattttttaaaaagataaatagtcaaattttgaaaatgaatagtatccgttgtcatttatttaaatatgaagggagcatcttttcagcattgacgggtatccagaatataattttgaccattgatttctacacaataaatacttacaaaatctgacataataatattatgaaagtacaaatttgaacacataagtttcacacgcccagtctaaatatttgaaaagatatattcggcacactatgtatgttttttttatgttctaacatagttggatctaggggtgatcatgggaaaaaatattaacccaatttatatatatatgcatatataaaaatacttttgaaaaaaaaaacaaaactcttttattgatatattttttgcggggtcttttattgatatattatgatgcatatttcatcaattcatacttctaactttggtatgtttagggtatttaataaaattatataaatttgatcaactatataaaaatatatgatacattgcgttttaaacgagttctttgcccagtttgctactagtaccatgagctaagatacaacaagtaaaagtctttcgcgtggcgcgtgactcctgtgtcgtgagaaagtcgtcatggcatcttgctctgtctgtccgtagtgaatctccccgtctttacgctcggatcgatcggtttccgttttctctggcccatgccaacgcacccagcagtcgtactgtcggctgaaaaatagcaattttccatgttgaccaacttgtcgactataaaaatatttggtcattctggcaaggagatgctctcccctacccaccggttcatattcataacctgctttttctttagagtattttgttttttacatgcttttgtgatagattatggttatgtttagctcacactgaaatttggaagtttggttgaaattggaacgtgtgactgaaaagttatgtgtatgaaaggtttgatgtaatggtaagttggaagtagaaaaaaactttgaaactaaacaggcctatatatgggtgaagtttgtaggtgacctagctaggcagctagctatattttgcttctgagctttgtttggggtcatataatgtctaaacgtcaagtactacctgagtcttaaatatttgatgttggtaacgtcaaataaaaagtagagggagtatattagcgataggaaatttggtttataagtgaagaaggtcctgtgtcccagatttaaataaaagatatgtgtctttccaagaaaaagaccagaagttaaaactttacaaaagtggtataaatggatttgtatttaaaagtattttctatgatattaattccatagtcgttgataatatattacgaaagaaattcatatcatcaggattttttgcactaccgctatgtcggtgacatgggaccgggagtatcatgactagaggcttgggcaggagcaatcacccacgaggtctgaccccctcgggggggtcgggtccgagggtgatgtggccgcccccctctttgtctccccgaggggtcggaccgctcccgtttcggccccgagggctgaggcgccccgacctcttgggggttttgcgccgcgtgtctgggttaggcaagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgccttgccccatcccgtcaagatgagagcctccaagcactcgtccctagccggagccggcgtgttacctcctggagatggcacgttggtcccggtcagatatatgccaggcttcatcctaaccattacaagcaagatattgtatgaagaagggcaaacatgcagattgttaaactgacacgtggtggacaagaatgaccgatttgtaaccggactgactatggtcatgtcatcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagggaggatgagtcccgacacaaaagaaagagagggagagatggtgcatgtggtatccccttgagatataaaaggaggaccttgcccacttagaaaagggggaaaaaacgatcccagaacgatcaggggctggcaggcactttgtagcttcttcatacacagatccaccaaaacacaggagtagggtattacgcttctcagcggcccgaacctgtatacatcgcccgtgtcttgtgctttttccattctcgcgaaccttccacacacagaccaggagtttagaacctcacccagggcccccggccgaaccggcaaaggggggcctgcgcggtctcccggtgaggagccccaagctccgtcagttgtttttttcaattttgctatatatttgtcgaaaaattttctcctaaaaatttgacaaatgtaaattacaatacaatcgtagtataattacactgtaacttatataacttttacataattttaaaccgttagatttgtttcaagatttatgcaagtgaagaaggaaaaaagtcataacacgcacacatgtgagaggattcgttcccacgacctccgtttcaccaagatagcatgttacgtagagattttaaaagttacattgtaattacatgcaagttacagtgtaattacatggtgattatattataattacatctgtcaaatttttgattgaaaatttatcgataaatatataggtaatcattttttttggaatttatgatgcaataggtagaggagaagggaaggagcatgcccgatcgctctcggtgatcacccacccattagccctccccgaacaaatcaagtgcctgccagttgggaacaaatcaagtgcaaactcttcattattcataaaaaaatcattaagagaacactacttgtcaatacattgatttcttgtgttgctatcacaagacaattatttttttatacaagatcaaaatacactcatatatattatgatgaaaactacgtgttgatgaatttttgcaaacgtatatagtaatagtattcttatctcacaaccacaaactagtcgataagagatccatgcatgcatatgtacgacagtacaagaccagcctcgacgttcgtgcgtccggccgatcagcaagcgccgacgcggaagccgaagacgcccccgccgacgtcgtacaggacctcgaacgtgcgctgctgcacgttgccgatggtgccgaaggccttgtcgtcgcgggtgggcgcgaacgcgaggcagccgccggacaccatgccgtgcgcgtcgaggtcgacgacggcgccgccggcgaacaccagcgcgacggtcggtatgctgaccttgtccaggccggtgaagttgaagcacgtgtcgagaatgcccaggggctccgccctcgcgtaccgcgtcatcccggctcggaacgccgacgacagcgccgcgtacgccgccggcggcagccgcgtgatcaccgtgccggagtccaccagcgacccggcggcgaacaccgacggcgacagcccgagcttcttcccgcccacggcgatgtcctccagggccgcgaagtagtacgtcgggaccttcttgctcctgagcatcggcgtcgtcgcgaaccgcgacgcgccgccgccgccgccgctcgccggcgcgcccagcgtgaggaaccccgacgaggccggcgtcgccgggaggcagtagaagaaggacttgccgtacctcgccgccgtctgcgacaccggcgactgcgcgtcgccgccgaggccgatgaagccgtcggtcttgtcgtccatgccggcgcccagcttggcgtggctgcacccgaactggaagcccctgacgacgtcgaagccggacagcgtcagcacgtcggagctgtacgtcccggttgtgttcgagccgtcgccgtacttgacgatgtactggcaccgcgacttggcgtcgcagccgttggcctcgccgctgtcgccgagctgcgcgcacgcggcggcgctgcagttgaacgccgcgtacgtgctcgacgcggccgggtcgaacagcgcgccggcgtgggcgtggcacggcgacggggcggggcacggctcgcactgcacccacgacacgtcgctgccggtgtcgatgaccaccctctgcgtcaccgccggcgagccgagcccgacggagatgacgtactccagcgtgtccagggaggagcccagcgtggtcggcacggacaccttggacgactggccgtcctcgccggcggccgtgccgttgctgccggagaacttgcgtcggatgtagtcagctcggagctggtcacggcggagcagctcctcgtcggttggcctcttctcgccggagttgggatccgccggcgagcatgggccgtaccggtggctcaacgtcaccgagctcgttccatctgaggatgacggaatggtcgctgcaaaaattaaatttcatttcttaggaaatttgaactttcacaagaagtatattaaaactttcactgcatgcaaagtatattaaactttcactgcatgcatgaaattttagttgcagaaagatacgagagatttttatggacagttcactaccattgggctcagagcagacggccctactaggattaaggtcaagaaccttgtaactctattcatttcctgcacgagcaacgaaagaatggtaactgcacaagaggagcagcaacacaagcgaaacagaagtcattgctgttcctttgcttcgtcctaggtagctaaggctatgggcaaacctgagctagatagatgcagcttcaaaaccctaccttctctatatataagaatcggagatcgattttcatcctccgatgggacatcctctcgtttctttcatttcatctaaatagttataaaaaaataaaaaaactgataacatagattaaatatgatatatatcacttcatagacgtcaaattcgacttttaaaagttgtaaaaaaactgaaactagttaacatacaatcatagttgtatttattgtttttgttacaatatgtaaaagtcgaattttaaactcgcatatctatggagtgatacatgccatattaatctaaattatcatttttaaaaaaaaaagtataactatttaggtgataaagagatattttcttgagggatgaaaacaccttctcataagaaactatcttaatcacagcccattcagttcagctgatatgctaacaggttccactagccaataaatattatagattataaagttaataaatagtaaaaaaactatggaccaagtatagggtggcacgaattagaaagtggattgtttctgtccttcgagggacatcctcttgttttcttgttttatgcatggtatttaaaaaatcataaatttttgttaaaaaaagttaaaataaaaaacatacaagttgaaattcaacttatacaaatttgactgtgattacgcgttctatccatagtcaaatttattttttttcaatttgtataagttgaatctaaacatgtatgtttgtgatgaagcgatatatcacatatttatctattttactatttttttaaaaaaatgatgatttttagactacatgtaaaaacaggggacattcttaaatgaatagagtttccccacgaattatccatatgcatctccattaactctaaaaaagacagaccccttgaccgagactcatagttgacccagtaaatcaaagttcttgcattttaaaactagatttaatttgttgaaagccatagcaaagaaatgcaacctaggcaagatcatcgcaagtacgtcatgcatgtatagcaaattaaatggcgacgcgcaaccgttagtatgagaaaaatcattgctgtcacctgtcacagcattctctgttcattttataaacttctttaaccacagaaatattaacatcccaaaaaatcagtaaagctatttaagttagcaagcaaaatatcccaaaatgagaagtttggattttgaacacaatatatagcaattagaaaaaaagatcataatacgagcaagaaagaaaataaaaaactaaataaaaaatataaatatcagtaacatttttcctgttctaggtattcaaaattctatctcgatctaaattaaattttattaatggagaactttttggatcacatttgatattttttatgcaacatttaataagttcatggataaagaaaggcaaatcttttttttttaagaaacgactcgcacccgatggtgcaaaattttatattgatatagcatgaaagatacaacattataacctttggaggttaaccgggaaaaaaaacaaaaacaaacacaccagcaccgcacgctggcagctcctcacacaacccaaaagaaggcgctagcaccaagccgaccgccatatgcgtgcgatcactgctaaactttaaggggggttgcaaatatttcccacataccgactctgtacagaagatagtcgaagtttatggttatcatcatgtagaggtgttgaagagagggagagggcgagagagaagaaaatacacatactcatccctcctgacaacatgatgatgacaatcaagaaccgccaacaatcaaaccgagagaaggcggcaaaggcagggaacaagacctcctaagcaacgtcttcaaggaggtcatgacatcctaggtgccaccgttgtccatccaactagactggtttttccagccgatgagatttgcaagtaggaggaagggtagctgcttgacaacggcccaaaaggggtcacggcgcccgaacacgttgtcattgctggctcgggaaatccaccctctcccacaccttcgatgccaccccagaactcctccgcccaacaatctctatcggccggcagctccaccacacccggtgccactgggccaccttcacgaccgacgctgcattccgtagtggcgtagagtcgttacccacgttgaccactatctcggccagcactgcgagtagccgttcctgccctctgcaacagccgcagccttctctgtccatgtcgacctcaccttcaccaaatgcctgctataggctcgtatcgggcttcttgccctttggccctggtcatggtggtctcctcccgtcgtcgcccacgtgggcctcctatcgccgcaagccatcatagcctcccgctatcattgctcgtgctgacctccttgccactaacccccgtggcatcttgttgctgctgcttcgttgcactggctgctccggccagatccggcacaagggccaacgaatacacacacgggccgaccagacctagctgtggtagagccggatccgtagtctccacgtcgtcttccctatgctccacgcaccaagccactttcctcgcgctgaaggcgaggcaccaccatggtttagtcccgccgccgccatcccggttgaccactcaattctccggtggcgagaagaggaaaaaaaggggagatggggcagcgagcgctagggttcaaccccctaggtaactctcatgtgcggaagaagggcaaaccaattatttgtatcatttttctctaacttgaatggatgctttgcatatggattgaaaaactatcgatcggtgagatggtacttttcagatttatgtgttcattcccgcaaaaaaaaagatttatgtgttcatttgcaatatcatttggctatgagagaattttcaattgtgtttttctaatacctaagtggctaagtcatgcttatatgcgatgggatttatcaaatttcctcttaaaattactccctcagcaggacaatatagtatgcattttgatatagaaatgtcaaactttttagaatttgatcgagtagtcaaattatagaatatttagtatataaaaattattctaatatttatattttaaggtgattttgcaaataatagagagctatgaaaagatatatagaatgagcccaatgcaaacaaggctcgaaagaaccgaatgaaatacatatatattttacgaggaatgcatggtcaaagttgactaaatgacttaaaaattaaagtaaatgtacgaaagggataagatcttgttaaattcatctggtgcgatgctgccgtcatcagggcaggaagtgatacatgaattgaatcgtacgtccttgaatcttatatactccctacgtactctaccatttaaatgcaatcacaggtttttttacaatatttaaccatccatcttatttgtaattttattattattattattattattattattattattattattattattattattattattattattattattatataatacatgactagtactttatgcatgattttttaaaatttttttataaattttttaaataagacgaatgggcagagggagtagataacgtgattggtttacattgaccggtgttctaccgctgttagcctgttttgattttgatcaccaacaaattttaagagagaatctattctatacaattgagtttgttcgagttcaataatttgtcattaacattttcactttctataatatatttttgactttatcaattattctacaataagtcattgggcctggggccttcttttcaaaaataccaaaaatacccttatggacatacaaggttaacaattaatttatctcattagaagtttaaaaaatatatgaaaactttcatgtgacctccttacataacatggaaatttgtatagaatttctttcttttttacatttttattttttaaaaaatataacttatctgttgtatgctatataaaataattttttattgttgtttttagtataaatcatctttcatacactacataagatattttgtgctattttctcttatataagcaaattctctctcatataccacatgaaaatattttctttctaaaaaataaatataccagaaaacacttgaaacatgtacacaaacttccatgttgtgtaaggaggtcacgtgaaaattttctctcttttttttaaacttttgatgaaataaatcaattgttaatcttgtatgtctcaaagggctcaaaacttagatttagatatgcaaacacgagattccctgtaatctatgacgggctgtccctattgtaggtattctcacgcccaatgacgtattgtagaataattgataaagtcgacagtatattatagaaagagacaatgtcgatgataaattgttaaagccgaataaactcattggtatagaagagattctctcaaatttttaagagagaattactgtttgtgccaggtaaagatgcatagctttatgtgaaaaccttagattggaggtagtccaaagggaaactttgattaaaaaacatgtctcaaactacaatttactcaaatttaaattatgaagttttggccaaagataattgaagatcatatttagatacagcatactttcatagtacagtttattgctaaaatataagtagtcaaacattatatagaaatagagtccagtgacaattgtttaagaaccgaggttgctagatgtagttaatgttatttcttattctcttatcatgcaacaatataccaaatatttataactattggatgattaatatatagtctaataaattgtccttcttctttatttttgcttctgtgacgaaggtaatcacatcgattatttttagccttcatccagagtgtatgtctttcctgctatatatagcttgcaccatctcaattatttctagctttttgggacaattgattaaagttcaacttgtgaagagcacataaatcacgtaatgtaactataaaacaaatccatcttgcaacccataattgcccattgtcaacagtgcatgcaaggttatcatatagtatattttaatagcattggcagtttttatatggtagaggcactggacttttgacgttgtagtactttagattatacatgttttacaaaaatagatcctctagaaaacttgtcgtatttgactacacggagggactttttttttattcaactgtgctaatcttggtatggaagatacataatcttggtatggaagatacatttaatacatgtttctctcaagttatttagggcctgtttagttccaaaaacatcacattaaatttttagatatatgtataaagcattaaatatagatttaaaaaactaattacacagttagaggcgaaatcgcgagacgaatcttttgagtctaattagtccatgattagccacaagtactacagtaacccacatgtgctaatgacggattaattaggctcaaaagatttgtatcgcggtttccaggcgagttatgaaattagtttttttatttgtgtcaaaaacccctttcgttatccggtcaaatgttcgatgtgacgttaaaaattttcttttcgcgaactaaacaggccgatgtgacgttaaaaattttcttttcgcgaactaaacaggccggtatagacctctacctggggatcagctaggtcgtggtcttgcactactacacagaaggttttcccatgtggtcgaacggattttcgcgtgcagagattcgggccgtctggagcaattcgtctgcgaaaattgctatttgtgcgtgcgagcggcacaaccgcacgcgaaaatccgattttcgcgtgcgggtgcttatgtcgcccacacgcacaaataaaaaaataaaaaaaaacaaaattgaaaaaacaaaaccctaaccctagccgtcgccgccttcccatcgccgtcgtcatcccgtagtcgccatcgccttcccgtcgctgtcaccgccttcccgtcgtcgtcgccgtcgccatggccagatccgccgccttcccgtcgtcgtcgccgttgccgtcgccagatctgccgccttcccgtcgtcttcccgtagtcgccgtcgccttcccgtcgccgtcaccgccttcccatcgtcatcgccgtcgtcggaggcccgccgccaccgtcacgccgccggatccgcgcggggggcggccgccgccgccggatccacgcgggggcggacgccgccgccgttgcaccaccggatccgcgcggggggtggccgctgccgccggatccgcgcggggggcggttgccgtcacctacgcccaccacgcgccgtcatcgccgtcgccgtcgccgcgggccaccgccctcgcctacacccgccgccgtcgccgtcggtgcgggccgccgccctcgcctacatccgccacgggaggagaggagagaggagtgaggagaggataggaggggcactgaggagagataggagagagagcactgagagaataaaggagagggatgggaccgaggcatggaaaaaggaaaattttgaagtgggtacgagggaaaggagggatgattacttttgcgttcttaataggcccgcacggaaaaattggtttatttttctgtgcggttcatttaggaggactgcacgggaaaattgatttttccgtgtgggcgacagcctgacaccaggcctctatttttctgtgcggttccacttacgaaccgcatggaaacaaaaggggatcgcgtccagaaaaatcaatcctctagtagtgttggcgctcattgttttggctctgacctctctcacttaagaacaactcctttctttagattaaaataatatattcatttgttttctaagttttagaaaaactgacatatcagtgtatcctaattcatttccgatagtttatttcaaaacacacatattatagtttaaattggacaaaaccacatggtgacacataactctgggtattataatcctaaaatttcacaaaatcacattactgatcattttgactttgatctaacatattttttagttatacaatcagatcttaaatttataaagaatttatccatcatgtaaatgataaatccactttatagaattttgatataggagtatgttaaaataattaatggtgtaatattgtaaatttttagaaacataataccctggattatgtgccatgtatcaaaatccacgtggttttgtataacttgaaccataatagataacattttataaaatttgctcttacttttatttttaaaaactcatttgggaggagaatgtgggtcccccccttcatgctttcagaggtgaaagttgtgaactttacctccccacaagcaaatccattagtgcatgattaattaagctttatctggaataaatctaaaagtattaatatgatttttaaagcaattttcattttatttttgcaacacacatgctgtttaacggtttgggaagtgtgcgcgtgaaaacccgaggaagtagaagttgagaagaggtgaaaatgaacacaactttaagttttattgatttgctttcgtattttctgaaaaaaataggggaattaaattatggcgcatgatttgtaattgttttctcaaattttgatacaggattttggtatgacaaggagggagggaaccatatcctccctaattaagttggatgacggcaaatttttcggagcttctttttctttaggttctatgtttacgtttatgttatatatgcaatggaaccaaatattttctatatttttttacggtttgattaaatgcaccgctggagatagcctaattgtatcgatcaaggatttagattttcgttgaatggaagctcataaattcaatgtgtttggtttaagggcaatacttgataggacttgaccatctatggttttcggatgaacaatccattaagggtttgtttggttgggtggatagaaagggttaatattttgtttggttatattagataaactcgagggtggatagattgagaatagtaaacaattgattaataatgaactactcattaacaataaagtagactataaccaatcgagtatgttatttagtaataataatcttattgtgataataccaatgatgcgaactaaaccaattatcactaatcaaataactaataattaattaaggtcagtgaagatgggtagtacttcgtttggccaattttaccatatgacctcgtccaacagcttcctagaatattcctctagctatcatccacccttattgtcaaaccaaacaggttcaaaacttaaaatggtcatctcctatctaagactgtgtttagcttcacaccaaaattaaaagtttgaagaaaaaagttgaaaatttatgtgcgtaggaaagttttgatgtgataaaaaagttggaaactaaacaagggctcaggataattatttactccgaatgtaccgtacatggtatgaagagggtcaaccttctagttttttctcctctggtgatgcacatgcatcagaaatgctcaaaaaaaattataaaatcatatggaatttttaaaactttgactctgatgtttaatacacttagtttaaaaatgtaaaaatggtgcttgtaaatttgtattgaaaaatactttcaacctcttataaactcctcgtgctttagaagatgataccccaatataaaactggaccaatgtcaatccttcatatccatatcaaaaagtcaaacatcaagtagaatttttaccgaatgaaatgttagtctatatttctttacccaactcttgaagctccggattcttcctttacaaattgcacggaagaacatcgccagagttatttatccaattggaaatatttgtgcaataatatgaacaggtcttggctggtttgaaatgttaaatggagtatatctacactaaccaaacaacgatggcaacacttatacataagtgcatgtttatacgcattgaaaagcttatcctttttgccattttgtgccactagccgcgtttgccagttcaaatggcggttgccagactgtataaagagtatatatagtagtgaaaaatcgagtgacgattgcctgaaataatggccaaatcaaataccggatgcttgtacgcatcatcgatcttaattactactacctccatattttaatatatgacgctgttgtctttttattcaacgtttgaccattcatcttattaaaaaaaattatataattatcatttattttattgtaacttgattcatcatcaaatattctttaagtatgatataaatattttcatatttacataaaaattttaaataaaacgaaggataaaaattgataaaaagtcaacggcgtcataaattaaaatacgaatacggagggagtacgtactatgtcaacttcttgctgagtttggtgatttgtgacattgcaagagaggacttggcgttgcctcgaactttctataaggtcgatcggtcgtcgtcgccatatatactaggcatcggtgcaccatcattcaagagctatcgatctctccttgaaaatataattgatctaccagacatctgtccgtgcaagatcagacgatgacaccaaaaacacgatgtttaattcataacggtgcagccaaagtctatatatatctccgaagcacacatcacgggtgtttctcttcaattagcatcaaccggctaagccggccaatcgtacctattagtgacggcttcgagaggtggtccatatagcccttgaggccttgaaccatccactaccacagaacccctaatacaagtggacactataagtgtcgaaagtggtaaaacaagcacctatagtatcgttcccgcctacccgcctgctcacgccaccccgcctaaaccctgaaaaccaacaccttttttcttcaaatagttgctggtttttaaaaagatctttcacctattacctctgtcagagaaaggtgccgttttgtatataaaatccggcaccttatattccccagcccatcggagtagttggtgcgggacccaccctagaaccggcatctttttggtgaaagagattgattttattttaagaaccgacatttttcacccttcacctcctgaactatagctgttgggggacccaccctgtaaaccggcaccttttgtactgtcaaacataggtgccggttttagtgtgtagggatacgcgtaagctacgatagcataaatcaaaattttctaccgcgtaaaccaggaaccaagcaagtcttagatcatagatcgttaccactcgacgcgctgcgcagtagaagaaagcgctaagaaggcaaaggaaccctcacgatgtagcgcgcgttgatgtagaggaagtagtcgatcgcaccggctcgaccttctcctcctcgtgcgttctcctcgccgtgctcccacgccgatcagcaccgcagagcagcggcgcctctatcggtatccacacgtatagggacagaacgccacgtgcagatgtgctagcacccgcgcgcggctaaggttttgctcggggaggggagcggcggctagggtttctcacgtgatgcaatacctccgccggtcacacccctcacgaatatatacgatccacgactcgggcctccaaggcccgtaggatttatattcggatccctatccgaattaagctcatattggatatccatccattccccttattccagcccattaagtgtgtaaccctataggttcatatacactcgcctgtaacccgaaaactctttttcggtccatgtgtcaatagtggtccctagccgaatgtattgacccaccggacatacataaagatcatatcggctgaacctctagtgtatacttgtatgaacccctttgcctcacgatatcgattaagcttaaggctagatatgtgccatcctctaatagctcattcactcgaacttgtgatagattatatattacttgtgattgactcctcaatcacctttggcatggccatgcactttcataatctataacatcgaggggcctagggatatcttttcataggaggggcaaatcccatcttgatttttcatatcccactacatgtttcatagcatacccgaaaactacttttataactacccaattacagagtagcgtttagcagtctctaagtaagctactacatatgttgggaaccatgataatctcaagtctaaggattcgacaccaacactaaatgagatcactgatgacagaacacatatggctcttgcagtgtctcatgttgggtctatccaacaatatgttccccaacatgtgtccacattattaatttagtatctctataccatgatccatgagacataatcatcaattaatacatgtgctgattatttaaacatatttgttccacatttgatatttgatcagtgatcctttagaaatagtgacatacaacataaagaatctcatgaaagaatcacatattcattaaccaataatgagttatctatttcaaggaacaatatcagataaatatgtaaacatagtatgtgtggggatacccggtttgagtatggtatcccgaaaccacccaaccgtccaggatttcgatcgcgcacagattgatatacagaacaactttcgatacgtatacccaagtttttatagaaattattacataaaagataactaagacaggttttaggggccgacagggcaaacacactccccacaaacagaagacccatacacaaaataggataaaaacaccacaggcaacgcctgagagcagatcgacctagaacaagaactcgtcagcaccatagaattcttccccttcctgcgcctcctcagggaagaaccgatcgtctgaaccacattttatgcaagaggtgagtaccgaggtacccagcaagccacatccataataatacaaatagaatatgtgcaaggcgtacaaagaagaatatagttcatcaaggaggtttcataacaagcctattataaatagttttttactactttgtaaaacatttcatttgcaaacagttgtaaatcattattttaaaatagtagcaatattaatcaccattcatcctcatcttcatcatattccatattttaatttaaaatctactcataccatgataaataggaatcacccaatgacatagcttcttaaccggaagcacggcacattcgaatgatttaagactcatctctgcagagactgcctagctttacccacctgatgtcaacagcgagctaggctgaggacaacatagccgttcgagagtcccacttactactagttactgcccagtgggatattgatccgtcctagcagtcgggcacttgctgggcctaagcaaggctagacggtcgctgctttcatgggttccaccgttgcggatcatgtcaacctggcagaagccccttccacatgtccaccccaaacctgctcatagagccaccctacagtctttcatatagtgggaccatgtactaggctaagtctgattacttggtcctgtggatgggcgcaaattacatcattttccatggcataagggggtagtccttatatccgagggaagccaccaaaactagcacaggcccgtgcatactttaagtgtaaatatacactttcaacaaaataattataacaatatgcacggcctaacacaccacaacatccatcttcatccggaattaatcttccatatcactccaggcgagtgactcatatcaaataacatattttatatcacccgacacgccaccacgtgacaacgggtaaaccatgtatatgagtatagatattttgtggtcttatccactagaatattattgtgaagtatataaatctacacctaggttatcaaaggacgtgatatagcaattcatggatctggccaataataacaatgtaatattgggtaataactaaactaacaagtttattcaaaaataattcatacgcaaaataattttataaatactcaatgcataaaataactaagtggttctctactaggtttcaatatgatcaaagattggaactgtggcttgccttacggaacgtggccttccgaagcttcagcgtagccttctaggtccacttcaattcccgtgagtccggtgggatcttcaacgtgatctaacgtacgcacacaaagaaacgaccaaataagcctataataaaaatactacaaataaatggtaaaataaatattgtgaatcagagcccgaacaaaaaaaaatgataaattgagagttaannnnnnnnnnnnnnnnnnnnnnnnnnnnnnnnnnnnnnnnnnnnnnnnnnnnnnnnnnnnnnnnn

SEQ ID NO: 8310 - DNA, 979 bp, Oryza sativa
tcattgcaaagctcagcccctactaattgtatcttttgtgtgatttttctaatatctagatagtgataatgtatactgcctcccccttcttttcttagggaaattctaaccttttcagcaaataaaggaggtaaaccagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccagcaaagtgataaattatgttatagattagagtggctaaggcatcagaaatgttaccggttggattcccattaccatctctatcaggtaatggccttccttgatcatccctcttaactgcgcaaagaatctcctgtctttgagtttcatttaaataattattccaccatccttttaattgaccagaaaacccaatgacaatcatattggcagcttctctttctttgtttccattagctatgcaggcattagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgactatatcatatttctcattatcagaaatctcattgatgtttttatttacttttaaattatttagttttaaggctagctcattgactagttcttcagagattgcgggtccaaaagccttttgttttccaaatttgatgttaggatcaattgttgggacaaacataggactaacagactaaaaactagaagactgagaattagaaggaatatttatttttacctcaggtc

SEQ ID NO: 8311 - DNA, 595 bp, Oryza sativa
cggatggaagtcaagtgacataacagatgctgaatgacccgtgaaagtacggagtgaataacttgtctgcacataatcaaatgattagtcactacatggttttaggttatggaacatcttgcaatcactatcgcaatagttttttttgaattgatatcacaataagctattagcaccctaataggataactttgcaataaaatataggaaaatgtccattttacaaaattgaactcaagaaaaaagtcttgaaatgatcacctcaaactacaacactagacattttctagctcaaacatccaaacagtttgctttacagttgtccggttgggtttgtagttgatggttgattcccaaacttaaaagttcaatgttgtaaagtggagcttttttttttcttaaaaatatatatggtgaaaaggagtatacattgtcagcatcccaaacccgcacggttttgtcaaaggaagatgtagcaagccgtgacatgcttggactaaatcgaacatccgtaatcaatgccgaatgttcttctaatgaagatgtaggctttagagcaggctctgtacaccataaaagaacctgcgcagagtaa

SEQ ID NO: 8312 - DNA, 522 bp, Oryza sativa
  unsure (1)..(522): unsure at all n locations
nnnnnnnnnnnnnnnnnnnnnnnnnnnnnnnnnnnnnnntcccccgcccgcctctcggcttcggccttcggcgcgcttcgcctacaagtagtagccgcgcgcgcagcacaccacaccaccacaccacacacggtcacacgtctcactcgccgcgacctcccctccaactccaacctcgcccttctcctctcccccgcgcgcgcgcaagcgagcgagcgaagcgccgcaatgacctggaacaaggccccggctgcggacgccgaagccggcggcggcggcgacaccggccacgcgcgcctccgggagctcggctacaagcaggagctcaagcgcgacctctcgtacgtcgccacactgcccctctctctctctctctctcgtcccttttcgcccttttcttggctgactttaaaccggttcacgcgcgcgacggcggcgtgcagagtgctgtccaacttcgccttnnnnnnnnnnnnnnnnnnnnnnnnnnnnnnnnnnnnnnnnnnnnnnnnnnnnnnnnnn

SEQ ID NO: 8313 - DNA, 553 bp, Oryza sativa
ctacatgagaaagacttctctttatctcatttctttaaccttattggttcatcatccttaataagctcctattgtacgaggaccctaactcatttctttgaaaatggtgtacatctgtgcagcttttatgttaaatccttccatatagaatccgtgcacggaccctttaaacctatgtcaatacttagtatcctgcagcagcacgcagggtatcatctagttgctaagaaatcacaagcgtacatccctaacaagagcattttaaatatctgatgtgttgtactgttgtgccttatggttaatggaaggtccgaatcggtgctagggaggacaaggaaagaatgtgggtgggaagcgaatagtcagtccattatagcattactcatatgctccgatgacacgagtattccaacaacatcctccaaaacatcatgtatttattcaatcttgtcacaaaaaaaaaaagccgcacagcattacataggtgtatccccgttatcttcaaagatgaagatctctctcatcctcatccgatcgagagcagataactaac

SEQ ID NO: 8314 - DNA, 4854 bp, Oryza sativa
taattattcggtgtgtgatgaacatatatatggatcggtagaaagatgagaaagaaatggtgagggtattgccctctgaccacacttaattaattaccatgtaccacgatgccaaggcttccgaggccgaggaagagcatgaaaatggcgctgcacttcatgttgtgtggtttgcgaagtttgtggtatgtaactatgaactattgtatttgtgtgtgatgactgctgaattggacctttgttttgtgtgctgatggaatgcaatgggtcctaggtaatttatagatgacgaaattgctggcttagtttagaagcttatctttaccaaagggagaaaccccatccataatttgttgggtttgattggatgcttattataaaccccgagagattaattaggagcgtatctttgatttgctaaggatagcaatgtgtaattacgaggattatgactggattggattgcatatccaataggttataatagtatttattattaccttactatactaaaagactagtgcaatatatgggcctgaaaaaaaatcatattaggcctttaaaaatgaataagtccactctaactttctcaattataggaccaatctaattcgtatccctcaaccgtaatactaagggcatgtttagttggtgaaatgaaaattttttggtatcacatcgaacgtttgaccgtatatcggaaggggttttcggacacaaatgaaaaaactaatttcataactcgcctggaaaccgcgagatgaatcttttgggtctaattaagccatcattagcacatgtgggttactgtagcacttatggctaatcatggactaattaggcttaaaagattcatctcgcaatttacatgcaaactgtacaattagtttttctttttatctatatttaatgctctacacatgtgtccaaagattcgatgggatgtttttgcgaaaagtttttagggaacctaacaaggcctaaatatcttgacccttcaactattaaaaccagagtaatttgactttttcgagtacttttagatggttttcactaacgtggctcattgatctggtccagtcagcatgtacttttacatatcttacatatcagtgcccctttctttctcctcccctccccctccctagtgcccatatcgccccacaagcaaggaggtagtcaatgacgaagtgactacgggtagcaatgatgagcaactggcgcgctctccgcgtcggccctgccgtgctaggagtagccgagccaccggcaacgcaccagctggtgagcatcaaggacgctacatacgacgagtcgctcgtgaagggtgcaccacccacccagcgacgtcatcatcgcgtacctacgtacccaggctaagcggcatcagctacgcaaggtgcttgacacagtagaggcgcaatgagatttcaccatggagaaaatgaatcggtagtatgtggggctcaccgtgctgatcgagcaggtgtggataccagcaaagcgacaggtaggcggagtggtgacaacccgcggtgaggttaggggcggctaagacatgtttaaatgggactaaaacttttaagtgcctatcacatcggatgtttgataactaattataaatattaaacgtagactattaataaaacccatccataatcttggactaattcacgagacaaatctactgagcctatttaatccatgattagcctatgtgatgctacagtaaacattctctaattatggactaattaggcttaaaaaatttgtctcacaaattagctttcatttatataattagttttgtaagtagtctatatttattactctaaattagtgtctaaatatagagactaaaattaagtccctagatccaaacaccacctaagcaaggtgcccaggtccttgaggttgccgccaatttgcattgcttcccgcagtaatccttctacgtacgcgaaatctatttcaagagcgctctcagtttaattctatagcgcgacgcatctcagagccgtctaattgtgcacgtcgtcatgatgtccacccacgttggtgtctttttcctttcaaataaagttcacgtgggtgtctttttcctattcaaataaagtttcctctcaaattacttatccgatctacaatccgattataccattgtgttcgttacaattaaatcttaacaacaagatcttacatgattatgttccggtgtaaaagtatttatatttgtaaattacttttattatatacataagttacttttatcatatatatatatatatatatatatatatatatatatatataaaagttacttttagatttgactaaattacttcttagacatataaaagtaaattcaataaaatctaaaagtaatttacatatattctaaaagtaacttaaaatacaacagaagtaactttgtcacgacattagaagtaaattcgttgtaggggataaaatatgactttttagttaattccataatttgtgctgattaatttaatttctagatagagtcatgtttttatctctacaacagatttacttcaaatgacatgtcaaagttaccttcgttttgttctaagttacttctataatatatataaattacttttatacttactgaatttacttttatagtttaagaagtaacttagtgaaatctaaaagtaatttagacatatcataaaagtaatttgtgatttttcatcaaaagataatcatgtgagatcttgttgtaaagatttaattacaacgaacacaacggtataatcggattataaatcggataagtaatttaagagaaatttctctaagaaggaaaaaaatacatagatattgagtgtactagtagctttttttttttaaagaagggtgtctctctctagcactatccagctagcactctcggtgtagttgtgtccttctacataacgctttagagactaatctttcatttgagaatgttgtggcttcaatgtgtaccttcacgacggagatggtaaccataagcccaataactgatatgtaggtcccatatgttgacttagtcgattggattaggtcaatgagcatgttatagaaaccatctaaaaagcagctgaggtagtcaaattacacgggttttaatagtttggggaataaaatacctggtattgtggttgagagatacttcctccgtttcacagtgtaagtcattctagcataaatatagaaaatgctagaatgacttatattgtgaaacggagtaagtaattagattgaacatatattgagggagtaaagtgaatttatttattcccttgaaaaatgtgcttggatgggctggtaacccactagagctactgtgctcaaagggaccacctatacatttatcgacaaattttcttctaaaaatttgacaaatataattatagtacaatcgtagtgtaattacactgtaacttgtatataattacactgtaatttgtatgtaactacagtgtaacttgtatataagtttcacgtaattttgaatcgttagatgtattacaaaatttgttctggtgaggaagaaaaaaaaatcacatcacacacatatgtgaaagaatttgttctcacaacccccctttcccgaaataaatgttatggagagatttttgaaagttacaaaaatgttacatcatagttacagtgtaattatatgcaagttacagtgtaattaccctacgattgtactataattatatctgtcaaattttgggtgaaaaatttatcgacaaatatatagcaaattcggtgctcaaattgggccgtttcacctagaaacttaaaaaggaaaatctcctcggtcagccatatttttttttccaacgactatcgaaatttctatcgggctcgcgatctcgctcgctccgctacctcagtaaggttcttctggttgctttgctgcaatccagattgttgtccttgccatcttgctccctcacaagctcacccgattgatgccacattcctggtctcggatcggcgccgcttccgttccactagaaagcccgcgttgcgtcgatcctctcctccaccactgcaacgaaatttccctactgcaacgtccctcgcctcgatccatagcacattagcaccacctttgctgccacctcgcttgcatatgcctctgttgtcttgctggcattcatatgtgccaggggcattgtcccgactcctgaggccgtgtgtgcttcgaatttgttgccggtttctactgcttggtccatgagtccatctattttaatttttagtctgcaaatttcatgcattattgacactctttcgtcaattgatattgagactttaatcccccaacgctcacaagtataatgctccataatctcttgatttctggataatgtttagtattacccttctcccaaatggtcagtgtagtagggacttttacttcactggtaacttagggtaacagtaaattatcgaatcatgcaaacaggctgtaggggtgaaaacggtcggaatcggtagcatctctttggaaacgatactcgaccagccggtaattgatcatatttatcatttaaactaggaaaaggtatgaattaccccccctaactatcgcggtcgtctgaattaccccctgaaccacaaaaccggacatttttcaccctcaactatacaaaccggatgaattacccccctcaacccaatacccggtaggtttggtccacgtggcgtatgcgtggcagtccagtcagcattatatatatatatgtgtgtgtgtgacccacccgtcatacactcttcctctctctctctcaatcttccccctctctcacggtcatcggcatgcgg

SEQ ID NO: 8315 - DNA, 4526 bp, Oryza sativa
  unsure (1)..(4526): unsure at all n locations
gcgagagagaaatcggagttcatcgtcttcaaccggtacagtgcggatgttctccgccgccgcgctcgcctcgcccgtccccgcagcgctctcctcgcccgtcccagccgcgcccgcctccgcctcccatccccgcgaggtccgcctccgccgtagaccgccggtcgcccgagggagactgggagagagagggatatatatatatatatatatatatatatatatatatatatatatatatatatatatatatatatatatatatatatatatatagcccagggcagtgactaggggtctagtcaccagatatgaggataggaatgcttatctatatgcaatctttgatgtgagattagtatgtgacaattggatggcaatccaggttgttaaattttttttttaatattattatgcaaacataaatgcagtactggaaataaagatgtaaatacaaattatgtacaagatataaaattagatatttagaacataataggtttatatagaacggtccaggtgttcattcatataccttgataggttgaaggtagttccttctgaagattacaccaaggacttggtacaacacgttcgtaattatacaggtacaggactctcacaaagactcttacatagactctcacacttagactctcatgagtcttttatttaggttatactatagtactaacactttgatggagtggagtggagtgtgatggctggtggagcggtgagaggaacggttgagtgagatgtgttgtgtgtggaatgcgatgcctctgagccccttatatagcgctcggtagagaatcttcatgatatctcttcttgacttcaaagagttcatgatatccctttagacttcatggagagaatctttgatgatgacgcttttgaccttcaataaagatgtcataatatcgccttttgaccatagacttatcttatctagaatagtgtagattccttatcttgaatagtgatctttgtcggggatgacaagatctttattcattatcttcgttgattatcatgggtgctgattgcaccgtgtcgatctctgatggctctgttttctgaaaccactgagccaggcttctgtagtaacttttcttggagcattcatttccaaaatccggtttaattatgtgccctgctcccttgaagtattcataactttggttgtagaatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtctattcatgatatatatataatgaattgctggacgaacaggtggtgtgaattttggtggtattgaggagaagataattctgtatcttccatgtccaagtctcctgcagatatctttcacagcgtttcctaaatcagattgaaggatctgatcgagggttgcatagatggaattcacaagaccatgatctataatggtttggagagatatttcttcatggttgtatgtgggtaggttccggaatctttgaagatttatctcagctttgagaaccaggaatctataggatgggtcagagattgcctgatcatctagccttaagagagggagcatatatatgattactcgtatggctgggtttctttctctcccttctaagagatcaaagaaataatcttggagtccaaggaatattttcatttgtctctccttaaacttgtgccaaacaagatcgaggatgtcttgcccaaagcaggataaggtttgctccgttttgaagcttaatctgggctggagattttcgtatgtagtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttttcctcgcgataatctagtaacatctcctcatgatgagggatatcttgtattttagcccttttttctgttatcttttgatctgagggcacgaaatttttgaaataatatgccaggccatttaaggcatgagctttttcttttttgttttttgtctgccacaagaggtttaataacccttgttgtagctctgttactctgaagttgtgattaaatcgttctccatggcctctgggcagttggggcagtctccatgaactcatattcgtgagccattcagacttctgtgaagccatttccctgcatatatattcaaaatctttagtagcttttaataaatatctatcttcccatgacgtcttacctggcaagtccatagattttggaagatatgatgggaaagaattgtcatgtaaatatattgtattcacaacttgttctctcttggtctgaataagctggtcaagaatctcatctgtgttagacgaaaatcttaggctcacctgtttgtccattatcttaaattgaatatcttcgttcgtgacaaggaaaggacgaataagtgataaaaatggtgttcctaaaataacatcttgcttaagatttttaacgagtaggaaagatgttttaatgcaaacttcagatatgcaaatatagatttcagggatttgatattctactgttaaaagccttccatctgccccacgaattctgtgggcggctttatagaaatatttatgagggataataccttctcgaatgcaactgacatcagcaccagaatcaattaaagtaatatgctggaagtaggatccgtctataaaacgatacataacttctgtgtaccatttttgcttcatatatttttgaatggttccaacaacatgatcatcttcttgaattggttcgtccttttcttccatatggaatccttcttttgattctaacatgtatagacgctttcttatttcttctaaatcttgtttcataattttttggtcttcgaataggctgatcaaatctggttgctcattcttctttttctgttcatctaaccttttaaacacttcatcaatagagaggaatttgctcttttgaatatccttttttagtttatccttatcagttttgactcttgaaaggaatttttcgaggactcttcttttttcttctggatcttgaatggtttcaaaagtatcgagaacaaattcttctaaactggttaaaacgagtatattttcatcagactcttcttctgaattatctggctcacaacaagagcaaccactgtcttggcaacaattaatttctgcatttttttcttcatctgaacttaagtcattgtctatattatttagtattgcttcaagtttttctttaacgtcttctgattctgaatctaacaaggcttggatctcttttttaactttggatttgaaacatctgttagctatgtgtcctttcaagccacatttgtaacaaatggtttctttgctttcagtgtcttgtgttcttatattcttattgtaaattctttttggtttccttttggtagcttgaaagctcatcttgcttttatcatttggttttgtcatgggtttggaatgggtttttctttttctatagacataaggatcttgaaaaccaaactgatagcaaaaatctcccatttctcttttaccaagaatcctttgttttttgagttgatctttgatttttaggtcattgcaaagctcagcccctactaattgtatcttttgtgtgatttttccaatatctagatagtgataatttatactccctcccccttcttttcttagggaatttctaaccttttcagcaaataaaggaggtaaaccagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccagcaaagtgataaattatgttatagattagagtggctaaggcatcagaaatgttaccggttggattcccattaccatctctatcaggtaatggccttccttgatcatccctcttaactgggcaaagaatctcctgtctttgagtttcatttaaataattattccaccatccttttaattgnnnnnnnnnnnnnnnnnnnnnnnnnnnnnnnnnnnnnnnnnnnnnnnnnnnnnnnnnnnnnnn

SEQ ID NO: 8316 - DNA, 1479 bp, Oryza sativa
ttagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgactatatcatatttctcattatcagaaatctcattgatgtttttatttacttttaaattatttagttttaaggctagctcattgactagttcttcagagattgcgggtccaaaagccttttgttttccaaatttgatgttaggatcaattgttgggacaaacataggactaacagactgagaactagaagactgagaattagaaggaatatttatttttacctcaggtcttcctgttttgtagccttccataaggattgtctctattcgatctgtttgttgaccaagagaacgtagagatatatttgcataattttgttgttctaccaaatgtcctatgtgttcaacctttgctgtttctccatatgtatttttagaaatactttttagtggacaagcttttcctccattatgagataattgaatggattcaaatggaggatgaacagagtctaccttgtttccactggctgtctcccattctgtagaaaccttcttgataacagttaaatcttctgcttcggatttttgctctttttttatcatgttttttcttttgaagaattcttcgaagtgtataatctggctattctcgtaccagtcaaagaagaaaatatttctcctttgttctctcatttcgttatgccaaacttctcttatcttcattctgaatgattcgtcaacttcttcaaggtatcttttagtcttagctctatttttggggagccttatttctctcctaagcaattctttgtcaatttcaaattcttcttcttctaaagcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctagtgtttcaatcaaggattcgacttccgactgatccatagacttaggttcaacagcttgagataaaacccatttctcaggcagggtgatctcatcccatttcagggttttggggatagtatgtctgttattaggattggtttgaaggagagtggttaggccttttggtgtataatgtttggcacaaggtgctaaagttgtcatggctttgtagtaaactctgtgtgtgtgtgtgtgtgtgtgtgtgtgtgtatatatatatatatatatatatatatatatatatatatatata

SEQ ID NO: 8317 - DNA, 7465 bp, Oryza sativa
ttgccacgttggcgccacgtgtgcaagcttaaaccaaaaccacttagaatagtgctcaggggggtaattcgtccgatataaatacttaaaggtgtaaaatgtccggttttgtttttcatggggtaatttagacgaccgcgatagttcggggggtaattactttaaactactcaatgtcaaaattaatacgatatagaaagaaagttagaaaaaacaaaaattataaatagccaaaaaggatacagtcggaaacggtagcccttacacggaaacgatggtagcccttacacggaaacggctatcagtcgatcaggaatttcctaaccgtataatttatacatctctgtgttcgctcacgaggcttagaaaattttacattaatatttaaaccattgattgtggatgttccaaatcgatcataacggtattgattaaacaaaagagcccacataaaaaataatttataaatagccaaattcagactaaaaaatgccaagggagattcacgtaaaacacaatacaaaattaattgaaatttggagtaaaaaataaaataaaacgagcaattcatttccaaaacaaattccacggttataatccacaaatcactaaattcggaatataataaaatagtgagaaaaagaagagaccatattaaagcggccatgttaattctaattcgtgacaaaacataaaataaaattagaacttcaatatcatataaattccaaacttaattaaaccgaaaacacccgggcatgactctacccactaaggttcaaatcttaatgcgcacaaatattacgtatatgcaagttgagcattaacacaattttagtgagatatgtgccactgatttctacattagagcgtgtgttagcggacgcatttgctgtggcggatccaggtatattcggtggggttggctgaccccatagtttgtacaccctacaaaccttttcaggtataaattcaaaatattttgagaaatgatcccacttaaatacaaattactagtaattgatcccacgggattaaattcgcagctccgccaccgcgcatttgtggggatctaagtgtgatgttacgtgtgtgtatgcaagtgtgctatgtaaaagaataaaaataaaaaaaacatgtactcatcaaacatttaaaaaggtgtgcatttccgtatagctaggttttggtgctatgagagcaggtataatagtactgactcagccggcgataagaaccaccacatcagtattatcatacgtggaggagggagaaagcatgagagagagtgaagcgagagcttctgcaagcgccggacgataacacgacaaattaggcaagatgaaatattttattcgctttgtgggtctatagttcagttacttgatcttatatgcatatgcatactgtgtggtttcaagtactagtttagttttaatcacctgtacatgcaacaattaaacatattcttgcttccgtaaaaccaatatagaaccaatcttttatataaacaatctacagtattaactttagatgacctgatgtactaccgccgactgggtactttcactgttagccttgctctgaaatgggtttgttggttggcttgaaggccgatatttcgtggggaagcagcttgacccagccacgccacgcgcccacgcgaacttacattatactcgtatctacatgctcccacatactcggaggcacgtactagcttagtttgctggaggaagaagaaaccagatgattccacgaaaagatctctgtacacgttgatttcgcccgtcggtcgccgcgtctccatcgcatctcgccatctcggagaacatcagagaaaggcacaatgctctcgtgttcgtccaatggccgctccaccgctccgttgaaaacagtcgtaactgacacgtgctcccgcccttttcttttttgtccatccaacaaagatgaaaattcgccatcgccacctttgtcaaacagcacatgccaaattccctataaaaatggttacgcatacgatctgattctccaactcacatacgactgaatttatcatttatcatcggttgtaaacggctacacactgtgtgtatgagcatagtttttttattaatttatggttttgcagggatgaatccagtgtggtagcggcggggctcgagcgtctactactagcatgaggatcgtaggagacccatgaaacctctacaaaacttttttttttataaatttcttttaccatacttcgatggaaattgtctcgctatttctttctgatccgttaggccctgtttagttcccacgcaaaaactttttaccatgtcacatcaaatgtttaaacacatgtatggaatattaaatatagataaaaaaatactaattacacagattgtgtgtaaattgtgagacgaatcttttaagtctaatttcaccatgatttgataatatggtgctacagtaaacattggctaatgctaaaataattaggcttaataaatttatctctcagtttaccagataaatcaatttattttgttattaaactatttcgaatgaatgtattgatgacacgtcaaaacttgaaacggcgccttattcttagtcagtgcgagtatccgacccgacgccacgcggggcgccgcgcccacaggatcgagaatctcacgggggtgcagagtgcagactgcagaggctggcacgggggccccgcgcgcccaccggcccacggcgcgagagccacagaacccgggccgcacaaaaatatctctccccctttgcctccgcttttatcccacccgacgatgcatcggacgctcgcgaacgttcccgacgccagatatttcccgcgcgccgcgtcgcgccgcgcaactcttcccgccttccagcttggcttcgcaacgcttcggctatcctcttctcttcttttggttgacacgatcaaagatattttccggcgtccgcgcccatatatatgcacgcgccaccctccgcgtttcgcgaggcctctcctcgacgtcgcccgtacattctccagccgcgccatcgttctttcacttcacccccaatgttgttctagcccccgcgccacccaagatagatagattcatcgcgatcgatcgagcgggaggtagagactagagagggatagtgtgtgctgctgctgctgcgtcggagtaggatatcgcgatcgatcggtcgatcgggcggatgcagcagggaagggggaggaggaggataatccagggatcgtcgtactacgccgtgctcggcgttcaccccggcgcgtccgccgccgagatacgcgccgcgtaccaccgcctcgccatggtgagtgcgattctgcaacacacccggtctggttttcctgtggtttggtttcgccggagttggaagcagagcatctgagcatatatggcgctgacgtgatttgggatttggtgcgtgcagaagtggcacccggacaagatcaccagcggccgcgtggatgcggaggaagccaagagcaggttccagcaggtgcacgaggcgtaccaaggtaatcaaaaagcacaaatcctctgtttctcgtgcgtgtcctctgcaatctgcatcatcttcttcggacgaatttctgaatacgaattttttttttgtctgtcgcgtgcgaatgcagtgttgtctgacgagaagaggagggcgctctacgactcaggcatgtacgacccgctcgacgacgaccaggaggaggacgtcgaggtaatccactaagcatcaaacttttctcatgcgtgctttgcttctttttcttttttttttttgatattgcgatggtttttgtgatctaacttgctgatttgcttaccttgcgacaccaccagggcttccacgacttcctccaggagatggtgtccctcatggccacggtaggaagagaggtaattaaatttgatgaccgatttaagccgacacgagcgattcgatcacaaatcagctatactctagacccaaatgcagcgaaaagagaaaaattcaaattacaaaaatttccgatgcgtctaaaacctgtgttaatccacttcgtgcaggagcccgtgtactgcctggacgagctccgctccatgctggacgggatgatgcaggatttcgcctcgtccgaattgccttcgcccagcggcggcttcttcgccggcgcgccctcctcgccgttcgccgacaccggcgccgcgcagcagcagcgcggggtcggctccgcctccgcgcgcgcgcacgctcatccccaggtggtcggcaactctgcctgcctcagccggatggccttctccagctactgagatcaatttttgccagcggccgcaacatcatcacctgcatagattagctagcctcgtcgacatcgagtgagagtgagtagtcggcggcggtgcggcgccgccccctgctgccgatgaggcgcgtcagcgtcgtgatctcatgaaggtgcatgcagaaaggtggcaaggcagggcactggaacaaagtatttctgtttattttcttgtcttgtttcgatgggatgggctctgcagcgagaactgtctatactgttccgagtgtaccgtgacaatgtgatatcacgggactgtttgcctttgtacagtttcatgataaacaatctgaagtagtagtaatgaactagtgacaatgatgatgatgatcgtcgttgttccgttctgttaggatgatgggacgatccctttggtgtgaaactgcactcgtgtttcgctttttttttaaaaaaaaaaaaaacgtgcaccttatcttcctctacaggagtaaaccgtagaagactagtccagagaaatgaagttttttttaaaaaaaatacagagattgatcaatactgatatatatctccagaaacatgtaattttgaattgaatttaaacaaacaaaaatgttattttttttctacttagtaattgaacttgattctctcttcgtttcaggttataagacgttttaattttagccaaagttaaactattttaaatttgattaagtttatgtacaaatatagtagtatttataataccaaattagtttcattaaatcaataattgaatatattttcataataaatgtgtgttgagttgaaaatataattattttttctataaatttagtcaaatttaaagcagtttgattttgaccaaattcaaaatgtcttataacctaaaattgagaaattgagggagtatttatctgaaatcatatactattttaatattagttgttcggtgatatgcagaaacaggaagacgtcccacaaatacacttccccgactggcactagttgttttggacttgttcacctgtggccaaggtgcacggaattgaatgacaatagaatgaagcttgaagttacatctagaaccgaatatattatacttcagcaccaaaaagagaaaaagaaccactaatcaatcctgttcggggcatgctctcccgtaaccagagcacttaaagtcttaaaccccccgagatattagcggtagttccacgctcctaccagaaacacaataagaaaaggaaaagaatacacgtcacgtacaccagcacatctaacccagtcccagttcatatatatatcacattcatgtccaatgcattcctgaatcacagttaaatcttaatcctaccactaatcctatgcaaaaagaaaaaaaaaacatgaggaatccaagccaaatgctgcgactgctgctgctgcgggtggcaatcctcgccgccgttctcgcgacaccgtcgctgggccgagtgatagggggcagcaagtgcaagtgcctcatgtgcgtctgcgacgtggacccgcacccgctcccgccgtcgcgccaccacccgccgccgccggaggagccggagccggagccgacgccggtgaaccaccactaccctccgccgacgacgcccgcgtactccctcccgccgccggcgcagccgtacgggcagtacccgtacccgtacccgtcgcaggggcaggccggggcggcgtactggccgccgtcgacgccggcggagatgtacccgcaggtcagggggtacatccggtccgccgccgctcaccgtcggcgtcccggccacggcgggctctcgtcgcgcttggtcgtcgtctccgtcttgctcgtgtccggcctaatgccactgctcgtgtagtcgtgtgatcgtgtctcctgtgttttcgtttagtacggccgggccgaccgcgccgaagtttcgcggcctgcgactttgcgaccgcagcatatgttgcggctgtcacgtttactgatttggcatgtaaataagattacaactgtatcgcgtcaacacgtttcaagttccattatacgtgagaaaatttaaggcttgtttaccttataggcattttcaacttttcaaaaattttaacaatccccaaaacttgataagattacaaactaaacatatcattacagtacaacttcaccaaaatttgataatttcataaccttcttctactctcaaaacttttaccgaaattttgaaaaacatcaaaccaaacatggccaaaccttattgttaatgctaaaatttggcgttacgaaaaattaggaggtatattttagcaatgaagttagcatgccttttaattccgatttgaaatgtgataaactcaattccgatttgaagaaaggtatagagttcgtgaatttttcacaggaatgccagcgcaaacgaaacacagtgatgaataaatttggtcgaacactcgagaaacaggtgcatcgacactgtcacggctgcggcttcactgttccattgttgtgtttctatccgtgttccgtaccacgtggagggcattcgtttgtcgattctttttgtgtggccccaccataaacggagattacaggattattctctccgtcaatcaccagattacgcagttagcgattaatcctaattagcgtggccctccagggaaacaaaggcgccaaataaaaattaaggcgccaaaccattagacagtttttcagaaaatagattaagctttacatatggcacattattatcggatcacaatcatcttcttcgcaacaacaatggcctctctatctaatcttccaaggtcaatcaaggtcaccgattcactgcatgaacaagtgacaaccatgccgacggaaccagctgcctctgctggaatgtttgtactgcatcatccagggacaagctttcatggtaacctagaaggggaattagagacggtaagacttcataatgttttcactttcttttattagtaatcattgagacttgatcactacaagcacatcatatctccgttcagtaaatctcatagaagttttgcttcttttctattagcccttttttttctgtaagtttcatgaaagtttttcttcttttctaatttgtctcagataaaaaaacaggtatattaatcaggatcctagtaaaattgaagctactc

SEQ ID NO: 8318 - DNA, 2973 bp, Oryza sativa
  unsure (1)..(2973): unsure at all n locations
nnnnnnnnnnnnnnnnnnnnnnnnnnnnnnnnnnntttgttgttctcgtgcaggtactagttccaacttatatttacaaagtttagtgttcatatagaattcatatactgagttagttttatttaacaataggtactcgtggtcatgataaaagagaagaccaaatttcaaattacggtcagtgttttagtaggccagaaacacgatgtatgtgccgagcatgcatgaagataagtcttagggatgatggattgtattgcatatatgaattcttgcacgagcataaccacattcttgctactggaagtcaggccctttacttaagatctcaaaggaaaataactgaagcacagatggcaagtgctgaaaatgcaaaatcagtaggcatttctaataaggctactattgatttaatggcaaaagaagcgggtggatatgagaatcttggatttactcgtgaagacatgaagaatagattatattcaaagaggtcattgaaggtaaacgaaggtgacacagagggagtcttggaatatatggagaaaaaatcatcggaagatgttaattttttctattccattctggttgatgaggatgacttgataacaaatattttctggactgattctaaaatgattgctgattatgaagtttttggtgatgttctttgttttgacacaacatatagaaaactaaatgatggtcgtccatttggtttgcttgttggtgtggataatcataagaaaagcgttgtttttggtgctgcacttttgtatgatgaaactgctgatagttttgtttggcttttcaagacatttttaaaagccatgtctggaaagaagccacagactatattgactgatgaagacgcagcaatggccaaagcaatcaagttagtcatgccaaaaagtcatcatagaatttgtgtttggcatatgaaccagaatgcctgcaaacaccttgctggagttgtgaaggagtacaagaaattcaatgcagattttcagaattgtatttatgacaaagaggaggaagatgaatttataaatgcatggaatagaatgcttgaaaagtatgatctgcaagagaacaaatggcttgagaggctatnttacaaaaaagagcaatgggcattagtgtatgggagaaacacattttctgctgatatgagtggaacacagagaagtgagagcatgaacaatgaattgaagggctatttcagtgtgaaatatgacatacttaccttcttggaacactttgacaggttgttgtcagacaaaagatatgaggaagtcaaaaatgactttaagacaacccaaagtacaccatggccgaaagcagatttgacaatattaaggcacaacaagaatttatactccagcaatatttaaagtgtttcaggaacaagtgttgcaaacattgaactgtgacctatactggtgtacaaattaaaagttcgcggtaagcaccattagcatgttgtaaaattttctccaacagaaggtaaagtcaggtgcagctgcaagaagtttgaatttctcggaatcctatgttgccatgcattgaagatacttgatgttaacaatataaaagaaattcctaagcaatacatactacaaaggtggaccattgatgcaaaatctctacatataaagagcaactgcagtactcatgaagatcctaaaataaagttatcaacgcgcaggagagacttgtgcagaatgtttgttaaaatagcatctcgagctgcagaatctgatgaaacatacttaatggctgccaacaatgcacaaaagttagcagaagatgtggagaaatacttgagtataaggcctgatccagatttggataaatctggtttgtatcctactctgagttgaatagtacttatgctagtgactactatgttataatctaaatcagctatctcaaaaatattttatcataggcacagaggaaaatgttgacccgagtaaagcaagaggcataaaggttaaagagaaagccattcgtgggtcgaggagaccaattggtggttttgacaaggcaacacaacggagtaaaaagaaaaagagtgattcaaacacatcaaagtgtccagtacaagcagaggtggtaacaccatcactgccatacaccatgatgcaggtcagtagattcaagatatacacacacttggcaaaagagactcttattagtgctactgattattatttgccttatacagattcagggtcgttcagagattcccactaactacaatcacatgcaaatgccagactactatcatgttgaaggtgcttcattacttcagtcatctggttatttcagaacttctgaaaaaagtcaagggatgcagcatgaagagactgcacagacatttgatacatatccctatagcatgtttgcccatttaaattaaaatccccaccttttttcatattaattagcacctttaccaatttccaatcacattacaacttataaggttggatcttaatctgaattcccatatcgattcaagctgtcaaatcatactagtactttctcttgtattagcatcaaatatatggttcccaccaaacatgttgtttggctcatataaaaaaaatcctaataatttagaagcatcaaaatacaagaggtgtttgcaaaaatgaacttaccaaataaaactaccttaatgcagctgtatggtgaaaaaagtttcgatcttcaattcttcacttcttcaccatagcaaacagtagttgccagcagcaagggagttccacatttggtactgaccattaaactacaccaagccgacgagtatgcggagtgcagaccacgccaagccggcgagcccggccgccgacaacgcaagagcaaccatggttgcgtgcggccaagaggaagatgaggagagcagcagatgagcagaacttcagatgaactctctgatttggggacaagagataaggatgcagtggt

SEQ ID NO: 8319 - DNA, 16611 bp, Oryza sativa
  unsure (1)..(16611): unsure at all n locations
nnnnnnnnnnnnnnnnnnnnnnnnnnnnnnnnnnnnnnnnnnnnnnnnnnnnnnnnnnnnnnctctagatactactgagagcaaatagattgaaccagataaatttattcgagaaatgaaatgaaatttatttgtgaacagataaaatttagtttggttagtagttactgggaattgtattactgtgtgaaactattgaattggaaaacagtgtttgcctatttttgtgtctatccataaacgtcaaccttacttcataaattctcgttttatccaaactactaaaaagttgcagagatacaaatgtaggacaaattgatactacggtcatcaaggaaatttgcaaattgcaatgcatgacacacattgaaagccttgtttggcatcaatttcaccaaatttcttgagctttacaatatttcattctcagataatacgtcattgcttttctcttagagagttcttaaaactattcactgaacttgatttgttaattgacatcatgagttcttgattctttatcatctttgtttgtttcacccctctaaagcagacctcaagtcactgccagagatgcgtttcctacctgacccacctcccacgccaacaatttctccaggtaaacgttattcagcttgttcacttatcctgtgaccttttggccactgactccattcgtgagataatcctcatccgtatcatcctgtacttcgcctctgctcacatgttgttttgtctcaattttggggtatgtgcagctataaaactatgatagtagaaatttgaacttagtaataccacgaaaagaatcacatacgtaattgtgcgatcatggtatactgttacttgcagcatctcttctgttgagttgtaagacttgtaactgttactaccatttccagcatggagtgtcctgctgatgctatactatatgtataatcttctcatctttcagttgtaacagtactttttagctcctgtatgaccatgatcatatcgtctatttcatcgtttaatcacagtcacggcaacgcctatgtggactcgctaatctgttgtgaatgcctgtgcagctgccgtcccaggatcaatgcccccgacgacggaggagcgttcgacgcccgtgcctgtgccgccacaggaccggtctggatcggagacctcaactcccagccggaatttccttgtggtgttgttagccctaacagcagcagcagcggcagatttgatccagctgtagttctgatatgtcattgcccatgcccagtactcacgctcctgacgaacttatgcctgttgcgtctttcctctgtcggtcggctttggactcaaatcaggtggtgccgtgtgttgtacagatgcaggggaggatgatctctgagaaattttgtccggaatggtgatgttttctcttttggtgtgctccgatagtccgatccatggtatgtcagtacaagtgtgctgcttctggctatgtcatgcaccattgacaacattcatagggtacggatagaatatggtttatattctcccatagtcttcatgtcactggaagccaaagaagagcatttctgcagtcacacggtcatgcagcatccgcactcaatcgatgtagtaatatagagtccagtcgcgcacaagtcaaacagttaaacaaaacccgtttggctcaccttgtcaaaatgttggccatgcctgacgtcttcttctacaacctggccagctgggccgtttggttcggctcctcgcacctgattcacatatccagcttaattcctttaggattatttattctattttttaaaaaaaaatacatcctgtcaagaaaaatattctagtatttgcttagaccacttgtcttaaatagtttgttaaatttatttatcacaacatttaatttatccctattaaaaagtagataatctacaaaaaaacagtccatccaatattttctaaacaaagccttaagttgaacgattagcgaatggctggtgcaacaaaatcaacgtagctgcttccccatttacgttccaagatggccagcctatgtgctaactgctactaccttcatcgccacaagtcaactggaagtaggcatcagggttaccttctgcagaggcaacccagtctagtcaagcccagcaacttgcacaacttgaccaagaaggcaagaacacacacaccctcgcttgcttaaattctagctgaattccattcgattctagtctcactctcatgtaaagccacagattgttcaaacctctgcattacatatacccaagaattctcagaattacagatttgcaaactgcaacatccactgtggatcataggaggcgaaattgtgcaaacatatttggagttaattaattctagcaagcacgtagtgacgaaagtgcaatacgcacgcatggaaggatcgattggtgccaaggtgtgccggagcgtccggtcatgctgggctcaccggtggacgaggagctaccggcggctggcgccggcgccggcgacaccgaggcggcggcctgcggcggcggcggcggtcggcggaaggatcaggctgggcaggcggccggcggcggcggtggcgtggtggaggttctcgcagctacgtgcggacacgcggtggtggtggccgtcgtcgtcgtcgtcgccgtcgccgctgcagctgctgggtcgcgtcgtgggggagtacctcagctccgtgcgacgacggcggcggatgatgctggaggaacccgcgagctcggacgacgacgcgtcgtcggcggcggcggcggcggcgccgacggcgaggcttcggcgtgccgcgtcgaggcagtacggcggccgggtcgacgggagaggggtggtgctgaacctgtgcgtggcggaggcgctgctgctccggcggagctcgtcggtgaccaggaggtcgccgctccgggcgaggaaggctgcacgtacagggcgagcctcagcttagctcactgatctcaaaaaacaatcgatgatgcgctaccgcctaccgtgcgatactgcgatgcatcgatatcgttcgtcagctcaagtagcttcaatctacaacaactacaagactataaccgcacgatgcgaaccttgggagctgttcctgcaaagtgttttacatgatgacaggaggaattttgggaacaaaaagaatactcccttggttttatattacaaatcgctttaacattcttttttaaaaactttttaagtttaattaagtttataaaaaaatatagtaacatcttccaccgaaaactaacatattatgaatatatattaaatgttacatgtaactaaactaatttaatctcgtagatgtagctagattttttttataaaccaaatttaaagaagtttgaatagaaaaaaattaaaacaactataatatgaaatggatggagtaatttaatatgagcttcattggtgcaacagtggtgtgtcattttttttttacaaaagaaaatttgtttatgcccccaacaaattcgatctcacgtgcagtcctatttacagaggggaaaatgagcatataaaatagcaaaagcgtgtagcgcgcggctgcaaatcccgcgcacatgacgcgctgatgagtgatgacacgcgacagcgaatccggccgcaccactgtttccgaccggagatcgttaggtgcgatgcgaaccgatgcggtcgcagagattcacatctcgcgggtggagcccactcacattcttcaggaagaggggaatcgggaatcccatgtggtggggccgggctgtgggccccaccaccccgtcctccaccttaaaaagctttgtcgctgccatggcatatggcgtcggagtcgaaatccccccccaaatagttggtggtagcgatcagtaggcaggagaggattaggagggatcggagaccgacatggcggaggaagggcagcgcggcggctacagccggctcgccggcgatgaggaggtggctacggcgagcggcggcggcggcggcgactacgacgagcggaagctgaggctgctcggctacgagccgcagctcaagcgcaacctctcgtacgtaccccctcctcctcatcatccgccatactcatctcgttcgcgctcgctgcgatccgcgcggtcgtcgatccgtttcgattctcgtggccggatcatccttctgaacttgcggttgatcgaggcgctgagatgattggatttggtcgtgttttatgtcgttgtttacgtgtttattaattgtggtttcgtgttgacgcgcgatgggtagctagtagtacttgcttgcgggctttgtgcgcttcgctccctattccccaattatgaagacacgcacactttctaatgctggcaaatggaggaatttaagttcaaattgtgaaactactaagggcttctttaaaacatacgaatttcattgtattttcgtaggaatcagttcagtttctgtaaagtttctctaaacatcctcaattcgtaaggagacttaagaaaaaaaaaagaaaggatacttaagaatatcccctttttttttgctgtcactaggatgcagagttgcagactgtccttccccaatctattggagttttatacattatatatttgcttagagatcaccctatcccattagccaaacactgcctatatattttcttagagatcacagtagtatagtacacatagagttgttgatctttagtgagcccaaagtagttgaggcctagatttcaaactcgtccaacagggcctatctaaaaccaggccttctggcccatccccttcggcccatcagaaaacagacccctttttttcagttttttttaagaagaagggcactttttatatatagtatatacagcctttttaaattgtgatcttaattcatataaccactagactacattttctttcacagatctttttatatgctttttttgcatttcattttttttaaaaaaaaaagagggaggaaaagaaatgaacaaaggaaacagggaatcagcgaaaggtgtcactactgacaatttttggcgtgcaggctgctgtccaacttcgcggtgtcgttctcgatcgtgtcggtgctgacggggatcacgacgctgttcgggacggggctgcagttcggcgggccggcgacgatggtgtacggctggcccatcgccggcgccatgacgctcgtcgtcggcctcgccatggccgagatctgctccgcctacccgacctccggtggcctctacttctggagcgcgaggctctgcagccaccgccgctggggccccttcgcttcatggctcaccggctggtaagtatcagagtacctccctttctgcgtgtttgtttactaagcactccatagtaatttattatcaatgtactactgataatgtagtagtacttcgtaggttgatcacatattcctgtgagtaaatgtcaacaaaattaatctaatcatgctgctttagttgattaacacaagttttattattacgcttatgcttattcttataaatccaaatttaaattttaaattttaaaacttaattttaaggttgattttgtggtttttttttatcgcagaattttataccatttgcttttgaatcactaacacgtatataaaagttgagctttatatacaaatactttcttttaagatagtgaaaatggattatacctcctgcctatacccataaacagatctacagccaaaagccaaaaaaatctcagatgcaacgcctgcgtacgtgccataggttggtcaacgtgagtacgtgagtccttgctgtccgtggattacagagtacggagtcggagtagttaaaattgcaagtgtgggagcaaaaggcaaccgagccatgaacacgttctgtacgaatcagtcggccgcggaaggaagagccgcacttctctttttttttttcctccgtcttggtggcgcacgcacgtaaaaagatgtcggcctcgcgctcgcctgcttggtacgtgtcgtggctgcgcgtgcggcctctcgtccaccggcgtaggggtgaggcgaggtttttgcgagcggcggcacgtgcgtcatgcgatcgcgatcgacgcacgtacagacagagccatcgacgtccgataaacaggaggatatgggcgaaaagtcaatcccgaatcttttgattgcgcaaagtgcaaagtgcaaaaaaaagaaagaaaaaatattagttcttttggcatctctagcactccacggctaggcccataagagcacccgcaatggtaaagtaaggtgatatctataaaatatgtacatctcagcaatagactagattaataataaaccacttcaatgatatgtctacatgggtatctatagctctctaatcaattgtctcgtttttctctatagactatatccaggttagtagatagctttgctctttctcttcatttaatctcttccaagcaataaaatatgctgacatagatatcttgtagatagtttatagataatcattacgggtgccctaataattaagtctagttgagtgagtacgtacgttaatttgcacgtacgcccggctagcgaatccacacgtctctacggctcgtttaataaacacgagacaggttgcaatcaggacaaagcaaagagaggaaatggcgtgccaggctatatatgctcggttgttaatttcgtgttgtgtgccgacttcgaatcccgacatcccgtagacacgatccggcaatataagagcaggtacaatcaataacatgctataagatagctgtaaatatattttaaaaaattaaatgaggagagagaagagcaacggactacagatttatagccagctgtagcacggactctaagacgcagtatgcgtatgacaggtgggaccatgtattaatagtgtagtatgtagctattgtatgaatgagctattagaatggctatagataaattggagctagtagttggctatactattaaacttgctctaaggggaaccgttgacaatttaagatgtatacatgtctgtctattccaacctttcattctctcagtcatcttcaaagtctgtttcttaggtgcataatataggctctgcatctttcctatgagtctgaaatcattaatttcaaggaatggttaaattcaaacaacattttcttgtcagatactactcccaaccacactaatttccggttgttactgaccgagctatgttaggcggtgtttggttggagggattaaagtggtgctaaactttagtccctctcacaaaaatataagttcttaccatagggacttatacttttgtgagagggactaaatttagtccctagttcccaaacacccccttaaaatggttacagacaaaaaaaaataaaataaaaaaagaaacatagaaatggaaacgaaaacgatttgctttgccgcgtatcgatcatttctgaattttaccatgtccttacggaaattatttttttctatattgtggtaattatcgtatttctattttatacttcaatgtttccgttcgacatcaatatgtttatgtctatataatttcgtttttatgatatttctgatactgtttttattttcggtttcatcgttttcgattttatttccaagatatatactctatccatcttaaaattaaagaatctagtattgagtatgttatatcctaatactatgaatctaatattaatctaatattatgaatctgtacaaatccttcttacgaggaaaatatccacaatagtaggatggcagaaaaaaaagaaattgcctctttgtctcgtggttgactgaaaaacaatccatatcctgccaacccgtacgctagtactcctctgataatctgaattgaccgtaacctgatcctttgcagcacccaaaaaaggggtgtgtttagtttacactaaaattaaaagtttggttgaaatttaaatgatgtgacggaaaagttagaggtttgtgtgtgtacgaaagttttgatgtgatgaaaaagttggaagtttgaagaattattttagaactaaacacggtgaagatctagctggtgagtcatgtcgtagataagaatataaaaggttcttttacatttctttccataaagtgtcaaatataatttgctacttggtgtgcagatgatgaatcacgtttgcagactcgcatgtaacagaacctgttatttttataagcattttatatgccacctgacctgcgtacgcagcgcgcgtgctgtgcgtgcacattttcaccgaatcccatcctgcggtcctgccatctctgatgcacgcgactttatttttttttctgaggacttctacacgtactaaaacttttttacaaaacatttgcaaacaaaattttcaaccgtttaatttaatttcatggaagttaaaataatcttgatttactcacaatatgccacgtcagagttactacgtagagagcattttgtaagaaaaaaattagtatgtattatatactgtactttccttttttttcttattatatcccttgattgggtttcgtgttaaaattgagacatctacagtctgtgtcgtatgattcgaattcccatggggttggggtggcccgtacactagacgcccgaatccaaagttgcaaacctttactttagtttagtaggaacactttactttatgaaactataaaaaagagattacgcgtgttcatgccatctacttaaaaaatatatatctagcacgaacaccaaatagtaggagtactaagagcaagtttaatgaggcacaatcagcagacgataagagtgccacatcatctaaattcattcgtggaggagagagaaagatagagggagagggcaacaggcgcttctgcaagcgccgagctacagcacaagaaactatgcatattataggaaccaatgcaaaatcaatattgtggttgtttttctccaatagcatagctatggccccattagcagaacacacgggataggatagagagtagcaagttagattaaaaaatagaaaaagttaactacctagagaagtgtgtaggtagattagcagcctgctattgtacgtatcatctttattttctacctccggatgacatgtacatttttatcaccagttgatggcggtactattaaacttgctctaacttatttctgttcgtggcggctatcaatagtttaaagagcagcaccatgctgacaggcaaaagaagatattagtttagggagattcgcactcaccaggaagctcaatcaaaatagcaaaatagcatgactaaaacgtagtattttagtttttctttttcgttgtttgttatttatctcaattatgagattagtattgtatgcactcgtgtacttttgattgtgtatatttactagtggatatgacaattttttatccaatatctaaaacatatgctgacagccaaaagaagaagataatagggagattcggattctcgtcaggaaagctctatcaaaaatagcaaaacggatctccacccctcgtgggcaaatggggtctcgtctcctctttttttaggcaggagggagcaaggctagattcctcaccccaacactgtcgcagatcccaccatcttacctggcagattcggtatcagcgcgtgccagtccgcccggcgcccggaggtaaagcaaccaaccaaacaaaccatcacaaaccccgcactttcgatcgtgtacgtttgaccccgcaccccctctcccccgcccgcctctcggcttcggccttcggcgcgcttcgcctacaagtagtagccgcgcgcgcagcacaccacaccaccacaccacacacggtcacacgtctcactcgccgcgacctcccctccaactccaacctcgcccttctcctctcccccgcgcgcgcgcaagcgagcgagcgaagcgccgcaatgacctggaacaaggccccggctgcggacgccgaagccggcggcggcggcgacaccggccacgcgcgcctccgggagctcggctacaagcaggagctcaagcgcgacctctcgtacgtcgccacactgcccctctctctctctctctctcgtcccttttcgcccttttcttggctgactttaaaccggttcacgcgcgcgacggcggcgtgcagagtgctgtccaacttcgccttctcgttctccatcatctcggtgctgacggggatcacgacgctgtacaacacggggctcagcttcggcgggccggccaccatgacgttcggctggttcgtcgccggcgccttcaccatgaccgtcggcctctccatggccgagatctgctcctccttccccacctccggtggcctctactactggagcgcccgcctctccggcaagcgttgggcgcccttcgcctcctggatcaccggatggtacaaccgccattcttttttttactaatccatagcggttaattttttttgaccccccattttttaattactttactactgtcgtttgcctgatttcttgccttggttcggatcatgtgaattgggggcgcacgagaaggatcatgatacttgcatgtgaacggggtttgttgatttactaattgttaggccagtttttctcttttttttttctgtttcttgttgggagttcaagatatatatggataatgggaacattgtcaaaaagcttgattgtttttctttctcatgttcccttccgtttccttgttttctttctggagtgacatcaaagcggcatcttcaaaagctctgcaatcttctctccttcttttcctgctgaacaaaatcttttttgttccgcccaattagatggagagagagagagagagagagagagagagaagtgctgctaattcgtactactactttgcactgttctgatgtcgtattcaatgatgtggtcctattaatccaagtaggaatttttgtttcatgcgttttagtcaatgttccattctttgaccttgtgcagggagagcattgggcaaagtttagaaattttggttttgatgacgactgacgatatagtgtttgatcagggttaatcattgaagcccagtagcagtagttcaactgagtatatatattgtgctcatatcaacttcttaatactaaacatttagttctaagtagctctgggaggggatatgggtttacttcgcattcattggaaatctgtcacactgtcagcatatcccttctcggacaagtcctccatttctattcccagcaacaaactctcatttgagtactgatgatggtacttattggtcgtgcagacatagtcttcattctgataccactgaaacatgacatcaatcaattatgttcctttcaacctgtcaccataatgaattgggtatgatttgattccaaaacagttactttcagcatctaatcctctgttgttttttgcttgtttgtttctgtcacctgcaggtttaacattgtcggacaggtaaaccgaaccaaaccatcccttctctgaactttcagttcttatctgaatatctgaactttcttctgctttgcagtgggcggtgacgaccagcgtggacttctcactggcccagctgattcaggtgatcatcctgctcagcactgggggcaacaacggaggagggtacatggcgtccaagtacgtcgtgatcgccttccacgccgccatcctgttgagccacgccgccatcaacagcctccccatcacctggctttccttctttgggcagttcgcggctgcctggaacatgctaggtgacacctccctctctttgacctgacaattcgcataaattgaaggattcagtgattcgttctacagagacagacagtgaccagtatttctgaaggagatttgtgtggttttctgcaatattcaggtgtctttgtcctcatgattgctgtgccgacggttgctaccgagagggccagtgccaagtttgtgttcacccatttcaacactgaaaacaacgctgggattcacagtaacttttacatcttcgtgctggggctcctgatgagccagtacacgctgacaggatatgacgcgtctgcgcatatggtaagggcgaaaaaatgaacagctcaagagctaacagacaatgttgttgtgccaagaaatgtttctggccaatctgacattatggttcttttgctcatgattcagaccgaggagacgaagaatgctgacaggaatggcccgatcggcatcatcagcgcgattgggatatcgataatagtaggatggggatacattcttggcatcacctttgcagtgaaggacataccttacctgctgaaccccgagaacgatgctggagggtatgccattgctgaggtgttctacctcgccttcaagagccggtacgggagcggcatcggcgggatcatctgcctagggatcgtcgccgtcgcgatatacttctgtggcatgagctcggtaacaagcaactcaaggtaaaaaaaaaaacaaatgaatgactgaatcacaatggatgacattctagtgttctaacttttgtcggtagagcaacagttcactcactcactgctatatgtatccatattgttcttctgattatttttcgcgaacgtgatttttttttcgcgaacgctgttcttctgattaggatggcgtacgcgttctcgagagacggcgcgatgccattgtcgtccgtctggcacaaggtcaacaagcacgaggtgccgatcaacgccgtctggctctcggccctcatctccctctgcatggcattgccggtaagttcctgacaatcttgttcacatctcagaaagtttcagaaaacgcaacgaaacattgacaaattgattcttgctcaaaattctcaaatactgataataacaacaacaacaaaaaaaaactatgggaaatgcagtcgctggggagcttggtggcgttccaggcgatggtgtcgatcgcgacgatcgggctgtacgtggcgtacgcgctgccgatcctgttcagggtgacgctggcgcggaagcacttcgtgccggggcccttcaacctggggcggtgcggcgtcgccgtcggctgggcggcggtgctgtgggtggccaccatcaccgtgctcttctcgctgccggtgtcgtacccggtcaccaaggacaccctcaactacacccccgtcgccgtcggcggcctcttcctcctcgtcctctcctcctggctcctcagcgccaggcactggttcaaaggccccatcaccaacctcgatggctagctaagccaagattgaggttttggttttggttttcgccggtggatatggaaatgcagtgggagatggaagaatcgtcgtcgatgatcggaggcgtttcaggtgggaggagaagtataactgaagaacaggtaagaagatgatctggaagggaaacgggagcatatcatgtcatggtggtggtgttgtgattagttgttgatttgttcagcgaaattatattacgtggaaggggattatacattttatacactggttgtagattgacaatatgtactaagaaattgacgattcaattgaaggctaaaagcagctgaaacagttgtggaattttgagtgtgtgattgcgttattacgttgcaagtaaatgttcgcagatgtaaaaaatattaaaatattactactacatatttaatccatccatcttataaaaaaccaaccagtatctaacacatcctagtttcataaaaaaccaacctaatatagtactatgaatttggactagtttttttattagacggaggaagtacacccctgaggctttctgaaaagacgatctttatgacgcatggttgttgacacatgctaaacaactatcttaagaaggatcgactattttacaggtaaccttatcgttattttctacaaaatgatcggagatgccttcttacaaaggccccttatcgcctttctaaggctgagtttaggagatggcgctgagaacttcacctcccccacacggaaaacaacattacccattaacatgtgattagttaaatagtagcttaaaaaatctaaaaaaatagattaatataattttttaaaattaacttttttataacaaacttttttaaaaaaatacagtgtaacagtttaaaaaacgcgttcgtgaaaaaaaaagtgagttaggaaataacgggaaaaaaaaacacagagcagatcagcggccgccggagccaaaaccctctgaatcttcccgcggaagggaacgtgtagtaattcaggttcagaaatccacagaacttcagtactccaatacaaacccacccccaaattcaaatccgcttccaaaatccagcggcgcggcgcggcgcttccctccaattctccaaacccaaagccacccccccccccccccgcgcgcccaaaccatctcatctccgacggcgagcgagcgggaggaagagatcccatctcatccaggttgcgcctcctgattccgatggtacgtacgctctctcctcctcctcctccggttcgattcgcggcggtgctgaagtgtggctggattttgcggttggtggatgcaggcggcgggtgcggaggcggaggcggatgaggaggagctggagccgctcttcgactactcccgcgtgcagcccaccatggccttcagcttcgacggtacgcgtcgctgcggcggcggctgcggccatcgcatcgcttcggttctatcgggctagggtttttctcgcgtggggggattcgcttagggatttgtctctgttttttttttctccccgatgcgcagataccgacattgagaagtccgacatcttcgtccactgcaacaagcggcgcaaggtggccgacggcgacggcgacgccaatgccgacgtgagtgcgctcgaattcaattccagttttacggtgggggaaaaatgtttgacgcgctggtatgtgttttttttccttaggagaagggggataagggtgagcagaaggccgcgaaggctgccgcggtagtcgacttgggagaggaggattggctgccgccgccgccaccccccaagcccaagtccactgtcacggacgaatcagagcagagcagcgtattgaaggagctgaggtataaacctgtgcatggttccattctgtaagtttacctggtgatgccgtatgctgattgctgctttctagtatcatatcgggatccatacttggtactccctccgtcccaaaataagccaacctcgtactagtacgtgacacatcctagtacgaggttggcttattttgggacggagggagtatgtattagatgatgcggtgagcttaagaaagtcataccgtatcaaggtgtacagctgtgtttcttttatcaactttagaatgagcaactatattatattttgctattgatgaggaaagcattgttaaacaggtattgttgtttgatgcgagattattgaagtcaagacgttccaatttaaaagctgctttattaaatttcgcatcattgaacctaaagtgcttgtcttgtatagattaataagagtggaaggtagactgtactgttgttttcaccatcatttttccaagtcatggacagagctgtgcaacattttttttagatgatgcagatttagtgcatataaggcgaatgcactgctgtttatcgaagcactcagtgccataacaactcatgtttcatatggccagagtaccctttgcttttctgacagattagtgaccaaaatcggaataccctactgcatatgacatagccagcatgttatcccaatgagtggtgaaatcgattgtttctgacaatttccctagggaaaatagtctgcgacctaaagtttctggctgtagtctgcttgacggatttcgatcaggtgcagttggtaggtgcagttggtactgtgactgcaacttatgcagtccactgccacctgttagatccgaatctaacggtccacatgcacctggatactgtagatcactgtagcaaaaatattcggtattttgcgttgatactgtagctgatgatctggtccattcatcaccaaaatgaatggctgtaatcgcgtgcagtagttaacttgcagtcgctgttcatactgcaggtgatcccaatccctgctggacatccaaatatatctggaagttgaaatggaagtcctgtatatactatgattcttgcagtgatgttgtgtacggatttggaagcagtgctttgtttgttttgttttttaattaccgattcctagagatgtgaatttatgatcatctgatttctgcttacgtattatgcagattacagaagcaagcaatggcgaaatttgctgaatcagctgatgattttctggagaagttggctcaaactgctaggcaaaaggttgaggccagaataccaactgaacatatagatctagacaagtcacctgaacgacacgaagcaagagaaaaggtggtcgtaacagttcaggacaaagctggacatcaccagtttcggttatacaaggttggttttctaatggagtagcactgcttatattaccaaacctatatgatgttcttagacatttttaggcagttcgaattttctaacagatggttgtgaacttgtgataatttggcatgctcttctttaa

SEQ ID NO: 8320 - DNA, 24525 bp, Oryza sativa
ttttccttttgccaactcttcttttctcttggctttgtgaatctatcacgagcgtgactgcttttattgaatgtgtgcgtccaattgtttgtactctgtaaagaaagatagtatccctctacattatctaattcctttaaaattgggtctgtttgaggaaattttgacagctatagcttttctcagaatcagaagtttttttcaaacagtttaactttttattcagattctgagatgctacaagctagaagctaagtttaccaactagttgttttttaagaatattaaactccctcaaataatccctttatttccttggagctatcgaaaggtactactaatattctccatgttttggaatcatacatggttctattgtgcatctctgtatttttttttctattcccgtgttcgcaaaatcatgtgttaaaaagtagcacttgcattgaattctaccatcctcttagttatcttacgttcataaatcgatctcttcaatttttgttgcctactcccatcccaaaatgtgcaatttttaggttggtacggatattaagaaagtagattggaataattggaggaagtatatgattggttgagaagagaaattaggtgaaagaaaatggttgtgattggttgaggggagaagataggtgaaaaaaaaactttattttagatttattttggaataaggtattgtgttagaaatatctacattttaaaacatagacaatatctgctcactaataactgtttccctgagcattttaggacttccatttagaacaaaggaaatatgaaagaattttggattggtcccaaaagtttcgtatgaaaaatcttatgaaatgagccattacattggaattttggagaaaaacaaacatgatggatgtgtttgttatagctactttgctaagctctcaccaacacgcaaaccgctgtggataattagcataaaattaattaagtattaactaataaacctgaaaacagatttatttatttctttaaaacaacttcgatattttttttaaaaaaatattcaacaattaaaaagcgtgctgatattaaatgagagcagctccttcaaatcccaaaaccgagcgcatgtttgctccagaccatgagttgagtcagtagctaatccaaaagaaaaagaaaagatcttcatattcttatcagctaatcaggatactccctagtcactagctgcttctagattcattcaccagctggccaacgccctcgaactgggcctttagattcgaaccatgaaaacgggtacgagaaagataagacgatgcatcacaacacataaggaaaaagactaacagactttgtaacttatgatcagtacaaatcagagacatgttgagagttacagcacgccaacaaacatttctacagagttacaaacttcagaagctaatagagcagcatacacggtacaactgaagacaaccacaaaacacaaaccaggttagttcttgcacccaaagcggttcaagattttttttttttgttagctaccctcttttgtcatgtggtcacctggagcaagtcatttccagagcttgacaaacctatcatggcttactgaggcaaccttgcctgttgcgctcgatgctgctagcgctgcaactaaaccatcatgagcactgtggaccgtcatggcgttcttctccctaatgtcccagagttccaaagactgcacgacataaataaacaaacgtacactattaatcaaatgcactcacaaaataactgaactatgccaaacaagataagagacttgcctcgtagcatccaattactagcaaatatgggtaagaggggtgaaaaacgcatgactggaacttgttcccgctgcaactcaactcattcacaaattcaccgtcatgtccaggagcaaacgaccatattctgacactatcttcactgacagaagccagattgtcaccggtagaatcccaacaaagtgagtgaatattctttgtgtgcccctacagagtacagataccaataaaactttcaatggaacttgaacctaaagatacttgcaattgccataataaaaatattgtcatataaagcaagtcatatcaatcgagcaatgatctctaacatgtaactatttatattggagtaggtatatagcaaagaaggcattaatctgagtgcacagaagtacagaacagggctcaatcttgcagcttatatatacatcttattatgggaattgccattgtgggtttcttctgcaatactcctaccaggccagacagaaaaaccaatggaaatttgtccaaaagtaaactaaattatacctcaaacctaaagaaatttcattatcataaaacctactcatgaaatttttgcaagagttttcccccaaaatttagaactaagaaccaaaggatttgtaaatcaaatgtaatgggcttaaaaaaaaatccagaactgctaaaaaatcaaggatataagaatattcattggtttaatcacttttctgaacatccaagtcctaacaaacctatttatgatgcactgtaccaagtgaatgatcaagaatggcaaccacaatttggtacgagtaactagtggtagtggcggaggcatggtgccgcataaacagcaatgcagttaattacaagggctaagtgaatgcttccttatacacattctgaatgggtaaatgctaacagacctgcagagggtttctacaagcaagttgtgtctctccatcaagtatgtagatggccttctctgaggcagctgcaagatattttcccttttgaggttgaaatcgcatctgagtagcacctccctgttgggacaaaaatgattggaaacagagacaagcatcagaagttgaatgttaaagcagaagataccatgaaacacatgaagttgcattgcataccttaaagaccttaacaaaggtcaggcagctaccattatttatgctccagctgcggacttcaccatcaccatcacaggagcaaatcatatcttctttgttcggatggaagtcaagtgacataacagatgctgaatgacccgtgaaagtacggagtgaataacttgtctgcacataatcaaatgattagtcactacatggttttaggttatggaacatcttgcaatcactatcgcaatagtttttttttgaattgatatcacaataagctattagcaccctaataggataactttgcaataaaatataggaaaatgtccattttacaaaattgaactcaagaaaaaagtcttgaaatgatcacctcaaactacaacactagacattttctagctcaaacatccaaacagtttgctttacagttgtccggttgggtttgtagttgatggttgattcccaaacttaaaagttcaatgttgtaaagtggagcttttttttttcttaaaaatatatatggtgaaaaggagtatacattgtcagcatcccaaacccgcacggttttgtcaaaggaagatgtagcaagccgtgacatgcttggactaaatcgaacatccgtaatcaatgccgaatgttcttctaatgaagatgtaggctttagagcaggctctgtacaccataaaagaacctgcgcagagtaagaggcatgcgttaaagattttcatgcactaagaaatcaaaatatattgtgttaacaactgcacctttttatcatgtccaccagtagcgagcagtttgccatcagaggagaagtgacaacaggtaactttggttgcacttgcacgtgccttcgcaacttcagcaaaaccaaaccctgtataaacagatcaatcaagtgcgatcaagcagaagcttcatcatatggccaagagaaacaataagtaaaatcacccatatcatcttgattatgatctgttatggagacatttcttatttaatgtgtaatcagatgtgatgatagatatttaaaatgtaacagtggcaagcatgttttgccttctcaaaggcctgtggtggcaagataaaaaatgcagattattagtgagactatgttcatttatttatgactcctgttgattgcatacagcagccaggtatcagcaggatattaaaatacctttactagcatccatggagcgccccaatgaatccctagggtccatgtcatcctgagatagaaaagattcaacattttcatccaatgaaccatcttctagcaaacgatccacgtcagcctgaaattgaaaactttctgtggtcatgttgttaaatacaaatgaaaaacaagaataaaatttgggggttttaaggatatataacaatactaactgatgccctcagttattgcccgaatccagagaacaatctccaactctgaaaactattcacatttcaccctccacctcaaactatcgaaaccgttcactatgttggcagtcaaatcactaattctagtcaagtctatatagtatattgaatctctttgaatgagtaatcacttactcttgatacatatcttgtattgaatctctttggatggatggatgagattagaattagtgaagagtaaaaagttctttttcttggaacacagggcacagtccatattcgtagtactaggttactatattttaggacagatggagtaagcgagtagcactaagcaatttatttttattttcttaatgtggaaattctagtcaacactatagtgttaatggaaatctgataatcctaatgactaggatgagtgataagggatggagtgaaactaaaagaaaaactaagatttttaggaggggtgctgacatactgatatggtcaagacaatacctaagtatgggttacgcacatgctttgacacaggtcccacaccacaaaaaaccaatgtggtttaaggggaggacgtgtttccattggttttaatagttgagggacgaaagatgataggtcaatgttcaaggaggttttctgaatctaaattgtactcgaatggtcaagaatggagttgttccaaagaaaatatgtccataccagtgcatttgctggagacgtcaaacttccagcaccatcagagccaaacattaccaatggttttgcggaaccaccattctgctgcagctgtggcatagacattgcatctcctggtgtatgagtggaaggcgttgatggtgcagaacttggagaagggccagcagtatttgcagttcctgaactattggctctaccagaggatgaaccaggtttcttcctcttctttgtagtctggacaacaaacagcacagtttatgtgactcaatgactgtggtcaagttaatatttactcttcatattatcttaaacagtggcaagcgttttgaattcctttttgacgaaaggtgaaagaacatcagtagcagcaagggatatggtgactctgtcggcaggaaaaactacacaacaacataatttctgtgccaaaggacaatcaatttcagaccaatataatcaaagaatgcacaaatcacttagctccacagccttatatagtagattcatttccagtgattacagtaaagcacaaagcaatcagctgagtcattgaacaaggcttgagtttaaaactgaaactagcacacgatacatttcatggcaatttttgtatcacgtagaaatactataattatatataatatatatcaggatagaaacaaaaaagcagttagattccacaaaactgacagtgatcaattcagaccacaacgaacagtagtatattaggtctaagcattaatgcaaatggagcatggcaagcatggatgtgtacagataagaattatacttgatcaactccaccgaaagagtttggcatgcccccatcaacaggcatagttccgattcctggtttttcttgttggagaaactgatttgagctttgagactgctgactggagacagcaggctgctgaagctgtggatgctgctggctgttgctttgctgctgtaataattgttgctgctgagcaattttcttctactacgcagaaaaatccatataagaacatggaacatacaaaagagagaaaaataacgcataggaaggtgtccatagaatgagaacgatggaatcattacagtaatctaggtcaacttatatgcataaggtaagcatacagaaaagagcagaaatgtaacaaatactaaatgataaataaaccatcaattccatattagaaaacatagaacatagatattaggaaaattgatggatacaaggtaaatttgagttatcttctcaaaaatcgaacaggcagcattgtacttatctctgtaaagaactacaggtctagtataacagaaaaatggaagagagctgctaatccacattcagcaagaaattaagaaagcacaacatgcagtaactgcaaaacctagaaagtaaatctaaacaaacaaaagcttttacaccagtttaatggtggaataacacttgtaaggatgaaaaatcaaaagatatacctttatcaggatatctacatctccaccacttagactaggagaaccaatatttggaataatatcaccaccactgtttgtctgcccaacattcctgttgttaagcatcatccttaatcgtctgctgtcaacatcactagatgttggggaagccatattttgctgagcctgcaacataagctgctgctgctgttgcggggtaagaaaatgaatctgctgttgtaattgctgttgattctgcacaaatgacttctgctgcagaagtccagagcgaagttgttcaagtccctgtgaaaacaaaaagaaaaaaaatggcacatgaaaataagcaccgagagatagcatatgcagtcaattaataatagataccaatcacagtcgtttaccactatattggaaaataaaattgcaagttggtcccataattgctaccaatgatattaatgctggcatatattaccaatacacaaactgccacaaattaattacgtatatgcagaggaatagacccaaaaagaaggatggatttaaagttttaaatataagatgaatcagtaaggcaagtgtgaaatttgttgaaagatggtcaataaaataaaagtttcttggaattaggcgcttgccaatggcatttcttggattttctcataaaataaactgagaactacaattgcactatgcaaatggacagtgcaaacaaaacaaaaacaacacaggaaaacttataagcttatcttgctcagtagaagtgctacaagacagtctatgccattaataaactagagaaagcatgaacacccaagggagaaaagaccgctgcatttcctctctataggggagttaaacctaggcgcagtctattgcaggagcattaatcataaggaaaatgcataaaatctgtatttaagccaggcaatctatatagaaaccattcatgtccaagactaaagttactacttgatcataaactaaaccttaccgtgagtggccatcctttcagagtcaaattgtttccagcttgattagaccctgttaaaaatacatctgattaaggtatgcataacataaaaaagatcatgttccaaggtcctataattttacagcaaggctaataaactcttcaagattgaactaagaaaaaaaattacaagaaaagtaattccagggactatactgaaaacatgttaccttggacaccaataaatgacccctcaggacctgctgaccttggtgtcaaaatgggattcatctctgtcttgatactctgctaataatatgaataatattaggaatacatgttgacatttattctttttgtcctcctcgccttggaggtaagcatgttaggaattagagatacatgacagatcagaataaacagaagactaacctgagctggcccaggaatctgtggactcctggactgaacttgttgcagactgcctgacagaccaccaacagtaccatgcaaaatttgcctacaaaggaaagaagtaaactatctgagaaaagttacctcttgcagcgcatgtatattatggtcaatataaaacatggtgatgttcaataggcatctacattccattaaataagcaataaaatatgggaatgagatgacacttcagtatattttgttttggacacatcatttttcaaaacataactaaatgatttatatctacacaagtaattaagaaccaaaattaagagccaaaacaatgcatgcatgtaaaaaaaacagcaaaatgcagaagcagcaattccaagcataaataagaataacaaatagaagtgtgtctaatttatctccataactaaccaaatgactaaaaagaaaagttcaaaataaaataatatttttcgaccaacagatagacaactctgtgaatttcgataccagaagtactaagtgtagtgtggattagattacagtgaagctgtaacacgaatggtgaaatatcagctacaactgtacacggtataaagcttgttaaagtaattatatacttaattcacaaattcagcaggtaccctgaagattgtccacttgcagatgctttcaacaacgcttcgtttgaatcaagtagttgtccagcattctctccatatctttgctgaaaccaaagttcacgtgttatgataatattaaccacaaaatgaacatattggtgaggtgaggaatctatagaaacaacatcaatcaatgattatagataacagtcaaccttaattgacacctcgtccaaaccatctctctgggaaggcaactttaacctctcctcatacatttttgttgccataacatttgcagtactctggttttgccgcattaaaggattgtttccaggaagtccacttgcagtaccattaagaagatgagtaccatctctgcgctgttgttgttgctgctgctgctgctgttgctgctgttgctgctgctgctgttgctgctgctgttgttgctgctgctgctgtgctgctctttgtagcaacatttgttgcatttgtatatgctgtggttgctgttgtcgctgttgaggaggttgctgctgctgctgctgttgttgctccctggctttcatgtgctgagtctgaaagagtggtgagttgaagctgagttagaactgtcaattcagggaaaaagatctcttcaagttcatactaccataactaaagatgcaaatcagacaatttggaatatttatcgcacttgattacagcattagtaaaatatgctcccaggaaaaaaattgaatagcctacaatgtaaaaccgaaacaaaatataagttacaatggaattacctgcttgtggtggatctgacatacatataacacaagcagttgaatcataaagcaacaaacaaacagaaagaatcactaaccaatcaaaaggcagttattgacaaggtaaaatcagaaaggctcagtatctcacgcaaaatgagtcgagtcattagcgcaactaatcgagtattaattattattataaacttgaaaaatgtttttttttattttttttttgaaaacttctatatagaattttttttttgcataaaatgcactgtttggcagttcgggaagcgtgctaatgggaaacgagggagttgccatttcaatatgcagaaacaaactgagcgtaatgctttacaattcaagctgaacttatttgaaaacgccagcatggcaaactaaaatgcctgaaacattaaatatgtccataaaaagataattagatgcacagacacttacttcaatatatgaagccgcaacatctgaatgcttctcatttgtccttgctatgaaaatatcccaaaaaactgaccaccactcaaaaagaaaaccaccaggagcatcaatcgctgcaagaaacaagagttcagaaagttcgcgacatcctttactaacaaaaggtaaaaaattgtagcaaaactcatgacacaaatagcttcactcaacttgctgggaaatacataccaactggatccgaagagaccttcccttctgcttggaaggcctttgcagttgcctgcagatttctcttcataaagtagtcatatatgtagacatccagcctatttcagcaagcagtcgaacatttaggttggaggttagaaaattgccaaacatacaactcttttatccaagtacaagacaacgaaggatgttcaagcagagcggtgaataagaaactagtaggcgtagaaagaattataataaaaatgacaggaaaatagctggaaaagtgaacatattcaatggcccatctatctacatcaatgtacatccattttttcccttctagtttctcaataaatcaattagcatgctgccaacttcctctgcccattctgctataactgccctcatcttctctgtctccagtcactctgcccccagcttccctgctgcttctctccgcccccagcacaactatggctaccaccactactctgctttgccattaacttccattgccctcaatcctcccatgcagactcgtctctacctctaacgtggcctactctccttccatcccacaaatccactagattgccaccaatttcctggtgctagccatcccatcgtcctgagctctgcttcctccaccagctctgctcgctatcagccatgttgctctgcttcagcaacccacgtccgccaagctgtcacccaactctccgcttcctgcccctgttccaccagcttggactgctctagcccctcaaaccactgctgcagctgagggtacttgactcactgactggaggattcgcttctacttagctgacttcgccgcctaccactgctccagtttccatcttcgtgatattaccacattgtagaaccccacctccggcatggcaaaaggacaataaacctgcctctctcattgccacattgatgcacttttgtgctcgttcacctccctagctactttatggtaacctcgtttattcagcaaattacggactatttgtagtacgaacaccaacattccaccttcagaccgtggcagagtcgcttctttatattcaagagcagtggttcagttcctttggcacccgatgagctcttctccaggacttaccacttatgttttgactcctattgatggacacaaatccagcattgtcaagatatcagggaggaatagctgacagcttgttcgagctgtgtcacgatgagggttttagtgttatgaccacacgtcaggcccatggggcaggttaggcaggacaaattaggaatagatcaaacaaagctaagagattatctaattaggaaagattagagattagagatagagaacgaattagtttttataatatcaaagataagttccttggatgccaagtcagtcttccctatatggtatagagagggacgtcactaccgagcaacgggggtgctcaaaatcctgctgcctgctagcacagtgatgacgtggacatcaccagaatgtaacacgtcagtgcaaaactgtgaggtggcttcaagtggggaggtcttaatatatccgatataaaaggactcgtataccccattataattaagaaataaggaaatataatattaggtctggcttgataagagactcctggtgattgggccaagctcagcgatctcgcctttatccctgtctttcgatccttacaccatccatgaatcaacatcagttatattttgaaagaagcatttagagtgaccaatttccaattgaccaacactaaaatgaggcttcctagttattacttgtctatgcaaacataatgcttatatattacttaatcagtgaaagtatagcctagttaccagaagaatgggatatttccactcctcttcaaattcttatacagatcaaactgcaccgctttgatctaatctaacttgtagtagcataccagaactgctctatcaaatcatttcatccatgtctaagcgaaatcaagttattctctaagtactccctatcatactgtcagtaagtaaaccgatgtaggaggctaatccaggattccacagatcctgaaaaaactaatcaccgccaaacaaatcccgctcctctcttctcacgatcactatagctcaaataatacagtcgaatattcaaaacctactggcagaaatcatgttatcttattttcccaccggtattccaaatcgtacagagaagctagttatactgtatccagaacacagtcccgcaaaccaaaacagtgggttcgtccaataaacaaacaaagttcaaaggaaatccaccccccaaaaaaaagaaaaacaacatcgcccgcgaaaccctagcggccaaacacgccgcaacaacccttctcccacctagagcacaaggccggaaccggaaccactcacttcgatcccttcccgtgatttcatcttcaaaatcgccaaccccccccccccccgccccccagacgcagcaaaaaaaaaaaaaaactccacctcccagcaaaacacggcgtgaatccacgggaacaaggagagggaaaccccaaatcctcacatcttatccgcctcccagttcgtctgcgacatggctaccccaaacacggcggcgcgcccgcccgaaccccaccaaaccctagaagcgcccccacccccacccccaccgccccttgcccgcggccgccgccgccgccgcgcccaccgtccaacagacgccggagcagccaagccgacccgaaccgaggcggaggcggcggcggaggcgggtggtggtcgggagagaggggtgtggcgtgaggcgagtggaggaaagggggagaaagcggagagagagggagagagaggtggagacgaggaattcgtgaaatggacacgcgagagggagaggagaggaggagtgggggcgcaggcaagggtatatagtacactggctggtgacgtatcagcacacggagaatttttttggatatgtgagagaaaaaaaaaggggaaaaaaagagaggcgcattgaggaagggcggaggctgaggtgtgcttgtgcacccgcggaaggtagtatggcacagttcgggttcatcgcagttttgtccacttgaactcactcgtcacgtcaaaaagaataacttgaggacatgaaagttgtttttttttaacgggatagtaatcctattaactcaagtttaacgaaaaagcagtgtcacgtaataaaagtgtagagttattaggtttaatggtagctgctcgccaaaacttgttgatctgtactgttgttagattgagattaagatcatgggtatatctcttttcttcaatctccgagctaaccaagatccctatagaaaggggtggcgatagaggaagagtccctacaggctcaatggcggattcaaagtccggtacctcaagcagaggctctggatcacgtcattgtagtattttaaatttaagtgatcggcatgtctataattgttcacgtatatgtttgtcagatctctaaaaagtttctagacttgttactaaataggtctcaccaacgcagagtttctagggatatccctggatggaagatggcgatccagtttttaagggtgtttggttggtgggcaaaggtggatagggtggcctagagaggaaatattccatgaagatgttggatgagtgtatctggccaaattggtcggatgaggatatccacctttgctaatcttaatcattagtaattgattagcaataattaatgtattttgttgttaattagtaatcaacttatcaaaattagtgttgattagatataattggtctattttgttgttaattagtataaattatagctatattaatgataattaacatatattattattaattaatatgttattatttttattctatccattctcatccatccaaccaaacaagaaactggatggccatctccacccaaccaaaaaaagagtaccaccatatccctgtaaatatggatggccatatcctatccaacctcgaccacaaaccaaacacaccctaaatgggcctcaccaatacagaccgttatataataataagtgcaattagttgtggtgatggcagtttaaagagaagaaagggagaggtttattaagatttataggatgggtagaactttggagtaaccctagtgcctagagaatatatcatcaaggagtatcacacaaatagacaattcagtagaaaaatgcttcatactttgatttaaggaagtacatcatcaaggagtacccaataacaccatgacaatctataataagagatccattagttgtccacacgtcattgacttattacgtgtcaaataagtaaagggttcttatacttttactataaacttttgtattacaatatagcaaatcaataggctacggtagccttgagacctaagagtaaagaaaggcggagcaatcatttacataggtaaagatcacccctattctatttggcaggaattgaactaaacctatactacaacttaaaaggaattgaataaaacccttcctgtccaaatatgccctaagcaaatatgacgactaaatcagtaagggttcgttcgaacctctggttaggttacgctaatatgtttcacgcaaaacgacacagtcgtcagtgaatgattaattacgtattaactattacaaacttgaaaatggatttttttcaagaaacttctatatataaagtttttgcacaaaacacattaaacacattagttatcagtttggaaagcgtaaccacgtagaacgagaaagtagctcagtagagtagctaaatcgaactcagcgtaagcaattggttttaatttcaaaatctaccgctctttttattcttccacgttagtaattgggaatcattggaaatggacaattggtggatatgcttagctaaaacattaaaaaaacatggatgaaaaaatgttcacaataaattgacaactatatatatgtggttagactctaggtgttgtagtcaaattgcttctttccttcaaaagtctattacaacagtgtataacagattagccaagccaagccaattaacgagccataggccttgttttggagttggagattatgaaaatagatggtgagaaccttggcaagtattggcactactaaatttgatattgtagaatttgaactagcgtgggcaaaagttggtagcaaaccaaacatccatatgataaagttgccaaaattttggtagcaaacttgactacaatctaaacaaatcctacttcattttctagattctatggcatctagttatcagaatctttgtgagaatctggttgtttgtgaaaattatactcgaagaagctttaggtgcaaaaaaagcgtcctaaaacatggcctatagccaacagcctcaaaactcaacttagacctagaaagcacatagcaaaatatatttcttgttttttcaagaaaaaaatctactcaatacgttctccaataaaaaaagaaaagtgcccatttggccataaatatgcagtagacacctgaagcacatcaagaccataacttttttttcttccagcataacacactagcaattataagtccacgacaataatgatgagtccacgtcaactactacgagtttgcgcaagtaccacaaccaacaaatatggggcattcttaaggaaacatgtatgatgattaccagagattcacatgcagcaacggagtctgagagactgggacaaccataaaatgtaaatagggttagttctcagcacaaacggttcaacaatttggttagctgccattttgtcctatgattatctgcagcaaaaaagacatgttcctacaacgaagtttgatgaaggttgcaacttaatgtcatttccagagcttgacaagcctatcatggctcactgaggcaatcaaccctgatgcatttgatgctgctagcgatggaatcatgccatcatgagcattgttaatggtcacgatattcttctccctgatgtcccacagctccaaagactgcaagatgttaaccatacaaaaatttaatttaaaatatttttaaagtactataaaatgattatcttgaatatgatatataagagaacttgcctcgtaacaaccaatcacaagcaagtatggaaattttgggtggaagacacaagaataaaatttgtttccgctgcaaatcaactcatgcacacaatcaccatcatttcctgtagtaaatgaccaaaccttgatagaatcttcactaacagaggctaggtagccacccgtagcatcccagcaaactgaatggatattctttaagtgcccctgcacatgatcgcagacccacatgctccaattgagtcaaataccgaatgacatagtttgaagtattgatgtaatggtgggagttgtgggtgcacacaattaaatgcatatatacattggtgcagaaaccaaaagttatcactatttttaattgcaatatcaatattatgatgtcaagttctagaatatatattgcgttgaacacttaagaatgcaattccaccttttctttatgtcttaaataatccaaaaagctctagccaactagtggaatgatggtccaatgtgtaaatgcaaaacgacttctactaaacatagctgaacaatgtgtatactatattctgcaacagttctatcgatatgagaaattctcctagaaatgcatatgtaaaaagatataggtaaatatcattggttgtctacctgtagatcactcctataaatgtgcagcgtttctgcatctagtatggaaatcatcttttctgagacaactgcaagatatttcccatggtgaggttgaaatctcaactgaatagcacctccctgcgaagatatgataaaaaagcattcagggcaagttttagcttgcaaacaacatatatcaacactaaggaaaagaacaagaaaagaaatagctgatacatacattaaataccctaacacagttcacgcagctaccattatctatgctccagcaacgcacttccccatcactgtcacatgagcaaattatatcttctttatttgggtgaaaatcaagtgacacaacagatgttgaatgacctatgaaagtatggagagaatactccggctgcatagcatcaagatagtaaaatagttagtacatttgaacacatcaaagtgacattactataagagggtaattgacacaaatgaattacattgttagcatcccaaacccgtatggttttgtcaaaggaagatgtagcaagacgagtcatgattgagctaaatcggacatctgtaattatcatagaatgctcttcaaatatagctttaatgtttaagtcatctgtgaaccataaaacaacctgaaaaaaaaagataagtataaatatatagcctttttagcaccacaaaatccatagttgcttttacacacttttttatcatggcctcccgtggctagaagtttcccatccgacgagaaatgacaacaatcaaccttgtttgtacttgcacgagcttttgcaacctcgataaaaccaaaccctacaacaaagagaacatgttatgcatttagtctctgccaaataattctagtcaagctaaagaacacataactctaatactctataacaccctagtaaaggcatatcatatatgagcatttcaatcctcttgaaagcgaatgaatcctaaaacaacacatcccaccatctttgctttctgaaaactgaaatcttatcatgtctgttccacatactaagcaatgaatgaggaaattgtgcaaatcatttcatgacctttttttgctgactttgggtatgcatgctcgaacagggattgaaattgcattacactcaatagttcaaataggcatggagaccggttagatgttgcaatgaaatttgaagtgaagaaaagatccctatcaatgcagatgttgattattggaaacatcctttaggataaatgatcccttcaatatgtttgatctcacaagtggtgaggttgtgaaagtcttaagcaaagagaagggtaatagtttttcaaaaagacacacatttcttttataactctttttagggaggtgccatatgatactgcatatgatgggatggcatagattttttttcttgattgttttactatcaaggtcaataaaagttaaatgtacccaatccaattatgaaatatgatgctttgtgatatgtatactcactttctaaattttggttatcatcatcattaagtcagggtgaaatatggagatacctttactggcatccatgcaatgccccatggtctcctgaggatccatgtcttcctgagataaaaaagattctacattttcatccaaggagccatcttcctgcaactggtctacatcaccctggaattgagagatttttcatcttacttaccaagctatgtgctagtggcactttaaaatagagtggtatataaataccagtggatttgttggagagatcaagcttttggtgtcatcatagccaaacatagacaatgattttgatttaccaccattatacttcagttgtggcatggacatttcatctcttggagtgtgagtgaaaggtgttgaaggtgcagaacttgaagacgacccaacattgtttgatgttcctgagctattagctctttcagaggatgagacaattttctttctcttctttgatgcctgaacaacgagggacacattgtaaacatgcaatttgccaatctaaatatattggaaggcaatcgtaaatatgtcttgtttcatgagactaataggggcagaaccctagtggatacaacgtaatatagtatatataaatatataaaataatacaatacaagaatattatattggtaacaatacaatcctacaaggcttaagaaatcgatacaactccaaatatttcccagaaatgattaaaacaattagtagtagcgaaaagatatagtatgaagacatggaacagtaaagttccatcggaatagactagaaaaaaaaatcatatttgggggtatagaaggggttgagcaaaaacttggaggcgcataacgaattttctcagtagacaatgagagtaatgcttcaacaagcagaaacattgcatagtgtagtgtaaatgtagtatatatatgatctatgatatagagtttatgtagctttataaacaataaatcatatttttattataacatcatactcggttagctaatccaaaagaatttggtatgctcccatctagcatacttccgatgctttgagcctgttgatggtgaagctgattcaagctttgagcctgctgatgggagattgtagactgttgaagctgttgctgctggctatgaccctgttgttgcaactgttgtaaatgagcaattttctactatatagaaacataagagagtagttgataaacaaatggaaagaattcttgtccaaagcaagtatttctgataggtgtattataaaacactctaaagacaaatccctgtaatgtccttctcatactgcactatcagcatatcttattgtaaaatatctttgagataatttattctatgccattgacaacgcttggattctataatatgtcactaacaaagctcagttctataataaaccatcaaacaaccgttagttaaaccatcagtcaatcgttttcttcctcatatgccatcattgctagtaaactatcagttaaacttcgttaaagatgagaaaatgtccattttacccctatgttattatgcgtagtcatgaattttattggtcatgacccactactttttcttaatgatgaaaaatataaatcgcttgtctttttatcatccaagattattcaatgcgacatgtcattatgcaaaatctcaattttatccaagggctaaatggtcattttttgctccctattggagtttgactaacagtcaactaacaatgatgacatataaggaataaaatgagttgttcaatggtatattgtagaactgagctttgttggtggcatattatagaacatgcgcttttttcgatggcatagaatgaattgactcgatatctttagttgctttagcaggaaagcattctgcttaataaataagctatgcaaagcaccagggaagcttctaggctacaattgtgagaataaattaagtacatttagaataaaattttcagggtcgaatgaaaatgattaaaaaaagtatagaaaattgtttgaaatatgttatatagggaaatgttggtaacaagtaaaattgtcttcaataaaaaaactacaaataaatatgttcaacttttaatcagatcagacagaagtgccatttggataggacatgccacacctctaagcaaattggttatgcaacatctagaaagtaagaaactaatagcatcaaagcttttattggaaatgtaactagtacataaatttccagaattaggagtatcagcagaaaactagcatttccaaggtaggaagtcatagaacataccgctattaacatatctatcttattacgtgatccaccaatttggtcaggggaaccaatatttggaataatatgaccactattattattaatctgtccatctagatgaatggccatatttttgttgttatgaagcatccataatcttctagtctctacatcattagctggaagggaagccatgttttgatgggtttgcagcaaaagttgttgttgtggagttagaaactggagttgttgaaattgttggggtgattgtaggagcggcttctgctgcaaaattccagaacgatgttgatcaagccttatgagcaatgataatagaaagatgtatatgttaaaaaaaagttgcaagcttctagaatataataatgtgtaaatgtcatgttttgcactatacggaaaaactacatatgtatttggtgttttttttaaatttctatcgacaccatgcttctttttatttacataaacatagtgctcttttaacaccccaaagatcataatgtacaccaactagagaaaaggaacaacaaatggtgaccagatgtgggatatgaaatgtgcattggcatcttgagtaggacaaacaatcacaagactctcaatcacattttggcttgtgaagcggatggatctagtaacccgaccgggctgatgaatctcctaattttattattggtttgctcttagacgatataactttatttgcaaacaataaagtgtgctatgatggttttccttaaaagaaaaccaatcaaagggttttctcaagtaatacaacaaaaatgcacatagaaacattggcaatttctttcatgatgacgaggcatggctaccacccatgtcattgtactaaacaaaattccaatgaattttgtgtgaattgctaggtagagttttattggcacaaacatttctagcaattgttgtcggtagtttttaattagctgtcaacaaaatatcagtactcgacaagtccctagtccctccaatatagcaagctatcacaagaatagaattttcagatgcaaatataatatgaacatcgagcatatgccgtagaaaatgaaaatagctgacatcagacaattaggggcttcctatcataagtagagggtttttacttggaattccataaacatagaacgctaattaatgcatacatatttttattaaatacccatgttttttgcaatatgtaatttcctaaaataaatgtctccaacgtctcctagagaaaagaaaatgcacttaaaccaaatacaagataatagttggctctaaagcttaccatgagtgaccaacctttcagcataaaatttcttccaccatgattagatcctattaaaatgacatctcaatttagcttcaaaaactaaccaataaaattatgcaactttgcataccaataacaatcgcctgaagaattcaacatgaatcaaaactcatgtaattttttagactaaaaagcggtacgagttttgaactaaaaaggaaagtgaaagttgaaacatgaattatttactaggcaaggtagaacagtaattcaagggttcaagctagatgaaaattaccttgtagaccaagtaatgatccatcagaaataacatctctatttgtcaaaattggattgatcctaattttgatattctgccaagaatatcatgataagatgaaattggtaataatcttttttcttatgttattttgtatttggtatggtgagaggtgataagcagtatacaattcaaattaacctgttctggaataggaagtcgcggacttcttgcctgaacttgttgcagagtacttgataagtcaccaatacctccaggcaaaattggcctgaaaggtatgtgtcaatactatatgaaagcacatgtacaacaagttgctagttgctacatgcattgaacatccaacaagtcaacaagtaatccttgctggtatggttattaacttcatttctgaatggcttaaccatgattcatgtatcatggcaggtctggataagctatgaacttacactattaagaataaagctacatagcttacacgccataataatattataagtgtacacgcaatgcaatacccaataaaataatatagtgttcctaatgtcaaaattctaactatgtgcatacatatacaaaatgaaattactaggtgcaaacaaatgtatatcatagcaaactacatgcatgattaagataataattttctaacaagaacatagcatacattgaaaaagaataaagaatcacaattactttaatttagtagtgtgttgcatctactaagttctagtgatctttgcaagtaaactttgctgatgttagtacaacaaaaaaaaagtgcaagaaaataccctgaagattgtccacatgtagctgctttcaacaatgatgcttggtttggatcaagcacttgcccatatttttccccatatctttgttgcaactataagttcagcacaacaacgcaagatttagatcaaccaaaaacgcattatctaagaggcagataggagcctaggaaggttggacttggtgtggtacctttattgatgcctcatctaaagaatctctttgggaagggagctttaacctctcttcatatatttttactgccatagcatttgcaatagcagggttatgtcgcattaaaagatcatttccagaaaatccacttgtgataccattaaaaagatgagaaccatctctatgcagttgttgttgttgttgttgttgttgttgttgttgttgttgttgttgttgtgcagctctttgtaataacatttgttgcatttgtatttgttgatgctgatgttgttgatgatgatattgttgttgctgttgtttttgatgctctgcttttgcttgttgagtctgaaagattttagcaaagtacaatttaattagcattatctattcatgtgaaaaatgcatcatattccaaatgcaagtcattttacactcgtacacgagaattaaggaggtgatacaattattttcttgtcctgcagaaactacacatggaaaaagatacttcatttattgcgaaagtaacatcattcaaatagtaagcttatttacctgcaaagacccattagttgtagtaaatatcctaaaatatcacgtcaaggcggttcagccatgaccaagccagactactcttcgtaacactatactcatgactctaattcacatcaaggcaacatgagacaagctacggtttgtcacaataaggtactaggttttccaatgcatcatgtagatcagacataacagaagcccattacatgtgcagtgcctatgtaggtggtgcacaagggagtaggcaaaggctcccattaggcatgctacaaaatgggtgataggtgctccattttttctttgtctattgttctgcaatttttttatgcacttgggcattgctttattatttaattcaatccaaaactacgcatcatcaagtatgcaactcaactataaagttcatagactacacttagcaccagatgaaatacatatgacaaatttgaaagaggttatcaacaggctaaactggagctaacaaataaaagacaaacaattagcaatccaaataggcttcactggaaaaatgtttgatgatttaactagcatgccacattatgaagtagataaaattgagtttttaatggttcaactatctacattatacatggtttatgaaggcaacaaagaattttctatgttgtgatgtagcagaaaaggaagaatgaaaggccctaattagtagcatttgtcatagatggaaattataatcataaaaggataaataaaagcacagatacacacctcaatatatgacgttgcaacatcagaatgttcccgatctgtttgtgctatgaatatatcccaaaatattgaccaccactcaaaaagaaagccaccaggagcatcaattgctgtatgaaagttaattcaaggaagtaagtaatatcattaaaattgtggcaaacacaagccaaattaaataactccatagcaacttccaatcactaattaagtcaaaaaaaaaa

SEQ ID NO: 8321 - DNA, 14020 bp, Oryza sativa
tgggtacgttctagtaaaagaaacttgacaatttagcatttttgtgcaacaatttggctagatgtgtgttgttttagttcagaaatgctagatgagttttttcatgatgtttatatgccatcatataccagttatgcagatattaccttacaatcttgcatttaatctataaaaattatgttactcattcaatttgcaccactagtttggatttgtttcttcaccttctacaatttaaaccaaaatacaaaattttctaaataatacaatttaattgacttttaattactagaatgacagcatattaaatatgctatataaaactatgttatatattgagaaaatatatacttggaaattgaacatgtatagcaaaacgatgctaattaaaaaaatcaagttaatgcgctaacatgctcacttcttaagtaatggtacaaccattacacatacattccaagttggtactccctccgtcccgtaaaaaaaactaacctagtactggatatgacacatcctagtactacgaatctagacatacctttgtccagattcattgtactagaatatgtcatatcccgtcctagattcgtttttttcgggatggagcgagtacacccgtatggttacttcttaagttatacccacttgtaaagttgatgtatcgtgaatacaatttactcccaactaaaataaccaagacaaaattgtactaaatatttttagatattgagacccctctcggtcataaacaaggcatatattattccttgtatgacccgctttacaagcaatacttaggattcacctattgtcacaaacaacattttctggagacaagaggaaatctaccccactccctggtccattactttgttttcttgaggcattccagacctagaccccaaatggttatgctttaaatcattttcacaagccaaacaaactattgaaaaccatccaaaacaacaaagtggggtttccctgaaaccccagctcccaaactcacgtctactatcctcctactcgtgagacatacaagattgaacctccaaacatagctaccatcccgccgttcggtattgctaaaaaaaatggaaaacactcaaattgatctaacgccagccaaacaccacctaggaagcaagatgcataacaactatttttccatctcaaccagttagctatcatttaatttctccatttattttcttgtcttaatcaatcacaaccatttataatcttaatttgtgccaaaactaaaaaaaatacatatattttggaaatgggggaagaaaaactaatgaaaaaatggacagaaatcatgaaaaatgcatgatgcatgtcatcataatcatatagtacttcaacattagtaactcaagatgatttttcttgtgttctctttcatatgtaaggagattgttgtgtgcgagggtaaaagattggatagtacgagacaggtcaattctcaaagtgaatcggattgaaatataacaaggctttctagatctaaaagaggggcatgttagaacaaacggatctactaagaattttttgatagaaaatcagtgaagaaatctcacatgttttgggccatattatctgaatacagaaccatgctccacgcttccgcttctccaactccaacggcctccgagggtgaggatgtgatggtagcttttagagtttggggaggtattagaatgaggaagcgagcttagagggagattggtccaaccttgggtggtggcaatgagaggtttgcggtggcggagggaggtggtggcccttgccggcgttgaaaagaagtttagggatggcacacggagggggattgcggccgacgcgggtggtggaaccgcggcggtggctaggattggttagggttcggtggggtgggtagggtgagttatatagtaaagaggtcgatggctattaagcgttggatcaaaatcgggtgtctggaaattttaactagctatgcgggtagaaatatgtcaattgttgcatatttattacctagaataaatatttttaataaaataattgaagttcttatatgttttgtgacttgtgtgattcttcttctctaacgagcttgccaaattaatgtgcccttctgtgatatgcatgaattttgtagaatataaattttataggatttagttcggttcccacaaacttcctcgattccaaagaaggctaaggttagtgtaggcataggggagggaacgattaagattcaatggaccttggctatagcgcgaatgaggacgttggtggacatagatgtcatgatgagatagtaagaatagagcaatattagatggtggtgcgtgctcaatcaacgataacattgccacaaaagggaaaggatgtacatggaggcaaggaaagctaagcggaggagatggggatggacagtgtcaatgcttgatgtcctaattagggaggcgcctaagagaggaagaggatatgagtgagttaggttacaatgagggaagctgagcttatatggaagtggagggataatctagattgcacattttctatgtgattgttatggatttgattgatttgtcatttcccccaaaatcacatggccatttcttcatttttagtacacacatccctttcaccattctatttgaagaaaatatataaaagcacgggtagggatatagttcctttcattgctcgttgacatttctatatgctaccttacagatgcattgatgattactcaaccattcctttcatatatcattctattcaggtgggtattttcgtttccttctctattgattttacatccttctttattcttatatccagttattagcaatttactaagtactattaggtatattgaaagcctgcacctactctacaagctaaaaaatgtgcatcaaccttgtaaatgcgcacctacaagctaaaagagtatctgagtatataaagacctagaatttgctaacatcctaatcaaaatagcgtatgccatgaagagggataccaaacatgtacaattagatttacacgcttagagacggtcaccagaaatttgatctattttacaatgcagttggaatgtcagtacacattcgcccatacttcaaattctgaggaacacaactctacaaaattgacaaaatacccttgctaggcaagaaatcaattgcgttaagtacgtggtgatcaagtaatcggttgatgatggtattaaagtggtgtactccacatagggtggataacgagctagctcggctcggctcgttatcctaatgagttagaatcccagctcggctcgactcggttagcagctcgagctagctcgtttagcttgcaagccacctatgaccaacgcaatgcacttcaaagaacgatatcaaatatatcaaagataacaatagctgcaaactataatttctgcaattgaagaataagaaatcaagcaacctgcgaatcacaaagtcttggcataaaatttgtgtacccatcaattgggaatatttcatccatcaacacacctgagccttagcagatctggaagtattggtacatcggaaccaaccaaaaggcaacaaacatcctactgagtccccccccccccaaaaaaaaaaccaaaaccaacaaggcagattgacttgccgaaccaccgacattgacaaggacggcaggcttgagcttttccttctcgatttgtatcttggtgacgtggtgacgccagcacggtccgagcacaactgcctcctcctacttctcgttcgttcctccacgatgaagtagaggagccatggtccgcctcggattgggatttgggggtggcaacttcgcgcgacatcactagctcgctacccactggagggcaagagggctggtagcgatgggcatggtcgatgatgactggttgtgatgagggcgtgagggcgtgatggcgggggtggtgctacggccatattggagagaactggcggcgcggctggaaactgggtgtggggaaattgatcgatctctgagctagttggctgtcactatggttcagttgggaattcgttgggccagatgggccttgggctgcttgcttttgcttggctcgtttggctcgcgagccagctcgagctggctcattatgtctaacgagctaaacctctggctcagctcattactaaatctcaacgagctgaactgagtcagtcatgagtcgagcgagttaacgaggcacacaagtttttggtccagccctaactctacactattactgtttaaggtggtgttcttttctcctgaagatgaagattaagttttttacgcaaaacgaggtggtattgaagtatgattgattgagttttaattattacaaacttgaaaaatagattaatatgatattttagagcaactttcatataaaaagttttcacatgaaacgcaccgtttagcagtttgaaaagcgtgccacgaaaatcttaatcttcattcaactcttgttggagaaaagaacgagaccttaagtataggtaaaacttccccatcatgagaattatctcgaaaacaaagtatgatcatactaaattttcattactccatgatctagtgttgataacttttgcctttctcactagttatacaaccaactaaaaataggatgtgaaatatgtataagagtacgtgtgtccaactttgtgctaaaaaaagaaactaaatgcctcatcatttgtcttattcgtggaataagccaaacggtatatttgcaaacgaaaagtaatttaataggtgttcttaacgatctaaaagcaaaggctgtaaaatgaacttcgatgaaaaaacccccaaaatcaactccaaatttaaagttgaaaattcaaattttggttgataagcataagcataagcaaaaaagatgaggccctaactaaaaataatctatccaagagggaggggggggggaatcatgtcttcttatactatatacttctatttcccccaaccataaaaaacctacttctagctttataaggagaaaaagaccaaaatgcctcacattgagaaataaaatataatattggtgaatggttaggtaagaatattgaaaggataaaatatcttgagtaaggagatagaagtttgtgaaatgaggattgataaggagatagaagttaaatttattttgagataaaatttcaacttccaagttgatttattttagtacttcaagtactgataggtggatttggctataaacccacaactcctttttattaataccttatggtctctgttttacgtgcgaattcactgaaatatacaacccaaaatacgaggtgatagtaattaacaatacaaagtaacatttatggttctgccactgccacgcaaactcatccaatccaccaaactactccccttagggcatctaccaccaaaccacacctagagtgccctcagggcactcatctcccattggaggataccctaaatgggctcctcaaaatctgaagcaacttgttggagatactccaacccacaacgggtgtcccagcccacgaagccccatgtatattttcacttccctacccttagtccacgatgaccgcacaaattctctctctctcttctctttttcttcgcctcgtctttctcccttcgcccgctgtcgctcgcctctctttatccctctcgtcgccgccgctcgcttctctctctccctcctgtcactggcggccgcgagggtgatgaggagggccgcctccctccctctctctcattgtcgttcccgtcactcgccgccatccgtctccacgcggtggccgacagagaactgcgtgggggacgcgctggtcgacggcgaatgatgcgaaggacagggtggccgacggcgagcgacagttggttgacggcgcgtgagctctgccgctttctctccctctctctttcaaagcacgggagcagggcgcggtggccgacgacaagcaaagggtggctgacggcactctctcccgtcgccgcccgtcgcatcgcgtcgtcaccgtcctccccggcctcctctacctcgcgtcgtcaccgaccgagggcggtagatctggccccatcgtgggcggatctgtgcccccctcccctgggccagatcgggatggagcggcgtcggtcgccgacgattgggggggcgccgacagaggaggtcgcgatggtggaggggcgaggggtggaaagggacaaacgaggggagagggcggtgtctacaggctcctcgcctagcgccgaccgacccagcgtggcttcttgctcgggcccccagccgaggagcttgtagagccgcgacccctgtagagtagatgcgtggctctgctggggacggctcgagcaaaaacgtgaatgggagtcggactccgtgagctgaagccacgagccaagctacccatcgtagatggccttatttatatctagactagatgcgagaattgttatggctgtgcaagaaagatttgtcaaaaaaaaaagggataaaaggttccttataggcttattcagttgtactacacaaccaatcgtccaacgttatctgattattattattatttgtcaaagcatgtttgatgtacatcggattgacgtgaagacaagaatgatgtggtctttgcttatttagtacccggtcaagtcactcgtcataatagcctcaaaagtactgtaacagctcataatttgcaagtagccataagaaaatatctcctccactttgtcctgaggtgaaagaggaagaggaaaaggccagtgaggaaatagaagaaaaaaggggagaaaattacataaaagccctccgcaacaggtcccgaatactttgattcggtaggggtactaaggccattttcaacgcgaggacagtggtcccgttcttttgtccaaccagagttggatgaagattaagattttttggcaagtttttcaaactgctaaatggtgtgtttcttgcgaaaacttttaatataaaagttgctctaaaatatcatatcaatctattttctaagtttataataattaaaacttaatcaatcgtacgttaatgtaatctcattttatgttaaaagcttaatcttcgtcatcattttcatatttagagaaaagaacgccaccagtgtccaccaccatcgtacgttgaacgggcctaccaaaatggaggcctaataaaggcccaagtaagtataggcccaaatacgcccatgggtcgttaaaaaacggaggcccaataaatggtcgagttagtataagcccagttaggcccacgagtaggtggaacgaccacctcacggcccttacccgccttatcttccacatccgaggatttctctctttctttttccaacgcggccatggcgccgctccctctccccctcccgcttcccgccactcgccaccctcccaaaccgcacgaggcctcggcctccgcctccgcctcgctccacgccgcgctcgcctcgctctcccagcagtgcggggcgggaggcggaggcgggggcgccctccgcgacgccttcgccctcgtcgcccgcgccgagcgcgacgcgtgccccgcagcggtggtctcggtcggcccggaggcgtacgcgtccctcctgcagtgctgcgtcgcggcggggtgcctccgcgcggggcggcaggtgcacgccgccgccgtcaagcgcgggccccgctactgccgccacgcctacatcggcaccaagctcgccgtgttctacgcccggtgcggcgcgctcggcgacgccgagcgcgcgttcagcgcgctcccggccaagaacgccttcgcgtgggccgccgtcatcgggatgtggagccgcgccgggctgcacggcaaggccctcgccgggtacgccgccatgctcgaggcgggcgttcccgcggacaccttcgtcgtgcccaacgtgctcaaggcctgcgcggggctcgggctgcttggccccggcagagcggtgctcggttacgcctggaaggcgggggtcgggaactgcgtgtacgtgatgagcagcctggtggacttctatggaaaatgcggcgaggtggatgatgcgcgggaggtgttcgacgtaatgccggagaggacagtggtgagctggaactcgatgctgatggggtatatacacaatgggaggattgatgaggctgctgacttgttctatgagatgagggtcgagggcgtgctgccgacaagggtgagtgttctgagctttctgtccgcatccgcggatcttgaggttcttgatgggggaaggcagggccatgcagttgcagtatcaagcggcctggagatggatttgattctgggcagttcaatgatcaacttttactgtaaggttggtttggtggaggctgcagaggtgatatttgagcagatggttgaaagagatattgtcacctggaatctgatgatttcaggatatttgcaggatgggcaaactgacaaagcccttaccacatgccatagaatgctggagagtggcctgaagtttgattgtgtgacgttagcgtccgttatcatggcttgcgtgaaatcttacagaatggaggtgggtggagctgctcatgcttacgcagtgagaaacaatcttgaatcagataaaacggttttttgtagcctgatagaattgtattcaagtagtgggagaatcgaacaaatgcgcagagtatttgattcaattagacggagagatatagccacgtggaaagcgatgatctgtgcttatgcagaccatggaatgggttctgaggctctgaagcttttatatcaaatgcagcttgaaggcacatctccaactgcagcatgttgggattcagtactttcagcttttattcgaaatggacagttagatgatgccctaagcaccttctatgagatgcttcaaacgagcacacgccccaatctgcggacatggagtctgttaataagcggcttgtctcgaaatggtatgcatcctgaggttatgaatctatgttgcaagatgcaagaagtagagccagcacctagtccaacaatattttctgcagcacttcttgctgttaaatctgcagcttcagtacagtatggaaaagcaatgcacgcatgcattgttaagaagggcctattattgtcgaaatctgtggtgcagtcgctgctaaacatgtatggtagcttcaatgatagaggcacagtagagagtttgctaagatttcttgctgctgcacagtaaataatttcagggcgtcaagaatgtggtgctagtaaaataggacatacaggtttacaggttacagctgtacataaatacatggcgtttgcacatatgaattcacattcataatacaattcctattttgagtgatggagtatggactaaatcagagtggtcatgaaacaaagatacgtcataccagtttgatacgaaataacatctcttacatgattgtattaaccttgcagatacattacagagtatgcatctattgttgggaggcattattcctaaaatcagaaggttctgataaaagaaccaatcaccttaaagggctgaaaccagcgagtaaacagtgtttctgtggccacatgactctctttgagacctacagctagtcagctacaagtggttgaataatttcaagaaaagcataactgttttagtcactgtaacgatgaatatgataacatgctgacagatgtgctgcagttctgttgtcatccaattgttcggttttgaattaggatcgctactctgtgctggccctttttcggatactgtcaaagaacaatgtccagatgttatgggcaacttattatcattatataggtcattacttcttttcacactgcaaacaaaagtgtaactgtatattcctcctgtaaagtgtcaactcattgtacatatctttctgaacaactatacacagcacttttccactccagaaattgcagaattattactcacttgaagtatgagttaccacttctttcacactcccatgctaacaactggtgcttgtctcttttcgcaagccctgcatccgatcttgatggggtgcagaaggttccaatcagaaaaaccggcgtcttaagagagagagagagagagagagagagagaggctggaccatcgagcagctagaagttgcagcagctgctgggcacaggactgctcttcttgatgatgaaacttgcatctacagatgatcgagattattcgcccaaaagtggggggcgtactgcatatatgtagctcctgtaacagcgggtagcattgtcgagagatgtgccgcattcatggtggtgtgtgtgcccccggtttgctccgttttggatcagaatgtgtgccccctgcactggcccatttcgggaaggcatgctcgctgggaatgtgatgctgcggacgcattaacatgtcgctgccgtagcacagtaacttgagtttctccttactgttgcactggaatggactcgctgcgaataatttgggtactttgatcttcattcgggtgggaggaatttccacccataggaatagaaaaaatggaggaatataaatgcatgcacatatcaattcataaaataaattcaagaggtttagatggaaaatttactatgttttctctaagcaatttgtaggaaagaaaaaaaaatgtttttctatattcctagaaaccgaatggcactcgtaagaattaatcctttacttttcctctaaactgaacaagccctgcctagatagacattgcacagctgacttcaattcctggctcgtttgcagaacatgaagaagaaacatcaccaaagactttgtctgtaacgattgagaattccatgtcgcaatagtaataactgaaacggttcatgagaaattcttacgaaaatcctgcaaaactggcgcattacatttacattacattacagaacgggatgtgagcttttcgacccgaggaagaactgcatcggtgcctccgccacagcccacagtgggtggactctgtaaactgcaaaccggcctgatccgacccgacctgacctgacctgacggctgccgattaattaagcaggtaatttcccccgattcgcttagctggatcgtcgtcctggctgtggacggccgggcagcaacggcgacgagaggcggtgggcggggacgacacggtccagctttagaaaggcaggcacgtgagaggtgggcacgcaccgaggccaaatcatggagccgagtgcgagtgccaaggcccccgtgtcctcagctcatcactgcccaacatcaccattcagcgaaggcctacagaaagaaaacacagcaaggcctccgtactaccaaatgccaatatgcatgagtacgcgaacgatttttcttttttcagattgaagggctatatactccaccggtttgcaaaatgcgacgaaaaccgctagaatcgataggattcagtaggctttcggtgtaatttgacgaaattcgaacgagatttgcgaattatgagctatattttggtgattcaacagggggtcatcgcattctgactgacccatctgaacctgtaaaacattgtacactccaggtttccagaacttagccatcggtttgtacgagcacggtgcacctgggctcgacgtgttgtttgctgggggatagatgtcgcagggcagatcagatctcgcatccacaatcgttgatccgtgtggtacatgggccaacaagccacacgagctctctgtgcgtgtctggtacgtacgtcgcgtccatgcgatgcaaggctatagcgcgcgtgaagggcacatctgtgcgacccccccttgatgaatgatgacgctgaccgatgagtgaggaggcatatgatccattcccgttgtgaaaaatggatcgttgagctagggcgatgtagcttgcagacttttctctcaaacgatgatacggaagacgcacatgtacacacacgacttcctcgatgaattgccgatcgactaccgttcatgaatttcgtcgaattctgccaattcgcgcctcgtagattataaggacggtatcacgattactatgaaaaccgtgagattactgtaaaatgaaaaagtttcaaaatataagattaccgtatggagtaacggcgtgctattgcaaaccctgctgcttcgacatcaaaccaattggcaggcgaatccggttggtacttcctagttcctacccttgttctccactaatggaggtcaggatgatttagactgaacagtcacactgtctgtcgtgccgtttttctaccactgttccttcactatcacaataccatggcttgttacctgttggcttgttgctagtatctgcaactcggcattggtaaaaaaaaaaaggaaagatggaactcaaatgacaaggacgggagagaggggatgcagtaaaaacgcccaagatagcgcaagtaaagacgcgccggccagcctagcacgaacgggccacgccaatgtcacgcagcccgtgcctttgtcgccttccctacatgtagcagaatccattggtctccacggggaagaaatgcagaatccattgctctccatcgtcgctacgttgcgatgccatagaaactctacgctactgctgctgtgcaaacgccctcaccattgacgaatacagagccgaagacctcctcgctcttcttcgccagaattggcacaagaaaaacaaaaacaaaattgattcaccttatatcggcgacaataatgtacgtgtttcatagagtgagcagcaacaaaaaacgtagtcctactagtaacttactacctccatcgcattttaagtgtagttgtaaattttcgtatccaacatttaaccgtccgtattattttaaaaatttataaaaaaaataatcacatataaagtactattcatcttttactatcttgtaattaaaaaaataccaatcataaaaactttcaaataagacggacggtcgacattaataagagtaaagaccgaggtagtagggaaataaaaaatttaacaagctaacggatttaatgatttatcgctagtgtccgcatcttttagcgtgtattaaagacaaacaaaaaattaaggatttaattatatggtggacgtacgcgatggtgagtgtacatgtgtactctcattaaatcgaaaaaaataatactccatttattctaaaatatgtgtcacccacaactttaaagaaaaaaatcaatatttgtaaactttgactaatacttccttcatcttaaattgtatttttaggtgagcacaaatattaagaaaataaatataaatgattaaaggaatgctattattggttgaaaaaagaaagtggataaataaattaattgaaaatgcttgtgaactgattggttgaaaggaaaatagtaggtgaagaaataatttcatcttaaaccaaatcatattattaaaaatagctacattttaaaatggatacattttagaatggatgtagtagttaaacttaactaatatacgatattactctctttgccccaaaataaatccaatcatagagatgaatgtgaactaagagagggagtaatgttttgcattggagatcgcataaaaaagttttatattttttgcgatagaggagcactatagtagtgccatggacaatagaaaggccatggaaatgattagttttggaattcctttgctcccagctcaacatgtgattactcaattctagaacaacataaacgaaagaaggatgaggcacaatgatcacaaagggggcagacgatgaaatgaaggtaaaaaaaagagaagaaaaaaaatacatttacttggaagaatgaagcctgagaaaaatacaatttgatccaacaaaacaatacccaggaaaagaaactgaagaagagaagagaagagaaaaaaattggcaaagaacagagcattggcatacaggcagccaaagaacctatgcaatttttaacctttaccctgaccaaaaaggtgttttccgccgccgccgccggcgtcgtcacggcgtcggggcgggcggaggcgtgccc

SEQ ID NO: 8322 - DNA, 18556 bp, Oryza sativa
  unsure (1)..(18556): unsure at all n locations
gccgaccgcatccgcgcgtcccagtccagcggcgtcttgccggacccccggctccctgggcaaaaaagaaaacacaactccggtgagaaatttacattctggcattctccaatcaaacacctccaaacttaatgcaatgagtatctgtaaaaatgaaagactgaaaataactctgccatagtactaccatccaattaccaatggaagaatgcatttacattccaccatgatctttggtgaatgttgcaaggaaataacaataaaaaaatataattagtgatccttcacaagagaaaatttgctgccatcacttggttgaaatcgcagaatactcctggttgttgtattggattcttggtaaggatagacagagaaggttgatatttttattgatggggtgaataaaaatctcatcttggactggtccagagttggtcactgttaaagaaatcgggagtaacaaacaagtagtatgtcttaaacaaaaaatgtagtgctaacttgcatgcatgggatggggtgactgttgcaggctatgcattgcaagaggacaagacatcttcattggttaagtacagttggacagcacaaacaagcacacgactaatcaatcagcgcaatagttggttcagtaggtctactaaagaagagaataaatatatcagtgcattacatagattgcatcctagcaagtactactataaatagactattagctgttcatctggccatcaattaagcatatctgttaggtagcctagtacattacagaccagcaaacacaccgaattgttagcttcttgtctagtaaaagcaaggagaaaatcaatggtgcgactgatcctacagcaatagagtatgcatcatcatttctaaatgtgcaaaactgaatttttctgccaagtgttttcaaaacattgccgagcaattaggcaaatagagctgatgagcaagtgagcttgctaacccactgggcaagatccaaaagcaaagctgtggtctctactctcttgtcaagtagtggagaacattgacgagcaggtagcagagggcactggttacacatatgtgggtggcagcactgaccggtgccatggacctactatagctatagtaccctgcaattggaggccaggcgagcaagaacatgcatgtgcaactgcaattgctcctgtgacccttctctgaattaccagcaagccgtagtgcagagttgttgccactggcagtccgatcccaacccaactcaaaaaccacattctctcaactttgatatctgtgaacactctcaaggctctacagcactccagctgatacaggctgcagctccaaattttaactgttttttctctgggagaaacggagccagaggattaggacgccaagacagtgatggacactaacaggcaaccacctcgactgtttacgagttcatcgattcaactatcaaccgtcgttttccagggagttgggggtacgtttaagcgcaggcaattaaggagcccgatcaggtgaggcaaacacacacacacacaccacaacacggcgtcaaccccgtgtcgcggccggccgcacgaacagctccgcaataatctcacggattctggtgaagcctagccaagccaagccaagccacgccgaagccatgaaggcgcacgtagtagccgagcaaggcggccatggccccatgtccatgatgacaactcacacacactacaatacacttgtccattattattctactcgcctcaatcttgcatgctagctactcctaaggtcctatttttcctaagcaaaaacaccctatcacatcgaatgtttgacacatgcatgaagtattaaatataaaaaaataaaaaactaattacataaattgcgtgtaaattgagagatgaatattttaagcctaattgctacattatttgataatgtggtgctacattaaataattgctaatgacggattaattaggcttactaaattcgtctcgtagtttataggcggaatttgtaatttgttttgttattagtctacgtttaatacttcaaatgtgtgtctgtatatccgatgtaacacgctaaaacttttcaccgctggatctaaacacagcctaagtcatagctagatggggactgtaccaacgacaatatatgctaagcgtacaaggataaataaaagtctcctccctcgttgccctaccattgaagaatatattgacttcgagggaaccactactatgcacgaaggcccggccggccggcagtacacattacgcacgcacacagctagaattcgtggcaacattttacacacctttaaacacccagggggtgtacactgtaccacgatgtacaggcagcaggacaggattaagtggagaggcactagacattctctactctacggtaaaaagctgggccccacacgccagggaccccaaggaaaagtactgcactactactacaccttttctccctccgcatcaagtgcccatgatgatgatgatactatggtgccacgaagagtacaaaaactaccaggccaatgggtggttatgagccccggggggtcaccgtagcaaatttgcagcaacctgcgcgtttctgaactttgttctgggtttacaaaaccgtatatatctcgtggttactgctcggttttttgggtaacgacatggttatcgcggtaaccgtggggtggaggtaagcccatctcaaacatcagtttggtgaaacctggtcccggggcttgaatcgaacgacacgatacgctacgagtactactactcgtcactgcaggtgcaggtgcagcagaactgcaagtgtatcggagtagtagcagcagccaatgtgatggcacgcaccggcccagcgtgaggcggagcatgggatggaccagaccgtcgcgggcgctttacagcccaaacctcgcagtcatcactcccttgcacgcaccaccaccaccacctaacacacccacaacacacttccgcatcaaagaaaagcgacgcgaaaaaaataaataaataaacgataaagagaaaagagagagggataaaaaaaaaaagaaggaaaagcgcgggagccaccacgccaccgtccacatgccgccatggcgaggaaaagaggagagggaatttcgtcctcctcttccctcccatggaggctttggctttcgctcctgctcctacctactaccttgctcgcgaacacccatcaatgccgccgaattccgcgacgatttctgcgtctacgatgcacgcacgcactcatcgatcgcttcttggacttggtgatttccgctcgcgcgtaatgccgatctcatgtcgaaaaatccccgcgcaagaaagcgaccaaaatacgatttggcaatggcaatgcggtgacgcagagagagagagagtagactgaccgtggagcatggcggagaggctgccgttggggaggtagtcgaagacgaggagcttctcgtccttggagaagtagtaggcgcggacggggaggacgttgcggtgctccaccttgccgagcgcgtccatgtgggcgtcgaactcgcgccgcgccaccgccacgtccttgagccgcttcaccaccaccgtcgtcccttcctccagcaccgccttgtacgacgtccccacgctcccctttccgagcaccttcgccgacgcccgcagcaggtcctccaggtcgaagctgtacccggccccctttcccacgaacaccagcctgctcggttccgccggcaccgncgtcaccgacggcggggccgacccggacgcgccgcccatgtcctccttggacgacgacgtcatgcccgtcccctcgccggaccccggcggggggacacctctcgcgggggggtgcccgcacccgccgccgccgccgtagtgctcttcggtccctcgctggcgcctcgccgccgcttggacaccgcgcagagcacgccggcgacgaggaggagcagcgccagcacgacggcgcccacgacgatgccggcgattgcggcgccggagagcctccgcttcttggaggaggatgccgccccggggacgtcggcggggctcaccccgggcgacggcgacggggacgggaagaacgacttgcagggcgggagcggcgagccgcagagctggaggttgccggcgaagtcctcggccgggaagcgcgcgagcgacgccgggatggagccattgaggttgttgtcggagacgttgaagacgacgaggctctggatgctgatgctggggatgttcccggagagcttgttccgtcgagcggagagcgcggagcgaggtgaggttgttgagcgtgaaggggatgggccccgagaggttgttgctggagagaacgagcctctcgagggcggcgagcttgctgaccgccggcgggatggcgccggagaggaggttgttctggaggaagagaagacgaagctgggggagctggagcacgtcgtcggggatgccgccgagaatgcggttggagcggagggagagcacctgcaggttggtgaggcggccgagcgtgcccggcgggatggcgccgatgagccccacgccggggagccgcacctgcaccaccgtggcgttcccggcgtcgcacgtcaccccgacccacccgcacgccgacgtcgaggagttccacccgagacgccgctcgtgcggcgtcgccgccaggaacgccagcagcgccgaccgctcgctcggcggcggctccgcggccacgagctcggcagcagccacgaccacgaccaccaccagcaccgccgccgccaccgccctggtcacgacgccggccatcgcgtcgcacagcagctggacacggctacgggcgaggaggcatcggagtgtgaagctagcaaactgcagcggatacgaccacactgtgggttagcgagagaagtggtgggaaaatccgggagaatgtgcgtgtccgggagcgttttatgcagtggcgtggtgtgctatactagcagcagcagtaggagtacacactacacagcagccagccagcgcggccggatcggcaggcagtggcgcatacgatgccgtggtggtaaagcccgtgacgctgggcgtctcgcgggcgtgtgcgtgtggcgcgcggcgcgcgcgcgccttgtgatctgtggacgctgtggctgtgcgtcgcagtggcgcgaagcgaagcgctgctctgctctgcactgtgccgtgtctgggcttgcgcccttgttggtttctgggtttttgtggatgggcgggtggctcacacgcattgtgccatagttgcattcgtgactcgtgagcgggcagggggctgggtgtggtgcggcaggtgccggttccgcgtcatggtttgcatgcgtagcacgggggtgtcgttgtggacgggtcggtgcgtgtccagctgggagaattttcggggggaaaaaagaattcgagatcggtttttgagcttttccgtttaaggtggtgcttggatttatgaattaaattttaactagcatggtggcccgcacagattgcgcggcaagaatcattatattttctctcatataatagcatatatgttttctcattatattattcaaattttttagaatgacatcaaaattttaaattttgcaataactttacaaaactacaaatgtgtaatattcatattgtattttatatatgtgttagttattaattatttttaatattaaattttagttatttgtaaattatatatatttctatatgtactctagactcgtcttttcatatttttttaattctgaattttctgtaaattgtatttctatatagactttaggctcttcttctaatattatttatttttatttctgaatttttattatttctaattgtatttctatgtggactctaaactcatctctcaatattctttaatttttaatttcgaattttagttacttctaaattgtattcctatattgactttaaactcttcccatgtttttcttaatttcgaattttagttatttgtaaattgtatttttatacggactcaaaactctacttttaattttgttatgtttattccgaattttagttagttttaaattcctatatggactctataatctacttctaatattctttttttttaattctgaatttctatttattttcttaattgtatttctatatggactctatactctatttctaatattccttatttttaattccgaatttcagttatttcctaattgtatttctatgtggactctagtgtcctcttctaatattccttattttttaattccgaatttcaactatttctaaattgtatttctatatggactctaatctcatcttctaatattccttattttttaattccgaatttcagctatttctaaattgtatttctatatggactctgttttttctttttcttcgattattgtgagaatttctatgccatgagagcgaatgtggaggctcctttttctattcatttaataatataatagattaatattacattggatatttagacactaattataagtattaaatgtagactaataataaaactaattagcttccgttcaaaactaattagcttccgttcatctcgttttcataccaccagactctgacactttacagatctttctagcagaagtgtttgtttgcgtttgcagttatacattggcgtgtttttaatttaatcctgtttggtagtaagacctatttttaagagattgtggatctcaattagtcctttttaacttccaaacgtccacataaatgaacaaataagactgttcatttagagtgccaatgtgatagcaacagcatcatttgccaaacaaattgtataactagttctctaataacgcagctttcgaattaaatgaggattgtatagagctcgcacatcaggtgcaaaaagtgatcgacccttgtaacaggatcttccacggctcacgctatcgggtgctgaacaagtgtgtatcacacaaatgtgtgtccatccaatattctttttcagcgatgcaacctgaaaaacacccggcaaccagagaacagaatccccctcctaatagcttctcgctccagcaaagcgaaacgttgggggtccaaaattccaaattactaccaacaaacccatcttaagccatctccatcgcttaaccccctcaaaacaaacaaaccccatcatctgagcaacgagcatgcagagctgacaagccacagccaccagcagtctgccactcacctagtcacacatacaaggtcaatcaatcctcggcacacccagacagacagccagctcgatcgccacggcggttaagtacagttgccgaaagttggcggccgctcgatcgaagcggatcgccggtcgccgtcgtcgttgcgcgcggagcgaaccgcggggagcgaacaaccgggcgcacgtncaacgaccagagcacgtacgcgcgcgcgcgctctcgtgctgttagctagccccaaccgctgataaaaaatccagcgtcttgatcagaaaccaaacagaatcgatcaccacctggctttagctagctagctttgctttgcaaaccgttgaatgatactgtccctgacagtgagagattacatgggcttcgcgcgtctaaccaattagtaacagtgtaccgtggcagacgcagatgctgatcgtcttatctgacgtgtgtagcagcggctctctccggcgcggtcaggtcaaagatagacaaaatgtagcgagcgccctctctcattgttccaggagtcagaaaaccggaatctccccgggcacgtagcgttgtcctctcctctggggcagcaaaacgtgcagacaaaacggggacatcacatggagaaaatccgctctcgacgtccggacaggggcaaattaccccttcagccgaccgaggtccgtatttgtaagaatcaacgtgggggttaatatagtgccgcgacctgtgcgattgccagtaccgattgtgtgtatgtgttttttctcttcaaactattaagttctactgctatatttttcctttaaaaagaaaaaaaaactgttctactaccatgtgaactctgcttaattttgtttggcaaaatttattacatgacacccgaaattcacgttctttgctggaagacactgtaagaacgtgtttttactgaaagacgcggtaaaaaaaaggtaaataggatacccccgacattatttaactaaatcaagagagaatggagagacaagcatttgttcaagataagtttctagaccatgaaaacgaacatggagactcattttttctattactttaataaggtaatagatggattgaaatccaacctctatatctacacaaccaaatataacatgcatgtctactatctagaagtttttttttaagaaaatggtttaaaacctagtcttggtacgcaaactcatagaagtgcaaacccaaaattcttataaggttttttttaaaaaaaaacattagcgataacctaaaaaagagaaacaaaatgctaaggccctctttaaaacacatgatagaaaaatcacatgaacaggacaaatgtagggattgaagtagtatgtttttctaatcctgtaggaattaagaacacaggagacagagagaaaagccctttgattacatcacagaaaacacttaataaaggaaagtttcacaagaggtctaatctcttgcttgtttttctatggaattgaccataggaatgcaatcctatgaaaattttcctatcctcttcctacgaatcaaagctcttcctacgaatcaaaggcctctatagaaaagaaaaatccttataaaaatgaatcctccaaaattcctttactaatcctctatttcaaaggggccctaaactttcatctcaactagctcccccacacctgaaacaaacacggtaatctcgtacaaccaaacttttagggctcctttgatttggaagaaaaagatagaaattttagagaatttcattcgtgcgattcaaaggggccctcaacagctaatagttttggggggtgttgctgattgaaatgtcacttagcttgcaattgaggacttgtgaagataagcatcgtttttacacagaagctccaaacttgtttgagagcgccaatttgcttgggtggcctattttggttgtaattttcaaggactttgcaacctgttgcattcgtgttctttttaagctatagcacctatttgcacttaaatacaattttgtgcaccatggacactatttactcgaacaaagagtaccacatttatgaaaactaagtgtgtaaatacagcaattcatgattagagttttagcacaggttcttccgttgaaatgataaaagtaatgatcataagatgttgctcgcattattgggactagatcctcacgcatcctctttattgtcgacaaattatttcactaaattcatctaataattatttttagtcaataggcattattccctaaatatttcatcatatctcaggtccagagtttcttttagattgattttcaaagatttattaaatccaatttttagaattagttaatgcattagttttggactctcaatttaagtaacatagggcttgttcgacagaactagctgttgcagccctgcatctgcgctgcaactgctgttattacaaccgctgtaactacaggtctgcagcaggacaagcttattacaacgttactacaatagccatccgctgcacgaaaatcctaacgggtgaatgatcgccccacgcgatcggtggcaaccggttccccttcccacctggtttctttttttttttggtcaccgtattatttttctcttttagtaagtttatacacctaaagtttacacatctaaattttatctacctaaagtttgtatagcgaatgtttataattcaaaagtttatatacccgattcaaattcaaatttggattcaaatattttatttgtagaatatttctatacataaagtttatgcgtgcattattttcctctttttagtaagtttatacaacctaaagtttacacatctaaagtttatccacctaaagtttgtagagcgaatgtttataagtcaaaattttatatacccgattcaaattcaaattcggattcaaatattttttatatagaatatttctatacataaagtttatgcatgcaaagtttacgatataaagtctatgcacatgaatgagagtaggggtgaaaatggtaacagaaattcccggccgtccggtgttcatttccgactttctaccggccaagccatacggaaatggtaatcgaccgataaaatatggaaatggaaacagaaatggttttgctgttatactgatcatttccgtatttaccgtattcttatggaaattaccgtttcttataatatagtaattactgtatttctaaatatgttgatatttatagggcatgtctctacttaacccatagtttagagtttgattgtctcttcaatcaaatgggcatcaccaatgtatatggcaaaagtgatccatataaatgggactcacataaaaggactttaactataacaatctccacaatgtatatagatacaatgttgcattaggaaatgagagagaaataaagatagatagtattatttattccatatgggtagtctatatgcttatggataccttttgttattttttctatatggaccagttgcacaatggtaataggtagctgaatggaatataatattgcctatggactacttttgcttcacattgtggatgccctgggcatgtctctacttgacccatagtttagagtttgattgactcttcaattaaatccctaacttgagggctaaaatggagttaatttataatttatatagtatagcttgaatttatttgtacatataacatacttatgtaaaattaaatatatgttttctatagtttaatgtttatttaccggtttttgatatgtaccgacatgtttctgtccgtattattccgtttccggttttccgatatttccgatatcgttttcgtttctggctttaccgttttcaatttcattttcgagaaaaatatgattatggaaatggttgaggctgttttccgatcgtttccaaccgttttcatccctaaatgagagtattagatttttttctaatttttttactaactttgtttttttgaaatttatgatgaaaggagagaagggagaggaatataggggggaggggcgggttgatcgctgggatcaatcacccgcccattaggggcaccctccgctgcagcgcttcagccgttcggctatggctgcgctgtacaaccgaaaaagctgcaggttggcttaccgaacaggcccatagcaatcaattaaaaaattaataattatctaacctaattagttaaattttggtctgtctatatggatagtcatatttgctttggctctcaatttagtatcatactagtatttcataactaaaatcctaatgtctgaaatcaataattagcaaattgtaatttgatagatttgttcggaggctatatataataatctaatatttgcgaatactgatggggatctcccagcgtgatgaatctcagcgaagccgaataattggctatcagggcagcgtgcttggctaaagcgaggagatcacgtttaatttttcaaaatgcctcgaaaagctacgttttctcaatgttatccccaacgcattgtcatgtggtctcatcatgcaccagcttgctatattatgcatgcaaatatatataagcaatgcatggagagtacgatcgatctccttcaattcgcggacatgccattattctaacgcggcttaatcactcatgcacttgtatgatttgataaggcgacgaagccagcaaggcaagtcacttgataattgatcgaaccaaaactccacttgttatcagctaaggattgcagcatatatacactgtacatggagtaactatacattaaacacgaactaatcagtccaatatactataattttggcaaaatgaacttatgaagacggttgatattatctaccaggcacaaggtgcgtgaccatcatcgagctaaaccggcactaagaacagtagaaccaataagatggacggtacaatgattgaagcgaatttgtgaagaaattgttggctagtgtatcctgctcctactaccagcctaccaggcaactagtatgatgaggaccacaaccacctatgctatgctatattccatccgtcaaaaaaaaaaaaccatagtttacgtgtctaacttttgaccgtccgtcttatttaaaaaaattataaaaaaaataaaaagacaagtcacgtataaaatattaatcatgttttatcatctaacaacaataaaaatacgaattataaaaaaaatcatataagacggacaatcgaagttagacatgaaaacccagggtttgccttttttttggatggagggagtatatgctatgcattgctgccattgctagggccaagagcccctctgctcagggattagtatcctttgcagtcactgcacggtgcttttgtcactgacatataggcctgatgtatcgtcaggtccacatgttaatgacaaagacacggtgcattcgactacagttgagagatcctcttctcagggcatttctaaatagaaaccacaatgtatcctcctactagtctttggagagtgaacgctgtcatacgcgggttttcctgctgatatgacggaggcccctacaagtcttatatgtattatcaactctgatctacagtgtcacgatgatacacgatttttagggcatccacaatctagttggaaagtgggtattagggattaaaatattcttactagctactaggtagatacattgtggaagtaatagtaaatagctattgccaagtcaaagcttaccaccaagttatatagcactttgtggtgggtcctatctattttttaattgtggtatggcttatatttagggttttttcagatgggtcacaccttattacccactctacacatatatattgtggtgcattttcaatctattattaccattttacatgagcccaccttattatctacttttacaataaacattgaggatgcccttaacgctgcccacctattgaggatgcccttaacgctgcccacctctaagaccgaaccacattaacacattataagaaggggttacccatgaacctgattaagattttttttccaaagtttatttatttttattatatgcacactctcttagcataaaacataaatatctgcatcagtctaaacttagttgaaaagtcatatatttcgttctaccttcgcccttagccgaccagcatttggtacaggtcgatttggtgccgtcaacctcagtccaccactacatacccaaggcacgagtgtttgacatgcccttaattaccatcttctctcgtagcatcgatttcttctcgccgcaactcaccaagtgagaaatcagctttcccttgtacttctccataatgcccttagactttatgctcactcaaatataaaaaggtttaacttactaacaaataaaaaatgttaatatttgattaattaaaatgacatcaattatttgttttaaaaattttcttttttgtgcatcaatgttattactcatggtagtcatcaagatttggttaaacttcaaaactttaaccatcaatagtttttcaaatgcttagtttaaatctatttttaaaaatcaaataaacctattttttaaagtttgtaataggtaatactcaattaaccatgtggtaattccccccactcgacgcggagcctttctctaacacaaaattaatggctgccatttaaaatagctcctctaacacaaaattaatggctgccatttaaaatagctcataaaatcgtatctgaaacgccatatatttataactgagagaattttgcttggcacagtatatgactagctcgaaaaacaaaagatcacatatgaacattggaaataatcatctaatttacatcttactagctagaacgggatgaactttagttgctattaaagtaaccggtatcttttatgttataaaaaaaacgtgaatttttcatgctatataaccaattttgtctttttttttaatagggaacatccatcttaaactagaaagagaaaaggaaggcattgcaagtactgtagcacgatatagccctaatcaacgcgtccccattgattgataggacaaaatcccacaattcatccgccatccgtgatcccgtgatccgtcagctgcgatgcacgcatgtgccaatgtgcggtgcgtgggggagtcgttccacagcgatcgagccggccaccccccaaccgccactttatttgccgccactgctcgcagttatactcgctagctctcagctcgtcggcccgccgcgcaccatgtagccggccggccggtcggacggacccctccaaatccaatcggttgatgcccgatcggacggccgagagatcgtcgcgcgcgtgttgttatcgagtatcatttgtacattcgcacacatgggccaacgacggacggctcgatctacgctagcttctacgagctcctagcacagctagtacagcacattaatccataacacgataaaattaagacacatcatgatgagccacagggtggtaccatcgatggactacatagagtataattcagtgttcacgttggtctattgttaagtaactactccctccgtctccataatataagggattttgagtttttgtttgtattgtttgaccactcgtcttatttaaaaaatttgtgcaaatataaaaaacgataagttgtgcttaaaagtactttggataataaagtaagtcaaaaaaaataaataataattccaaaattttttgaataagacgagtggtcaaacagtgcaagcaaaaacttaaaatcccttatattataggatggagggagtacacgatattgtaaactcgtacaatatattatatactgtacaatactccatattatacgtatttttttggcacatataagtatacttcctaagaaaatttaataacaaggtgataggtacggtgtagtcacttatgtagagccatgggtcgaagagaggtcatcgaagcaactcagcaagatccaagatggtgactagtagaggagaggcgacatgattatagggtagcgagtgacttagagcagggggaggggtttggaatggggtcaaaaccctaagccatatgagctttgggtgggatagaaaatttcaactccggtcacataaaaaatgcattagctcattgcctaccatagtttaaacgatagttttatgatctacactcatctcgatgttgtctagtgtgtggcctagacagtctcgaagcttctagacgtgatttggtttgttcaaactattatctaggcgaacactggctatatatttgaattgtcaactttatcttattacgtctaatttgtgttaaactatttggtgcatatataactcaatatacataatattggaattaaatgtctcgtactgaaatctagacggttgtgcaataataaaactataggtttaaaactaagtatcgcaaaactatagatttatgatttataataatagaattatctcaaaactacatattttggaggtctaaatcctacatttgagttatcaacattcatgttttgtaattatattaactaggaaggtagcccgcgcattcgcgcgagcatgtaccgtatgtaggatgaatttgagaaacttatagggacggtataccagcgaaataatatataaaatgtttcaaaactgtgattgtttttcatgagttttcttcattagcattacaaaatgaatttaaattttatttataaaattacatattgaagattggggttggtaacttatggtacctaagacatgactcttgaagtttcatatggaaagagaaaaaacttaggcctattgggatcatttagtccttagactaaaaagtttagtcgcttactgtttggatccagggatttaaaaaagactaaaggcatgtgctctgagcgagaaagaagaaagaggctgtcactttagtccctataagtaccttcaagagggattaatggattttagtttcaatatgcacttttagtcaccctgtttgaattcttagggactaaaatggagggactaatggattagccccattaaccaaatttggcctaagttataaaagacattacatatacaaccatatataattaatagttctactgatttatgtagaaaaaaatataataactttattatttgatggcagacatcgattggtcatagctacggataattcctcataggaaattataaatatgtgtacagtatagggatacaaattagaaaaaaaaatagtagaagttatgagaaaaaacaaatatatgactctcaatttttacttattcggtagtccgtcatttctaaccgttggatatttagataacctagcatattatgcatagtccaactaaccaaattattcatcttacctcatcacgtcatcacggatgttggacatgttaatctggataaatctatgtatctatgatttacatatataaaattttaagtataataaaaaatacacactactatgccaatgtagtgaacgatgtgtgtgacaggttcaccatggccggcttcaacatgaacatgatcacgcgtacctgacgcagcagctggacctaccgctggtggaggcctcgaacctcatcaccaacttcaccggcacggctgattccttcgccggccgcctcctctggaccatcgccgccggcggtgttctgtcccagctcggcatgctcggcctcgtcgtgtccgcactcgtccctaccctctgccccgcgccgtgcggcgctgccaccgccgccgcctcgtgacgatgactattttagattatgtatgtatacgtacgtacgcacgtatgagagggtgggactatgggagaagaggtgggttgtgggatttttttttctaaagataaatataatagttaaaaataataggtctagcgatttattattattattatagaaatattgggtccaccggtttattaaaatgccatgtggcggcttagaagcgtttgtaggagtctcacgtggcggcttgagagcgtttgtagaaagtttaatggacttttagtatataataatagatagatagatagatagatattaaacctgtagttttgtgataattttattactaaatttgtagttttacgatactccaccttaaatatgtagttttctgatacatcactttgaattttagttttacgataatttgatcaaagtatatgtagttttgttaaatttacttaaaataattacaatatatctttctgcaaagaattaaagaaaaagtgcaaaagtgttatgtagcttataaaccgaacatatgtgccgaaacaatggaaactatttttaggacaaaacttttacactcctatttgtagcgatctagactgagcaacacaacgatgaaaaatacccttaaattaattaaaaaagacgaaaatttaaattggaattgattgacgcctttacttctaacaagcagactcaaaatcaattctggcgatctcctgtaaaaggcaggagaaattgggtttgcgatctttatatgctgccagctgatcgaagcattaactaatctatcaagacatccatttatgtgacgacagcagtagcatctctaggttggtggttttcttaatcacaccgaataaatatatcgatcgcgattaagttggacctaaaccgcactttatttggagtacttggattcttcggttgtactactacagcctgcaactgcaaaagaagcatctcgatcggcccatgtgtttagtggcgcaatcatgggggttaagtacgggcagcgcgcgcctaaaaggcgttttaattaggtgtttttggctaggtgacatcctgttctaggatgaattcgtctatggtgaaatgatcggctggtttggtttggtttggtttgtggaattaataatcaatcacgctagaacttaccactttgaggaatagggcattgcgattggcatatctgtttcttttttctctcatatcattgtcttctagtactacatccttatatgttattttcattcagatcagccatgataggggcataaactattcgttcaaaaagataggggcataaactataacatcttatttatgaaagcaaacagttgtaatagattcaaaccactcaatcgatcctttaaagattaaggtatcatttgtggcatttccatacaacatcaaataagtatatatattccatatcaatcgtatggaattggatcctatccagtatcgcgtggatgcaagaaccgtcattgacaggttcttccaggttcatatatatatatatatatacatatatatatatatatatatatatatatatatatatatatatatatatatatatatatatatatatat

SEQ ID NO: 8323 - DNA, 2328 bp, Oryza sativa
  unsure (1)..(2328): unsure at all n locations
tatatatatatatatatatatatatagagtatatttgtttggagctatatggtgctcgggcaccattgtttatattgagtataaacccaattcagatgagcatgagtctttttcaattagttaggtataaatattagcaactttatacactagttaaaagcaagtttgaactgaatttgaacttgtttttgttagattttgattctaggtatatagcacccacacacaaaattagttgggtaggtaatcatggggtgtgaaataaagaaaaaacagagttgatttgtaaataggtataggcaatatctatatatatatatataggtatatactccacatatatatatatataaatatataagtatatatgtggatatatatatatatgagatatagacaccaatgtatacatatatagagatatatatatatatatatatatatatatatatatatatatatatatatatatatatatatatatatatatatatatatatatatacttcctctgtttcacaatataagtcattatagcattttccacattcatattgatgttaatagattcattaacatcaatatgaatgtgggaaatgctagaatgacttacattgtgaaacagagggagtaagtggctattactgtattagcgtgacggagcgtggggctcctcaccgggagaccgcgcaggcccccctttgccggttcggccgggggccctgggtgaggttctaagctcttggttttaggaaggttttcgagagtggaagaagcacacaagacacgggcgatgtatacaggttcgggccgctgagaagcgtaataccctactcctgtgtttttgtggatctgtgtatgaagaagctacaaagtgcgagccagcccccgatcgttctcagatcgttcggtcccctctttttctcctccccttctctaagtgggcaaggtcctccttttatatcttaaggggataccacatgcaccatctctctcttttgtgtggggacttatcctatcttttcataaatggacggagatttgtatggttgtcgtctgaatgaccttctgatgggacggcccatacctacctccacttccgccggaagcaggcgcgacgtgggaacatggctgtctgctgacgacatgaccagtgtcagacggtcacagacggtcacctttgtccacgcgtgtcagtttatcaatctgcatgttcgcccttcttcatacaatatcttgcctgtaatggttaggatgaagcctggaatatatctgaccggaaccaacgtgccatctccaggagctaacacgccggctccggctagggacgagtgcttggaggctctcgtcctgacggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctgtgctcacctaacccatacgcgcggcgcaaaacccacaaggggtcggggcgcctcggccctcggggccgaggcgggagcggtccaaccccctcggggagacagaggagggcgaacacatcacccttgggcccgacgccccccgagggtgccaggctacgtgggcgattgtgtttgcctcaagcctctagtcatgatactcccggtcccatgtcaccgacaacaacttagaaaaaattaaaagaaaatagaaaaaaatctaatacccttaaaaaccaatgttcaaaatcccagacctcccatagttttcagcgcattttttttgaacgaatcggtgagccgccaatttcattgaatatagaaggagaaaactgtacagtgtaaagggaaagaaaaaaactcaggacctttcgccctagtcaactaaggaacaagccaatttctcagatgatgcgcgcctgctaaggcctatatcttggcctcgtccttgatttttgtcagaagaccactcggtgggagctccttatgctggaatgttctgcgatttctttcattccagatctcccagacgactaggaacgttagggagcgtagagcctttttgggtgcctcttttacacttgtggtttgatcccccattctaacaccgacgaaacctgccaccaatggttggggtggatattggggtccccgtccattccgctagggtcgcccatattctctttgtgtagcggcagcctgcgaggannnnnnnnnnnnnnnnnnnnnnnnnnnnnnnnnnnnnnnnnnnnnnnnnnnnnnnnnnnnnnnnn

SEQ ID NO: 8324 - DNA, 16136 bp, Oryza sativa
tgcgatttctttcattccagatctcccagacgactaggaacgttagggagcgtagagcctttttgggtgcctcttttacacttgtggtttgatcccaccattctaacaccgacgaaacctgccaccaatggttggggtggatattgttgcacgccgtccattccgctagggtcgcccatattctctttgtgtagcggcagcctgcgaggaggtgtagagccgtctcctggacccgacgacataagggacatatggatccatttggccatccgcgggtagatagtctatcagaggtccagactctattctgaatgaccagccaggcgaaggttttgcatttgcgaagagcccagggcttccaaattaggttgttggccgttgttccaagtagttgtgcattataggccgatgttgccgtatattgaccgtggctagtgagcttccaagatatttggtcgtcctcatgttctgtcagctctattgtctggatggcggtccaaaccgtgacaagttggtcaatcagctctgttgtccagcccacgtccgctggaaatcccagatcgagcagccattgatctgattgcaaggcatgttggagggtactattctttttcttggagaccgcgtagactagcggtgccacatctttcatccttctctcctgccaccaggctgactcccaaaaactcacagtcgccccatttccgattgttatggatgtcgctgctgcgaaaaggagcttatcggtgtcatcgcacggcgtaccagaacccacccatgctttctccggtgacttccattcctgccaaagccatcggaggcgcaaagctcttgcaaacttctcaaggtttaggattcctagaccttcggaaccagttttcagcttgcaaacaccttgccaattaaccaagctggttccaacactgaacttttaggggtcatctcccttccaaaggaaggctcttccgaagcgaatgtaaaggactctacggccctgtttagattccaatttttttcttcaaactttaaacttttccgtcacatcgttccaatttcttcaaacttccaattttagcgtggaactaaacacagcctatattccttacacatgcgtgaacatttgtattctcaaagacagcccaaaattaatgtatgctttggtacggtatatgcctgatcttttgccaatttggatgcccacgtatccgacagctctctgtgagaaagcggttacattgaaaaactacaatgttcacgagggattggggaagcgtcggcagtgactgtatatttggacactcttggatggtcaggatatcaagctttgtcaggcaatccaagttggcaggcaaagagttccagctacaatctgtgattgagaggtgatgcagaagaccgaaacgctcaccaatcatgggtgggttattcgagcctttacaactccagaacataaggatttgcaatgcggccgggaattctccctgctgcacgaccccttttactgacaaccaacttgggtatgtcgtaccattatattccctgatgcaaagggatgtaatccaggctggtggatggagctcctcaaggacctcagcttgcatttgaagctctggaccgctgctcatctccgttacaggtgcagttcttgatgcggagcgttcgtcaccaccccaacttagcgtcagatcagttatatgcctcttgtcagctagcctggctcgaacagcctcctctttgcttcttatattatcaagacagtcaatgaacatcctgccacgaaggttgttcaggtattccagctggtgtatctcatatcccttctctttcctcacagtgaagcgaaacagatttcggagcgatttcagtctccctatgttgggaatgtccaagcctttccacgtgtgcatataccgcaaattgacaaggttccccattttcgccggggaggaaaactgcaaattaacgaaaggtgtgaccgaaaactcgtggagatggtaaagcttggcaaattcggctggcaaagtgatgtcgttgtaattaagggatggcgaaataccaagataacgaagatgttttagttcaccaatacatgctgggaccgtcctcatatcttgcaagtccaagtacaccacccgcaatttccttagcctcatcagcacacgctcaaagtcgtttttactcatctcctttatggaatagcacatgattagtgtgcgcaagtttgccagctccaaaatctgctcggggaatacttcatcgtagaacattatacaaacatggcgaacatatttcgaaatatgttgtacaatgcctttcttgatttcaacacggtcgctgccagcaaccatctttgctacgtcatacaacgaatcatgagccgtgaagtactccccagaactagtgtcagaattaaccttcctttttagctgaagaaatgagcacacctgcagttcatgaaagtagagctcgccgacatcttccatatcctcctctcttgcattggttgtcttcaccaaaccctgtgctatccacatgctaataagtctctctcgttccaactcatatcttctaggaaatatgctatagaattcaaagcatctcctgacatccatatcaagctgttgatagctccagagcagagctcctgtggtagaattcaacacgtcgaggtttgatgttgctctccaataagtgatatctgggttttgcttaagccggacacccactattactgctgcaataggtgacctttgtagcttttctgcaatttttctcccaagtggtataaaatctcgatcatcaaagcttgtgccttctagtgcgtaatgcatgaacattgaaaagtatatctccttgtccaaatcagatatttgaatatatctattagctcgtagagctacatctgttcttctagctgtcactaggattctgcttcctctcttcccaacatcaagtggagaaagtaaatctcgctgctcctggtcattcttatcattgacatcatccaataccaacaagaaacgtttgcctcttaattccttcttcagcttattttgtagttctctacgatcagtaatactggaatgccggttttctgtgatctcctcaagcatatcatgaaatatgtagtctgctctcaatgtctcagaaacatgaatgagaatgatagggtcgaaatatttgtctttatcctctttttcgtagtcacaaacatattgtgccagggtagtcttgccagatcctgcaatgccatgtatgcaaatcacacgataacacttactgttactggagcttgctgcatgatcatctggtccctcacggagaatcctatgaatgacctcacgctcctcatctcgaccgaataccgttggtttagtaacaggtttaatgctctgcctgtaattgctggaaattgtattccatctactgcttctttcctggttcgagagatgtgattgatgcgattcggtgcaaagatgtttccagtcgttcaaaatttcttctatcgcttctattcttttcctcaacttccttttggcacaaatagtcaggaaagaatcactcccctgcaagaaacaaagcctcaaatgattacacaagctgattgttgaaaatatatgatccgcatttcttgatattttgggtttactttccttcaaagactcttagttctcctttacaatgcaacataagaagaaacataggtcccatggtacgtcatatttgtaaacgaaaagtaatttgtagataaaacttttatatatgtgttcttagcgatttaaaagtaaatgctgaaaagtaaacttcgatgaaaaacccccaaatcaactccaaatttaaggttgaaaatttaaattttgactgataagcataagtataagcgaaaagatgaggctgatagaaagcagaatgcagataagaaaaaaaaacaaagaaacgtaaacacatgaagttcatggcatatcttttcaattttataggaacataaaacaatggaagtacagcaggaaaagcactgaaaatattaaaattaaagtagaacatgtgcccaattaacaatcatatttattattttcataattaataattatacaataaatttgaatctatatatttctgaagtgatacaatattacatattgatttaacttgttaaattctttattattattattattattattattattattattattattattattattattattattattattattattcttcttcttcttcttcttcttgacgacatgatatggaagaaacgggaggacaccatatagtactacctttgcctcaatttatgtatagttttagatttctgtgtgtaacgtttgaccgtccattttatttaaaaaaattatgaatttttttttaaaaaaagttagtcatacataagtaccattcatgttttatcatctaataacaataaaaatattaattataaaaatttatcaaataagacgacgataaaacgttggatataagcgttccaaaactacaccctttttagaattgaggtagtagagtatgtggcttgtgggagactgacagaacgtaccttgtagtttgtgatgcccatcacttcgtaggaccagttccggtaaaaacatgcaagctggtagaaggaacggacccgttgcagcgagggtacaatgtctactccttctagagggaacggatccgtagtatccggtggaggccgagaaattggtagcggcgcggcagatgcagatttgctgctgctacagttgggatccggagccggagtatccagtggtgagcgagaaattggtagcagcgcggcagatttgctgctacagttgggatccgtagaatccggtggtgggcgagaaattgggaacagcgcggcagatttgctggtgcaaagcttgatgcaagcgccgacggcgtcctggaggtagtgcagccagttgatgtcgtcatcgcaatctgatttggtcgtgcacgtacgcatttttttcatcatgctctctccatcctttgatcgatccagattgattagaaagaaaaaaaaaagatcgaaaaaagacacataccattgaccttgttcttgatttggtgataatcgatgagatccaagatgtcctccgcttcgtacaaggcagaccttagctcctcgcacggttgttccagtttcttcacagcagatctatcatcttcagcttctttctgcatcctctgctcctctagttctctcagcatatcctccagttttgggagggtatgaatctccagttcccggagcttccgcgacgcgttaaagccgatgtaggaaacgaatttgttcacgagcaagttcataatgggcgctatcaaccatcctaccacggttacgccccaacccacagctgcaatcctccatggatttgccatggaacgcttttgagaaatgggacaaggagcataggaaagaaggattggagctctctactgtctcggtagctgctagctgcgtcctgcgtgcaaacattgcaccctcacctcgatcattgaccggtcgtcgaaatttccagcgaatcatcttttttttaaaaaaaaaaaaaagaaaagtgactagtactgaaaatgacataagtacataatatgtggacataccaactaagacgggcagacttttcaaagaaaacgcgtagtcaacattaaaaactgtccgacttttataactgacagcacaaggatgagtaatatgaagaaatctatctatctatctttttatactaaatccattaaacttcctatgaacactctcataacgccacatggtattctaaaatcgctcttaaactaccacatgacgctctaataaaatagagaaaattttaaaaattctaagaaaagaaaaatatctagcatttaattttcatttaaatggtagacccattagtttaccccgttagattagatccattataaatagtaatctatccctcctaatctaccatgtaatacttacctggaaaatattagccggaataagccaagaaggcataagttcaagctaccacatggcattctaataaaatagagaaaatcttaggaactctaagaaaaagaaaaatgtctggcctttaatttttatttaagtggtgaacccattagtttaccccgttaaattagatccattataaatagtaatctatccctcctaatctaccatgtaatacttacgtgaaaaatattggccggaataagccaagatggcataagtaagtacgagttaacaaccacaaaccagaaaagaagaaatgatatacagcaaaaaagaaaaacaaatattgcatatatacgtactacatactacttggaaaaaaaacattgcttttaaaactggattttcacttcctctgtatttttttttacgatggccaatgttaaatatttagtgaaagtaccgaaagaaaacaataattttaaaccagattttctattatacttcctctggatttttttattttctttatgatgatcaacgtcaaatatttactgaaggtggtagtataagaaaaatatattacttcataaaacatgaacacccaaaaatagatctataatataatataaaatatcaaataaatgtatcatttcacactataattgttgagtatagatatattttatttgcattaatgggcctaaattgatagttcaagatgaaataatgagtaattaaaatattactcgggacatattgtcataaacatgaatataaatgtattgtttaaaaatatgttgcatttttttctcacaaaacatagtcaggattttagcagttaatgactcaatctacgcttttgatttgtacatattttttaagtatataagtaataaatttaaggttgagttctaaagtgcttatcagattggctctccctcatttatcttgagcatgttctccgaactattaacctatgcgtgttttgcaaatactttctatacatttttataaaaatatatatattttttcatgtttgtaatatttaatacttaattaatcttgtgttgatgacctacatcatttttcatgccctgcataagctcaaccaatgagatcgaatgtagcctaagtaggagatagattagattatttactataaaatttaaaattaaagaatcaagttaactacattattaaaaaaatcattagtttgatcatatatactctacgaactgactaaagtcacgattattgtatttgcatggtatgcagatcgttggtaccaaggtatttgcgagattgaggtaaaagagatggagacaaggatttttacacatgtttgggccccttatttgacaggtaatagccctactcctattggccgaagctggtgtgctctatattcatcagaatcacacaagtacaatatttgggataacctatctagctgtcgtcgacttggcagcatagataaccaacacgtagtcgacagcatggtagtcttcctcctcaagtacgaactcatcgagtttagagatggtgctagatccctcttgtcggcctccgcaggcatcatattgggtttgtctaggcttatctctgatgtcgatgtttagcagcctgtgttggtatctattctgacttgtgtgtcgatctgttgtatcctctctcccctagggggtcttgtattttatacccatagatagccccttgtccaatatggatacaattcgagtagtccttgtcatttccgtatacaactatactcatccttccttatccaaaactcctatatgtgaggtataattccgtataaggcttggtatatggtggccccgtcgagcttagtcgattactattgggtatgtggtatccataaccatgacactattgttcactgatccatacattttttaagaaaaaagcaaataagttttgttgtctcctcactatttcttagctattaaattaaaacagaaacaatcaataatattggattttttagaaacacagcacacgtacaccctacctctttgagtacctccaaaagactaagctgacacattttgagatacaatgtcaccacgggcgtctcactgtcgacgggtacgtcacataccaccgaaagaataattagccataaatacgagcacagataactattgtattaattagctattaaattaactataaatgatttggagcaagtagttaactatattattaaacttgctcttagcacccatttcaattagttcaagaattgtggtggattccttggggacgtaactacacagctagtggtagctggtttgtctataagaggcaccatccacctatacttcaaatacaattttctcttaaactactcatccgatctacgatccgattacaccgttgtattcataacaattaaatctttacaacaagatctcacatgattatattttgatgaaaaatcacaaattacttttatgatatgtctaaattacttttagatttcactaagttacttcttagttatataaaagtaaattcagtaaaacctaaaagtaatttaacttagaacaaaacgaaggtaactttaagatgtcatttgaagtaaatccgttgtagagataaaaacatgactctatctagaaattaaattaatcagcacaaattatgaaattaactaaaataataataaaagtaatcatctcagagcattatgaatgtatagtaagtattttaatcaaatctaaaagtaactcacacacacacacatatatatatgataatttgttcaatgaaaaaaggcataaattaaagttacttctataatatatgtaaattacttttagaccttactgaatttactattatatgtctaagaagtaacttagtgaaatctaaaagtaatttagacatatcataaaagtaatttgtgatttttcatcaaaatataatcatgtgagatcttgttgtaaagatttaattattagaaacataacggtgtaatcggattgtaaatcgaatgagtaatttaagagaaaattttatttgaagcatagatgataggaatatttcccctacttactcaatggattaatagcaaccaaaactcctagagtaatagcacgtggatgtctctgattaagactaattggagaggcctcttcaattagatttaccgattccttggccacctttctctgtccgacccttctttagaattcccgtacctgcaatcctttttagaaagacacacatcattttgggaacacacaacagagcattaattgcgcgtgtcattccgttaagagaggttagagcaagtttaatagtatagcccattactagctccaattcatctatagccaatttaatagctcatctatacaatacaatagttacatactacactattaatacatggtcccaactgtcatacacacactgcgtcttagagtccgtgctacagttggctacaaatctgtagcccgctgctcttctctcttaaaatatgtttgcagctggcttatagcctgctattgtacctgctcttagatcaagtttaatagtatagctcactactagctccaaatcatttatagtcaatgtaatagccaattcatacaataactctttactatactattaatacctggtcccacctgttatacacacattacgtcttggagtccgtgctgcagcaggctacagatctgtatcccgctgctcttctctctcttcctttatctctttaaaatatgtttatagcctgctattgtacctgctcttagagcaaggctaataatacaactgacctgatggctataaggttctttatagccttctcgcagcttacacatataatagttagctctttaattgggggtgaagaatgtccggttttgtggttcagggggtaattcggacgaccgtgatagttcggggggtaattcgtactttttccattaaaataaaaccggagggagtaccatacaacatacatcgaactctgcactgacacatgaagtggaactcgcaagtatcagaatcaatatatacaaaaccatttgtaaaaaaaaaaagcaaaattcaatttttatcactactatgaaagaggtttttccaaactgtcaaaatcaatctttccatgcggttgggccagccgtctgcacgagaagtgctgtaaagatcgcgattttttcatgcatgcaaaaaacggattttcacatgcgggtgcttatgaggaccgcatgcaaaaataaaaaatcatgaaaaaaatatgatttcaaaaataaaagccaaaccctaaccctgccacccgctccatcatcggcgtcggccgagcaccatgccgctgctcccgccatcaccgtcaccggcgctagatccgtcacggcgcgtggaggtaggaagcggccgccacgccgaggttggcatcgccagatcctctgttctctcgccacccaccatcgccgaggctgcaaccgcaccgaagggcagcggatccgcccccctcccccccccccaagggtggtgccgccggatccgccgccctcaccgttcaccgtcgccgaggtcgcagccacacctaagggcggcagatccccccacccctccttgagggcggcgccgccagatccatcgccctcaccacccaccgtcgctgcccgctgtcgccgaggtcgccgctacacccaagtgcgacggattcaccccccctccccctcccgaggacggcgccgccagatccgccgcccaccgtcgccaagacacaaccgcactcgagggcggcagatccgccaccgttgcagaggccgtgtagccgctagccatcgcaccctcaccgtccgcccgccgccgcacccaacggccggcctcctcgtcgacgtcgccgcccgctgccacccacgtggattcggaggaggagaggagaggagaggataggagagaaagagagtagaggggagaaatatcagagagggagagagacgggtgaaatttttaaagtgttgacgagggagagagagagagagtaggagagaaaaaaaagatggggtatttttgcatgcagacaacttaaccgtccgcacgcgaaatagagttttgcatgcgactccttaagatcaccgcatgcgaaagtagacttacttttgcatgtggtccgttaagaggtacgccagcaaaaatagattttcgcatgcgcttctcttaacaagccgtatgtgaaaatatgggtcaatttttgcatacgcggacacttacaatccatttggaatctattgggggtctcgtctagaaaaacgttttctctagtagtgtatccttgtttttcgcaaattctattttgcaccttaattctagaaccagttgttttatttactgtagtatttacaaacctgacaaatagcgcagtagactatatattcactactgtttgaattggtcttacagttcgctaacatgaactattgtttgctagaatagcgttgatgtgtacttcgtaagtcattctagcattcccctcatttatattgaggttaatgaatctagatagatatatatgtctagattcactagcatcaatataaatgtggagaatgctagaatgacttacattgtggaacggagggagtacctagttattaataagtggcattgatgtcagcagcacatgtataacgggattgtgctagtgaaaaccactgtcaatccaaacaaaaccatggtacaagcagggtccacactttcagaaaccaccaaaatttcggaagtggtcaccaaaatttcgtaaattttggtactcttttgcacaaaattattttaaagttcaacaaatttggactgaatttgaatatatttagaccacattaaagaaaaggaaaatcaaaaaatttcggtcgagatagttgcttgcttggggggggttaaaaattttcaaaatttcgaaccaaaatctctaaccttgggttcaaggtgtttctttatgcatgttctaaaagtcaaggatgaataataaccgattttatagtttagggacgaaagtagactttgagaaaggtttaagggcttaaactagacttttccctttttaaaaatctaggttatgagttgagagaccaaaattgattacaataaaacatatttatatggactattaaagcaagaaagattgttataaaccacatgtacgtatatatatggttttgctaaaaaaaactttcgacggatttattttctcaaaactttcaaattttccacagtaagatgctctttaagatttgtgctaccgagataaaaaaaatacttgcgcacgaacaaggaggatgaatggatgatgatgtgtgtttgcaagttagctgcagtagccactagcgatgatgtgtgtttgtgaaagaaaagattaagttgcatactagttatataacagttacattgcatacaagttacatttgaaagtttttctctaaaaaacggtcgcatgctttataggtactttaaaccatgtaaaatctgtcagccagttggagagcacccatggtttttagccgcggtacactggcctttggttgaaactggatcgaactacacaatggtttaaatcaaccgccttaattcagtcgattttaacgactgtgcctcaagtgcaggagagcatgataatgatcctcatgaggttctgacttctgagtggatcacgcaaagcaaccagtggaattagtttagattagcaccactggaccattctacttgtgtatttatacatattataagaactgaaggacaggtacgtgatcgatcgatgcagttcatgtggtgatctaacaatttttttattagaaaggcacaaattaatcaagccatagacgccattccagtgttacttggcttgggatctcagcggccttgcttattaattaatgtcctcttgtcgttgtgttccaaattcggtgcatgtacaccttacttaacaaattgttggagcgtttgtaaaattatttaaaattatttgttggttgatctacaaagtccactctcttataaagtaatgcagtttgcccacatgatgaacaagtcaacggaagaagcaaattaatctgcgcccatagtttcggccgatttcgggtgggtttcatatcagttttactctctccggtttcattttaattgacgttttggacatcaaaattttataactttgaccattaataactttaaaaatatttagaaactaaaacaacaaatatagatctgtctttcaaagcactataatatatataatatataaaagtaaacatatatttatttattgtatatattataatagaaatataatgtcaaaggtatattttgtagaccgtgtcgttgtccaaaacgtcaattaaaataaaaccggaggaaataccatataacgtacatagaactctgcactgacacatgaattggaactcggaagtattctcaatatatacaaaaccatttgtaaaaagaagaaataaaattcaatttttatcactgctatgaaagaggttttcccaaaccgtcaaaatcaatctttccatgcggttgggctagccgtccgcacgagaaggtctgtaaagatcacgatttttccatgcgggtgcttatgaggacctcatgcaaaaataaaaaatcatgaaaaaaataaaatttcaaaaaaaaagccaaaccctaactcccgccgccacccgctccttcaccggcgtccctccccccctccttgagggcggcgccgccagatcctccgcctgctgtcgccgaggtcgccactgcacccaagtgcgacggattccccctcctcccgaggacggcgccgccggatccgccgcctaccgtcgccaagccacagccgcacccgagggcggcagagccgccaccgttgcggaggctgcgtagccaccatccgtcgcaccctcaccgtccgcccgccgccgcacccaacagccagcctcctcatcggcgtcgctgcccgcttccgcccacgtggattcggaggaggagaggagagagaacgagaggagaggataggagagaaagagagtagaggggagaaatatcagatagggaaagagacgggtgaaaaattttaaagggttgagaagggaaacagagagtaggagagaaaaaaaagagggggtatttttgcaagcggacaacttaagcgtccgctgcgaaaatagagttttgtatgtggctccttaatagcaccgcatgtgaaagtaggcttatttttgcatgcgcggtccgttacgaggtccgcctgcaaaaataattttttttgcatgcgctcctcttaacaagccgtatgtggaatatgggtcgatttttgcatacacggacacttacaatccgtttggaatctattgggggtctcgtctagaaaaacgttttctctagtagtgtatccttatttttcgcaaattctattttgcaccttaattctagaaccagttgttttatttactgtaatatttacaaacctgacaaatagcgcagtagactatatattcactactgtttgaattggtattacagttcgctaacatgaactattgtttgctataatagcgttgatgtgtacctagttattaataagtggcattgatgtcagcagcacatgtataacgggattgtgctagtgaaaaccactgtcaatccaaacaaaaccatggtacaagcagggtccacactttcagaaaccaccaaaaattcggaagtggtcaccaaaatttcgtaaattttgggattttggtactcttttgcacaaaattattttaaagttcaacaaatttggactgaatttgaatatatttaaaccacattaaaaaaaggaaaatcaaaaaatttcggccgagatagttgcttgcttggggggtccaaaatttcgaaccaaaatctctaaccttgggtacaaggtttttctttatgcatgttctaaaagtcaaggatgaataataaccgattttatagtttagggtggaagtagactttgagaaaggttcaagggctaaaactagacttttccctttttaaaaatctaggttatgagttgagagaccaaaattgattacattaaaacatatttatatggactattaaagtaagaaagattgttataaaccacacgtacatatatatacggttttgctaaaaaactttcgataaatttattttctcaaaactttcaaattttccaccgtcagatgttctttaagattcgtgctaccgagataaaaaaaatacttgcgcacaaacaaggaggatgatgatgtgtgctttcaagttagctgcagtagccactagcgatgatgtgtgtttttaaaagaaaagattaagttaaatactagttatataagttatataatagttacattgcaattataaactagttacatttgaaagtttttctcctaattaaaacactgtcgaatgttttataggtgcttcaaaccatgtaaaatctgtcagccagttggagagcacccatggtttttagccgcggtgcactggcctttggttgaaactggatcggactacacactggtttaaatcaaccgccttaattcagtcggttttaacgactgtgcctcgagtgcaagagagcagataatgatcctcatgaggttctgagtggatcacctaaaaaacaaccagtggaaatgtggaattagtttagattagcaccactggaccgttctacttgtgtatgtatataatatatatatatatatatatatatatatatatatatatatatatatatatatatatatatatatgtaagaactgaaggactggtacgtgatcgatcgatgcagttcatgcaaaagctagagcagatgataatgatatatatatccacatgaggtccgtgatacttgtcgtgccactgcgataaccacaccatcaacagctagctaaaataatcatgggattcgtcgccgtggtcgatatggtttccgggctcaacagcccaatggcgagattggtccggatcgaagtcctggtgctgctgggcgttgcagcgctgtttgtgctcctcatcctcggctcctaccggcggcagtcgagccgcaatgccgtcagggtgagcatctgggtggcgtacgctgcttccatccccatggtgagctacaccctggggctgatgcagtcg

SEQ ID NO: 8325 - DNA, 25449 bp, Oryza sativa
taacttttaatatttgactgcaagaatgttataagggaaagccatctctaccgagagcattaagttcaaaatctaaaagtaacgtggctttcaatggtgatgaaaagctgcaacaacatgaccagaaatttttcatggtgttttctctaaagctaaacgagtaaactttcagtggtatcaaactatcttttaccaactgtggcatttattccgaaaaccatgtgttatgtacaaccatagttagttcattttgcatataaggccaaacaacaatagatattcatatcttggttgtctgtcagaaaaagaaaatacaatagtgaacaaatgtttgcttactttcatattgtctgtactgaatcgtagttgtatgtcttttttttggcaattaattacggtcaagggccgcaaaatggctcttactgcaaatatcaattcaaatttaaataataactgttgtacaggattaattatggtgcactaagttattattaaacaaaattaactgacagtgaaacatttatccaatttaattgctctattttttttctgatccttatcaagtactagcattgacagtgagttgaattaagcaatcctctgtctctgcctcaactgctatgggattaggacagtacttgccaagttttggccatataccatcagttttcttgggtgctaccttttgttttgtggcaggcttagcgctacttggcagtgttctaaaaatcaccattagaggcggcacctcggtgccaagcaccagctcagcgctgcgaatagcacattggtccacgtcagcgcgatggtcaacatcggtccacgttggcgcctaggtgcagcagcgattagtcaactaggcggctgactggtggtggtggtggtctggttctggcggctgcttggatagttggatgcatgttgctgctgtggtgtaagttgccgatttcagcctttggcatgttggcaactatcaaacaaatggtagaatcaaatattcaaatcctaaacacatgtattttctacaagttggatgttggcatgctgcaatttgttatgttgtatacttaactcactatctaggacctggtcaattctccctcccaagttggctctaggcgctacgcatcaccctggtgccagactagcgcctagcaccttcttgaacactgctacttggtcatggtttcatggtcagagatgatcaggtaatacgtttcttgtttgtataacttgtataggagtaatgtcacctcctgggttatcttacaatgaacctcatggtttaagcgaacattgtggttgttccttgcaggtacagtaaaaaaaaaactggcaagaatctgtgggatctggctaaggcgaagaccagggatattggaagtgtacaaatggtcagtgagtttcttctctctttttttttttttttgtggtgatctcgtcaagtagatattgagttgcaaatacctagtactagtatctgggctgtctgaacacaacaatgttgaacgatgatcacatgatatatttcagctgatgtataaatcaagagaattattcatgtattccgaacaaggtcatatcaatactatattacagtacgatccgacggctctagccagcgtctctgacatttccctaaccaatcctttaatgacaaaatgtcttcgtcagataatgcaaaatgatttcaaaggattggatcgatctaataagacgcaaaaagaggttgtaagcatctcagcgggatgcgtaatgtatcgaattacctacgcagactgtaagggaggaggaaagaacgacggattcaaatccaaaatggataaatttcgaacaaaattaccttgggtgacgggcagggcagagattcgatttcgatgttccaattcctgtcaccttcttatcctcttcctctcttccagttgtgttctgcaaagacagagcaagaggagatggttggctgggagcaatggctggcggtagctagagagggccagcgagtgtaggggtctcctacaagtaattctcggccgcagctagcgtatatacccgtagtctacgtactgcttcggtcaagtctccttccgcacgataggaagaagaatctttggaccttttcaacctcgcgagctaatgttttcatttacgactcagtgatcactcagtagagttgttcaagtcctgagatttgagtcaaatcaacccatggaacgtcgcagaacaaggccccacaggacactagctagaatcctgattttaacttgggaagtaacttgaagcctcgcaacaaatcatcgccaaaattattagtcatttgcagccagtaacaattttccttgacgggcgagcagtagtagtaacctttacacgcatgaactcgctggtgtaaactatataaatccagcacatactcactggtcagctggtgtaactatataaatccggtcatgcatgccacaaaactctacgccgtccacaaaactgagcattgcttttgatgccaacttaattcgtgcatgctgacctccttagaaacaaatgggtgatttcaaataacttacgggacacatgcatcgtctcatgtggccacggccaacaggcagtaatgtatcagagctggcagtatggtactaaccgctagcatattatactcaagaactgcctagagctagggggtaaaaaaaaggtcagtcaaacaaatttgtactcgaatatgattggtaaggatcaaatctaaattgaggcaattccttctttaaaccacggcaaaacgtggtcggtaggagcaaatcagtaatacatgtacattccactgttctgcacatactgcatagaagcgctatgcacaagggcatatacaatgttatggggaaagaagctgtaatcaagttttttttctcttttgctcatgatggcaccttgtgtataaactcaaccatgcatacgttcctatttgacaatgcagcaaggatatgatattcgcctttaaatttgccaccacattaccaatctatagggtcattacccttctgtacagaaaacaactttagctggtcagttctatgatgatagtgcagctaatccaatgtggtcatcttcctcagcactaagtccatggcgtgcagcagagctccggtttcgagctggacatcagagaaagcaacgtttgttaacagagtagaataatccatattcaaaactagctctgagtatatgataactaaacaagtgctcaatctgcatggtataacaaaaagctggcaatggaattatcaaaagttagcaaggagggctcaaaagtattcagtcagttaatagaagaatctagttggtagaagaatgaaaacagtacaagcaggatgatctccactttactcggtttaaaaatccttgagtagtggcagactatgaaacaaaggcaacgacaagaaaaatgattcaatttttcagctaatgtacttatttccgtttattaaaacaacgttgtgttcatccattacgcaataatagaataaacatattaccataaaagaaatgcaagtcagttctcacttgtaacgttggtaataacattagtagccttttgaccaacaagagctctcaatttgttccctgaagcaagcaaaagtaagcttcgcataagtagcttttgatcttttggacttgcagttttgctcaaagactcatcaaaggctagcaaatcttcctgcttcatgtgtgggagggacagaagaacctacaagcaaagcacttcctgttagtcccaatgctcaaaatttctatgaaagccactgctataagtggtgtaattattttattgtataagcaagcagctgtagatttcaaattgtgataatacatgtttctgtaaaaacatatgcatagcttcaaattcaaaaaggcgacagcacaactgttgcagagaaagccaattatgtgaaatcaagatatttaaatcgcattttcattcagcagttacttttgcccaattatatatctcaaaaatacctgtctaggtgcgggatctctatctgagagatagatatatatttctcgacaaagtccaacaagttctgaactcgtaatggaattcaactcaacagataagccatgtaatatggaagaaaatagatctttcgcaacaaactgactcaactcagcccgatttgttgcaacagcaaggtgaatcaatgcaccacaaaaaggaataatttttgtgactgcttcactatctgtccaactgaacacttcaacagttatcctcaatgcaggaacagcagtggagacattaagcataagaaatctgcaaaaggatagcaaatcagtcttttgttgaggtgagaggtagcacacagctggctagaaatttttgtattacccagtgatagagctggaaacaaacaactccagatccttaagagaagaattaatccggttggcaggtccaagttgttctaaggatggaagaccactattcaagcctggtgatgctaaaacccaaagaacggaacatacttcacgagtcaagtctctaagcaatttctcttccattacctctaccttcagatctgacccagaaagattaccaaaattatcaggaaccttagcccggccctcacgaagaagactggaccaagagaaatcaagagcttgctgacaatggacaaataatggctgtaaaaggttcgatatccacatccgccacagttcaggagggcaatatttaaccaaaggaataataacaaggtggataagttggcgcaaatgccgaaattccatagcttgcacgttctccataagagcagcagtgatggaggaaccctctatgcatcggaaaaatggatccccaagactagccgatagtcctataacattgtacctgcagtatgatatgttcagatgggtcaaagacagatttcaggacaaatgggtcttagtgtaagatgcaaattttccagataaatgtagctcaaccattctcatattttaagggatatcagaaatgttaatcccatgaattcacctgggctatttgatattatagccagtataactatcaataggaattagaaatttgatcatatgaaagaccagatgcttaggttaaatttttacccactgtcacggatcccgcgtaaccagttccttatggtgttttccttagactctccctccctttgaacatccaacaatccatcagcagatgcaacctggcctttggtgagtttatttgtctccccaagaaggctggtctgctccgccacagtcatgctttttgccgctttgacttctcctgccagagactgagaaaagggctcggcccaaagcatatgtatgcatcgcaacagctgaagatcagggagaaggggaaaaatagtgatgtcaaaactatagttagctatcagcttaaccaatacatagtaattacatcaaaaaaaagaatgatgtgttggcaagaaagaagtgccaaattacccttaacagagggggcagaatccatggtagatgtgaacacattggatgcagattagcagttaccactgttgtggccagtgcttgtggagctgatgcagattttttggacccacccctcttgagtgccttctcaaataatgtgatgttgtgataaattgaccacataaattggctgtcagcaaacatgtgtgtcaagccagatgggtcagacaagtatgcattttgccattccacttgcgtccacattttgttgataggttctagtaaccaagccaggacttcctgttgctgttgaatcctacaaataaggtagaagatccaaacatatgatggaacccacattgacaatgtcacaataacataatgttaagacataaatctgaaaaggtgcagaaaccgaaataccctgcagaggatgccatgacaagaaacgcttcacagaggtggttatgctcagcacgtagtaagcgaccctctccttgaagataagccattgtatcagcaatgttctgcataattggtaatcattgtcagcgaccacaagagaatagatgctatggtgacttggtgagcaggactatagaatgcaaaaatatgcaggccaaaataaattaaggcaatcttgatagcacactgcatttcttactttgttcatgtacacatttgctaccctacattgaagacaggccacactgatttccttagttcatcaacacacatttcttaccttgttaacataaattgtagaactgtagcaataaatctttgcaacgacgattttaaaaaatgttatgtagttcagtgggatcgtaattggataaactactgccacatgtacatgctatagctgccagccagcaatagacatgcattccattagggccaagatggcacactagggttgcaacaagctagagagagtataggatctatcagctaatgtctagctgcagattaagctatcaagtacagtaaacacattgatttgataggatcaatgttctaaagggcgcaccacctaacgtcgtctaggcctcctaatcactgattagattatagctgctggtctgcatatgatttgtgggtaaagccttgataaacattggactttggataggatcttatttatacaaagtgttaccatgattaattggaaacattagattaggttctcagggactagctggcatcatctgtcacaaatccctcgagcctcgagttgctatctttaggctagtttaccttgacccagccatagtaagaaaaatcagacagcctcaaacagaaatctcaaacagctcaatttgcttcaaagacatgctaccagtaaaaaacaattgaactggccaattccacatgaaaaccagttaaccaggaaattctcagcaagcagctcaagcacaggagtggaacacatgggccactaaaggaccgcatagtcaaaccattaattaaatgggcatgaataaagggtcatgcagggggattcaatctctaatcagcagagcacaatcctgcctcgggtaccacctagctagctcggcttgttatatttacatacgaatactaactcagaactcagaaatactagcacatatcatactatcaacacaggacagctctacaccatataatccataaatctccctccctctctttatctcccttttgagtttttttcttgaatacgcatgagcgctgtgtatcatttcattaagagagaagaaaacacaagggaagctgaaacacccccactcaccccaaacatacaagtcttgaacttaaaacaaaattaactcaacacgaacttacgcaaccagagtgagagacctactaagaaactcactgaactcacaagctccagccacgcaccaaaaaccacacacaacactaggattagccccattaaacacaatcatttctatgcttccatatttaaagctagttactctcatacacaaatatatttaaagcttgtatgaaacacggttataactagcgatccactagtcagaccagtgacagtccagcctgttcaacaactggtctgactaacaggcaccaaacagaggcctcctcatgtgttcccatctagagtatgtggatcttcttttctgctccatagccatcaaacagctcgtggagtagctcttcatccaccggatacaccagatggctcaccatgatacaaagaactcactcagtatcggaagccatggtgagtggctctgataccaagttgtcacgacctgaggccacgatgggataatcactgccaggatgatagccaggcagcgtaggctgctaaggaaggtatgtagacttaggttggtgaaagaacatttggggagagattagactaattctgattcattgcttaatgataatagacacaatcccatccttgtatagatggaataacttggcccctaagtaaggactcgatctaatcttatgtttaactcacctggtactgagctgctaatggctcagtctctcggcccaatgcccatgacactgcctcaaagcaccatacttcaaattgtcactattggtctctgcagcatttatccctgttgctctatgttgcataactaatgtattttgatgttaatgacctgcttgcacttaaatgtctttacaatggtcataaagaaattcacactgttacactatgccaaaagtggaaatagatagtcacatcaacaagatcacactaaaattttaacaaaactaaattaatcgaatcttagtatggcactgatggattgttcttctacttatcgatattaagttattaatcactagaaaagagtatcttctttgatccataataaattcttactagaataattagtacaaaaaaagtggaaaatcatccacgtactacagctatttgtatcctaggtgtccgggattatgatgtatgatgcaagacttcactttgcaacacagcattgtactcacaaactgattctttatcaagtcacaataaccgtgtattgataaaacttgagagcatgtacaacccaagaccgtaaataagagcaatgtacttcccaggtaaatttccctcattttgcaattcaaatatcatgaagacccattttctacttgtaactactactccctccgtttcatattgtaagactttctagcattacccatattcatatagatgctaatgaatctagacacatatgtatgcctagatttattcgcatctatatgaatgtagccaatgctagaaagtcttacattgtgaaacggaggaagtacatcatattagaagtccaaaaacacaactgcgctggaagaatggcaagttgtctaccatacaactaaatgtagctcaaagcaactgcatgtgagatcaaatgggaaaccaattagggacaaatcctaaccttcatgtgaggcagaagtgctttatcagcagctcttgatatacgaatgaatgatgagcagatctgcagtctagcttgacggaaattatttgaagggtcctattgatacagaaaatgacacaaaaatgtaaatacataacatgttattaattaccaggtaactcaaaacatagcaattgacaagcaacaggagagaaataaaacgcatgaaaagtccacatctatattcatttctgtgaagtcttctatagtattgaattggagtgaaggattcaaagtccctgatttgccacatcgtaacatcagggtatttaatgtgtattgcttaggtattttgctgcagcctagaaaatgtacctgaattgtgatggggagagatgttaatatttcaaaaagcttattcacaatacaggcaactgcatctgggtaatgtctcaagaaaggacccaaagaatccaaatagtgaccatgaataacagcaagatttggttgtgaccactttaaagaaagaagctgctgaagtaagcctggtcacaaaaaaaaaatgaaagtaagaacattgtatatccaagtatccaacagcagacctaaattaaagtttaaagacagctgaaaccttcaaagatcctgtgaatttggaattttgtgtcctggtcaatctttgaataatcagatgagccatcgaatatagcactaacaactgcttccagccccagctgcgcaccttccattgcatcaagatcctggcatggatatttaactcaagttacacaacaacaacaaaaaaatagaaggtaaaactttctttcagcaaaattgcaagactccattaaattgatgtcgcaaatatatgtaggtaatgtatccaacctgggatgatttcgttgcttcattagcatctccaaatacaatgtttattctctgtacaatgcttgttgctgtaataccaggcctttgagatgcaatgacttttatgagatccagctgcaggaagaattcagggaacttgttaattaagtagtaaatgatttgtggaagtacaaaattaattgcatggcaaatatcctgcattgccacaaatcacatgtccatattgaaaatctgcgaaaaagaatgcatgttgtcacaaaagacaaatggatacttgtagcatgaaatggcatatgacaatatgtacccatgctaacaatcatgaacttatgtggctgcctcgtggctgaacgtaaaagaataacaatcatgcttttattcagctagaatacctaataggcatacccatgaacttatgtggctgcctcggtgagcagcactgctccagtgcctcaacaaataacttgcacttaaagtaaaatcagattcgactgaggaaaatttgcactttgaactaaaacaaattgcagcatagaacttgatgaatgccagagaatttgctgctctgcgtcaaacaaagaacatgctgattgcaattggtaacaaactgaccaagcagattggcagtttgcttgctctagttgataaatagtttaagaacctaaacaagctctatgataacaggcaaactctccaagtagcaggcaggcaggcactcacgatgtcccgtgtcccttggctcctaaacagctgaaattatgtggatgttgatcaacaacatgtgtgtctgaactctgtcaatatccttgtctaacatacacatcaaccaagggaccaaccaaatgtagaacacaacccaaggactaaagctgtagatgtcagatggtgtttgcgaggctattccagaaaagttgagtgcaattggactgatatttgtgttgtgatacatcaggtttgcatgccaaaataagtgtcagtagtttttcttaattttttccaaggatataacgactgaatgaggcaacttcatgaaattgttgaatgttaagcaagaggcaacagcaactacagtttttacatgtcaggagaaaacaagacctaccagcttggcacggtagttgcagaagtcactcttcccctctagctcttcactccatagttctaacagccctgaagatgcactcgtactttttttaagcattcttttgaacgtaacatccaaaattgtactgtacatttcatcagtgattaatactgacacccctttcttctccctttcagttgaaccaccaccagtagatgcagaattaccggcagcaggggtgtcactagaaacacgtgcaacagacttagcttttgatggttctctcaagaccacctacacatagctcatgttaacattctaagtaaaaatggtattgcattgatgttaactatgcaagaagagaccagaggtataccagccaaaataataaagattggaaatgaagcgtgatcttgtagtgttgataatattccagcatctatgaggaaacaaaataaattaacattagaatgatgcaacatgtagacacgacaaactatggtgttatgaaattttaggcatgcacacgtgaatcagttaattcttccatttcatattataagatgttttgggttttcaatagatcagtgcatggatccatgtatgtgcttcatatatgtgtccaaattcatatgtactttagtgaatctagacgagtgatggagaggccaaaatgtcttataatgtggaatggaggtagtagtaactaaactttatgttactaaatagttagaggagaaggtgctgcacagcagcattaagcattaatctcgtgtaagaaatatatggagaagtgtattttgaactgcgcacctgttgtaggaagtgcaaagtccttgctacatcagctagtatgcactgcatattagaagaaccgagagcaaccattgtctcacaaatacacattgcaaactcgtattcattaacatcaataacgttgggctgcatcttggatctcactaaaaaatcttgtgcaatgttcatcaacaactggaaaatgttgctcattgctgcatcatactccacaatcgcgacatccaaaggccgtttcctgagctaggttgcattggacaagccaataacatatcagaaaaggtgccgacagaatgaaatataggttaagaaaaatgcatcagcctctcagtacctctggcatataattttaaagaattcacaagcatggagacgaaaatcactgtaagaaaacaaggatccacatctgcaaaatggaattgctggtaaaataaaggggaaagaaagccatccaaacatggaagaaaaattcaagcatacagacccatgaattaaaccatatttggcgagatctgtcacaggagcccattcagcatatgcattggcagcattcagcacagcagttattgtcccaacatgttgtttagccaactccatttgctgattcgtgtgcgcgctcaaagcagctacaaagtgtttctcaagtagctacaaaatgagacattacaagatgcttacattagtatgttgtaaaaatgacgagcctccgtttttcgacaaataaaggaaaaacttacagaatataacagcggcaggatttgtggcaacgactcagtaagaccacgtaacaatgccctacgtctatcacctgttgcatgtaattaacaatttaacaggagaaagacaaagtttctatttggagtttgacacttcaagtgaatacagtttcaagtgatcaggacagagaagtaagcaaatagaatttaccttctaaatcctcattgtgaacagtgatatcctctggaagccacctcagaatcatggcaactaactcagcctaacagttatagggaaggaaaataaaatgcaatttaatatatcgactggtagaggtacagaaaaaagctgcaaagctgcaaggagcatacctcaataggaccattgtttgacaacgaaacaatagatgggagtaaagtattccacaaagcaactccctcccttctaactacctacaagataagacggtcactaaaaaagaatgtacctaaagaaacaaatattgtcgcagtacaaaggtttcaacaaaagtatatgagaatagccatgtaagggacctctgctactaatgcagccgtttgactcttcaaagcccactcctcatgaggaccaacaacctcaggtatcaaattaacagtcaaattagcaaattcatttcgttctgcaacactgagttcctcccatctcaatctcaccaagtgctgtaaaagttaccaacagaaccattagttatgaccatactaaaatacaagaagataatagctcctaatagagaaaaatatttttcatacaccgaaatagcagtaaataatgcattatggccacagtcatcacaggatatcaagtttagagctctaagagaattacaatacaagcattgctgaggcaatgactgtgagattgataaaacggttctaaatggaaaactcacgtcgtatgtaagattttttttttaacagtggaaaatcaagttgaccatactagtggtttttctttttatagaaaatactttctgcgatgcactaacaattgtagatgtgtactgctatggaaatgaggcgtcatgtttacgagggtaaataatgactggcccttttcttttgagaatggtcattcatcctaaaaaggtctcagcctggaaggatatcctagtcacgttcaccatgaaaatagatcaactggttcgaggaagggggtcagatggtgtaggtcgaaggaggctgaaattggttaaaagttgagtagtagaagtgagaaaaagcactaacacaccaatggtaaaaatgagctgctgtagatattagtaacaaaagcaagatggagcaatttattagtgataagaagaatcatgttcctacaaggaaaagtgcataccaaatgtacatgatttactagaaacaaggagtttagaccatatggtcaatcatatgttcgattggccatgtgattgattctagtaaggaagtcaaaacagcatgctgatcactagaaaaaaagaacttctggatttcagatcatattcaattgtgtggtgtagcttttggcaattaactggtatgccgatactgtttggcatagcaagctacaacaagcgcacctgcaacattttgaaaccatgcagtcggacctctgaagactggtcctttcggaccaataaaaatgatgtgttcgccaatgcccggacatctcctgtcttaacctgcatttcaaaagtctcattgtcaaacaatggcattacatttgggacaaggaggcaacacaggatttttcttataccagcgaaaatgtgcaaaaacattatccatgaaatgaactaactaatcagagcagtaacggttacacactataactgaaagagtagagattagaatattgagttgaatgcaccagttagttcaccaaagagcttaagctgattagagaagggcgaagaattcacttaatacttctaacaatcgctctcacatagaggttccctcagacctcagatatggaaaagaagtgaactgcaacttttcatttaatttcgtcagccagcattccaagtggagacctcttgcatgcttcagtattctaaaatcatattgagttgaatgcgtcagcaaatggaaaagtgtgggcagttcacttatagaccaatcgtgtgcaaattgacgaagatcaaaactcgtgaaagctcgtgattgttgaatacatatacaatcaacagaaaaaatggccgtgttgcatcaatattcccatcaacccgtaaaaacaaatagtagaacacaaaattaggaaaaagctaaacaacaagcatcctagcgaagcatcaccaaagcgctccccaccctaccattttttttaaaaaaaaaaagagcatccacagcagttgagacgagaaagggagggggtggcggcacacggaccgattcgaggtacgcgaaggcggcggagcgggcgtcgggggaggagcgccagtccatcacggcggagatcgccgccacggcggacgctacggcggggtcggccgccatctccaccagcgaaggggaaggggcggcggcgggtgggcgggagtgctatcggagggagtaagttagggttcggaggcggcgcattggcgtgcggcggagggcgcggtggccggggggagacgggatcgcgctagggtttgggttgggcggcgtcgcgcgcggccggagcggcgttgatgtgggggcttgctggattgcgttggtgtgggtgggtttaagggggaagaaagaggaaagaagaggggagagtgggtgaggactgaggagaagtagggggcaagccaagtaaaaggaagcggaggagaaaaggggtagaaatggtcggtggactggcccgtgaggcggttgtgtttactcctggctctttctgcgttcttatttttaatggggtgtgtgattaataacatgttgaaaagaattggaggctgtttggatggattactcactttaccaaacttctatgctacaagtgtggtatgccatagtttttgtggcaccaaaaaagagagccacacttgtggcaaatttttgttaaatgagtgtatgacatgtgggccatgagagtagaaaagtgtggcatgccaaatctttggcttcaaccaaacatttacaccaaaagtcaaacttgcctaactatagtgtggcaacgtttgggaagcaaccaaacagccccttgatcttttatatgggtgtattttaattttagggaaaatttgaaccatgccacataaattttgcaaaatttgtgatataccaccctgacccacatgtcattaactcatgtgggtcctatatgtcattgagatacgggtggcatatctcaaattttgcaaaattaaggtggcatggttccaacaaaccctttattttattggttttgttttgatcctaagtctaccgcagaaattttaaagatatcccaaagtataaagccagctgagaagttagagaccaaatgaactatagaaggttgttagcaatgcaagctactcatacgaggaacctaagggcactaaataggatgaagcactttgaaatcacgctctccgcaatgcaaagaacctattgtgggatcttatatacttttgcattacagtccctactatctttaaatttacattaatgcaaaagtttacacttggaaccctaaaatctacacaataatataaaatctaatccatccccacctaacctctccaatcatctgatttcctctcctctcaactcccgccggcaccggcatcgacgtcagcaccatctcagtgcggagaatcttagaagggtggtgggccggcagtcgaggagctccctcggctgcgcggcgacgagctcgcgacgagctccctagcggcactggacagattggaccgtcgcctctctgttagccccttgaccccttctacactcttcacaccgtagacgacaccactgccgccaaccacaaccacacctccctccccaacactgggcggaggggaaatcgacacctatggccaccaccatccctctctttcccccactccagccaccacgcctaagtgtctttccatcgcagcgcagatcgctcggaggaagccgagctcgatggggcaccggcgtgaccgcctcgaggtcagcggcatggaggaggagacggcgacaatgatagcagcgtaggagcggggcacgagatcggtggggctgcctcgaggtgagcggcacagaatgggaaacgacggcaagctctgcagcacaaagtgggagatggtgacgaggtcagcggcaagctcggcaggcaaatctagcgatgggacaagctcaagctgctctccttctccggacgttggctccggcaacatagatcgggcgcgccgggtggcgacgcagtagatcagccccgtcatcggctcctccacttcctctagtgggtggcgagggcatcccctccctttttttggttgaggcagtgaggtcataggggcggcaggatagcggcgcgcaggttgcttgcggcattggttcttgcacatgctccacttttgcctatcaccagttatttttgcaggtgaggaactcgactcttcctttggacctgagaaaacctcacaaagcaatgcccccctcaccccacgttctctctcttccaccacatcatctatcctacgtggcacaacgaatctacgtgacatggtggctcactgtgaagggcctaagaaacaacaatagtagtagaggaggtttttttttcggggcaattggttatttgaccccgttttgaaccctaactatcaatttgaccctactttttgaagtttgcttatttgaccctccttttcaaaaacgaagctatggtatgaccatattttgttaagggcatctaacggggttaactgaagcacaaaatatctcttctgcccttactcatttgaccttattgcatgtgagacccacacgtaagttctcttctcctctcctcctctcctctcttctctcttctccacggatccaccacagggagagtcggccaaaggcgagacggcgagccgacaccagccctggtgatgacgacgacgacgacgacgacgagtggccgcggcgagttcttgtcctctcctccacgtatccaccacagggagaggtggcgaaaggcgagacggcgctggccctggtgacgacgacgacgaggagtggcggcggtgagtctgggcggtggagctcgagctgcggtcagcggattcggtgccgccaccgccgcctcctccctttttccgcacgcctgcgctggcgccgcctccctcatcctgcgccggtgccgcctcagccgccgttgcccctcagccgtcgtggatcttctccctccacacccctcagccgccgccgccgctgcttccctcatcccgcgccggcgccgcctcagccgacaccgctccctccctccgcgcccctcagtcgtcgccgccgccactccctccctccgccccctcagtcgccgccgccgccccctcagcgccgccgccacaagtcgagtgagcaggaaggaggaaggagagagagaaatgtggatagggttgggtggatggatagggttttctaagggtattctgggtattatgaatattagttgcatttctttttttatttaaatcaaaacttaacggactagtagaaacagggtcagacgggagcttcatttttgaaaaggagggtcaagtaagcaaactctaaaaagtagggtcaaattggtagttagagttcaaaacgtggtcaaataagcaattgtccctttttttttctttcactccttttatatatttttatgttaggtagcttggtcactttggaagtccttccgtgtaggtaaggtatctaaccatcactaagtatcaatgccaattcctcccccctctccatacacattatcgtctatttactttccaacactaatattgcttatttccgatatgtacaatattagtattattgggttggcttttgcctttaactatgaatgaacggagtgtgcttgtttttctcttcctcgcaatgttaagatgttcatggcaagatagtaggtcagacacgcaatgcatttatttatattgagatcatgtgaattacgataaattaatggcatgtctgcatacatataagatgtacatatagattaaatagtaagcaaacaatgtttgtaacatatataatattaatccatcacatcagaaatattatgagaaactgagaacacatacaacatcaaagcatggaacacaaacacttggcggctcgaaagctagaagctgtggccagtgccaaagcttgtgcattaccgctaggagctgaatgcaagcaacgacctcattctcatggtggtcccattctcacaatgatagagttgatcaagaattgaagaacacattgttgtaagtttcaaatttaacgtgagttttatcgtgccctcatgtattttggcttcgctaaattattaccactttcaaacaaatgctacacgctagaataccctttgctatatgaatggactgaaatgcccctcatcctttctttctctttcaactctggtggcctcaccacaccagtttagaccatcgtcatggcgtgctgcggagagagatacagatgggtacatcatgcctagacagcccatcactggcaccccatcgtcgtgtcacccagctatacaagccggctcttctatcttccttgttcctcctgcatcagcgtgactgtgaaggctgccgcaacctgtgggatgccaaagagagaggatagggaggtcgcgggatgacgacggatgtacgacggttgtggctttaattaggcggcacgattgaggtttgacgggggggaagggaagcaatagtgggttgagctggtggtagtggagcgcatactggcgctggcgagttgggatgatggccatggtgtttggtggccaccggcaagcaccttcggcgtgctgagggagggagaaaaggaactcaagggcatttttcatctataatagtatctagcatatagatatcatttgaaagtggcaatttggtgaagccaaaatgcaggatggcattatggtgaaacccgtgtttgaagatggcacaacaacattttttttcctttaggttaggaggtatgccctggcgagatgggtcagctgacccaccctattgaatggggccctcgcattgaagcatacatgtattttgttgttataggttgtactaatagagaaaaaagtgtttggttctcaagtttgtttaataataaaagaggatgcatcgttggggaaaaaataataccaaaattctagtgaagcataggcattctgtctcctgttaaaagttttcgcattgaagcatacatgtattttgttgttataggttgtactaatagagaaaaaagtgtttggttctcaagtttgtttaataataaaagaggatgcatcgttggggaaaaaaagtagtaccaaaatttctagggaagcataggcattctatttcctgttaaaagttttgtacaattgcttataagcttttgtttaatgttggcagcgccaatttttttttaaaaaaacatgtgaatatattgttttgatatgtaggcaaattctcagtgtagttggtttgaacagcaaaccaaacagcccataggtcctttagattagcaccatcaaccgttcaacattattacacctatttttcatagaacacagaaaaaggtacccacctaggagtcaaatgctcatgtgtcaaacaaacaattaagatgctaaagtaatggatagaagccacgaaattcatagaaaccaatttacctttctttataaaccctgacctttggcctggccgtcggattggcagctgggcacccggattcggacgcgtggctctcttgcatccatccatcccccacttgagcgcaaaagaggtctctcgatgcgccgcgccgcgaacacgacaactcgacggttcttcttccaggcttccaccgtcctcttcgaccccgccgccgtccgccgccgccgccgcgcctagtgccgctcccacttcgactcttctcctccatcgaattcctcagagactccccacctccggtcgcgccggatcgaggaacatggacgaggagcggacggcggcgtggtggggccggcgggcgtgggagctcctctcggcggtgcgggcgcgggcgccgcttgtgcactgcgtcaccaacctcgtctccatggacatcgccgccaacgcgcttctcgccgcgggggcgtcgccggccatggtccactccctccgcgaggtcccggagttcaccccgcgctgcgacgccgtgtgcgtcaacgtcggcacgctgtccgagggctggctcccctccatgcgcgccgccgcctccgcgggccgcccctgggtgctcgaccccgtcgccgccgccgcctccgagttccggatggaggcctgcctctccctcctcgccctccgccccgccgtcgtcagggggaacgcgtcggagatccttgccctcgcctctcgctcgctcgccgcctcctcctcctcctccaccaccaccttcaaggtaccatttctagctttgctcgcttattattgcaaccattttgtcttcgctttaatttacccatccgaacaagttatagaaaaaaaaatcttgattgatacgattgagatggattggtttgattgtgaactgcctcgtgctctctactggaaagaaaaagagtgccgcgattaacaattttctgaacttgattgtgatttattttttagaaaatggattaaaaatggattgtgatgaggaaaataaatcctctcttctgtcctcacaatctgaatcccaatcgatgcacctgtttttgttactcgagagttcagaccgttccatgactgattattatccaaaatgtcagattgatggctaatgtcagattgatctttcagttctgtcaagaatcaaaactgactgactaaccaaaacaatttactagtacattgatactagtatataatgtacaatgttccaatcaattcccatcgattttgcagggcgcggacagtacacatgattcaggggacgctcttcaagatgcaaaagcactggcacggtccaccggtgccgtcatcgcggtgtccggggccgtcgattacgtcaccgacggcgagcgggtggtcggagtgagcaacggcgtggccatgatgcagaagataacggcgacgggctgcgccgcgacggccctcatcgcggccttcctcgcggtggtggaggagccttccgacgccatggccgcggcggcgtgcgcccttgctgtctttggcctggccggggagatcgggatggagtctggcgccaagggacccgcctctctcaggatgcatctcatcgatgctctctactgcctcgacgtgcagacggtgacctctcgagtcaagatctccctgcattcgtgataatgttcgctccatggcctgccgaatttcaggccaagttcagagtttggaataacggtgaaggtttgacataacactagaaatatgagcgcggcgccacgcctcgcacgctaacacctacgtggttagaactacacgtaattaaggttaatttgaccacatggagtggcatattatgtgcatattaatttgatttaacatcagattattatatggggccccttttttaagaactgtgttacattttttttccatctaagagtagatgaaaaatggtacagtttgagaaagtaggcggtaacatgcgaggacagcagagattggttcgaaaagtagaatttagtcgtaaatgggtttagcaatgataaccaataggtttactatgcagatcatgtaccaaatgaaattacagcgagttgttaatacttgtataagggtttgcgcatttatccattatatggtaattgatatggacaagcacacaatacatatatacaggaacgggtaaggaacaaacaattaattcagtgtacaaataaacatccaatctaatcaggaactcacgcgaaaaaaaataaccctaacaggtcaaagcaaacagaaagtacggaagatataacaactcagaaatcaacacacactacgaactgaaaacccatacatacatagcaacctctttttgttaaaaaacaagagcagcagcatggtgataaaaatcagaaaatcccaataaaaatggcaaccactacccgaggggaagcaggtttggtgtattcacaataaaaatgggcaacaagtttggtgtattcacagtattaacgaaagttttaggaaactaccagctgggcaagttaaacatgagcctaataaaaaggaggtccatggagtaacttttttttccaaccaattcccattccctagacatacacgaattaggaccatgtctcttacattcgtaaatgtagtaccagaattgctcatagagaaagaaattacaaacccaaaaatttgggaataaagatgatataacataaaagagttgtattgagttagcaaatatagagtcatgaacgaccggcccaacatcatcaagttcgagaattagtataaaacccaaagaacacaattgcttgcacttacaaaaagcagagccattcaattctctactataccagcaactccaaagtcgcaactaaattagtttgatatgggaataactcacaaaaaaaatacataaacaacaaatataatctctataagcatcaagttagacatgtaaatagatacatatatacaatggtaacgtctggaaccactacaaagagcactgtcagtagctttgaactggtgatggtcccatggcatccaaacaatggcagaaattgaggggacagaaaggccataaagtctagaatctttttcttctttcatgagtctccccttaaaggttaaggacacaaatacacaccattctcaatcctctttctgtggtgataaacaatacaagaatacaaattcatttagttcaaatacaggtttaggagttgggcatgataaacacataatatatagcagaccacggttccaaacatttgtttattccgactaaaataaagccttacacaacaatttaaaattaggtatgtcagttccttgttttggttaatatcgcatggccatcacactatcacaaacagtttgaattcaggagttcttgcagtgttcagcaaacagggtgcagtaatacactgtaacagttagttctcaatgtcaggaatgcccatggcaactgggctgctaaagcatcatcactatttcactaccatgacaaataatgaagaacatgattaattaaggagctcatgcagcataaaaacattgtacactaccctttcttcagctgatcctgacatttttacccaacgaactaagcaagtaagcaagcaaaaaaaagtccttttagaaaaaccaaatcaactgctcttgcaagcaatcatgcatctatttctaaccttcacaaagatgcgcatccatgtcctgaccgggaactctgtccctctaagagtctcaaagaatgaggatgtctcaagatttgccttcttgatcttggtcaacgccaagggcacctccagcacaggcaccttcctcgtcttggtcacctccttgagaaccttcacgctagcctacttgaacatacttgaagagagctagaaaaacaaacaaagaattatctttagcactaactgatgaggtaagacattgtggagtagatagcaaatccaaaaaagtgcacttggtacttaaagaagtttgaaatgtcagtaactggtgaaaactaattcttggtaaagcatcactaaagaatggatatgccatcttatttatagggtaaaaaaaggtaaatgagggattcatcaaagcgatgcaattggtagcaccaccatttcaactacttacactaacctattcttatcttttcagagaaaaggacaccccttctcttcttatcctctctgccatgtcgttcttgttccagtgacttagaacattggaagataaaactgtaggatcagtgaagagtgaaaaatgttagagcatcttacatgtcacctccttcacagtaacttctcagagacaaatacacagtgcacgcacaggtaccctgcaagctgcaagcatcgtaaaaaaaataataaaaaaaacccttcgtttcaaaaaaaaaatcaaattggagtacaaaactgaactaaagtgcgtggtttgtatcctcagcaaccaaatcatccttgtcctcgatgatgcacgggttgttgggactcaccatcaaagacatctgctgatttgcgcaagcaagcaaagcatcgaaattcaccatgttgaggttggttgtggcaaaaggcgcaaaatcgcaccaactcctattgtcccaagcacgacgccattgcaaaacttcgtgccgtcgtacaccagcgctggtagatccagccacgacggcctgcatccggcgttccccggtagtagatcgacgcgcgcaggtcgtagggggaccaagaaggtggtccactggctggcggcggccattaccttcacggctccacctgcagtggccaaaccgacctgctgatagtcgacaagcagaggaaggagacgtgcaatccggcgtcaacgacaacacttgggctgagcatacctgggcacaaagggccaaatcagatgctctccgacgaaggctcagtgtcgcggcatcatcgactcatccgaggagcggcgcggcatggcaccgacagccagctcaggaggaggggctgcggccggtaacgctgctcggaggagaggggctgcggccggtaacgctactcggaggagagggacacgggtggagaaagggaagcggaagggggtagcagggcacggtggcggtggcgatcgaagagggcctccaccggagccgtcagcacaggaggaggaggcacggaggcagcagatgggaggggttgcgtgttggacactccctcgcgccatggtccgccactccgagctggcctcgtcggcaacggcagttcccgcaccacgccaccactccaccaagaaaggagaggtgggaggggaggggaggagaggaa

SEQ ID NO: 8326 - DNA, 15010 bp, Oryza sativa
  unsure (1)..(15010): unsure at all n locations
nnnnnnnnnnnnnnnnnnnnnnnnnnnnnnnncctccccttcgccctcctcccctccttatccaatatagggggtcgggaacgggggaggtcgcaccacagcgacgacggcggaggtgccgaatccagccgcggacgtagccgcctcgccagatccggaggggagggccgccgacgccaccgccctcacccctcccagcggacccaccgccgcggcgtccacccttcgcgccgcctccgccttctacctccgcctccatcggatctgggaggagggagggaagcccgccgctggctccaccctccgcgcagccaccgccttgagccacctctgccaccgccggtagccgccgccgccctccggcggcagctccggccggaacccgcgtcgagagaggaaaggtgggaggggaggggaggggaggagaggagagggaagggagagaatggggagagggtttcggaattggggggttagtgtaggacgttttgcagaaaaccccctatagtttttatatttacatatctacccctaaaagcggaattttctcttcttcgcattgtattttcctgaaagacgagcggttatatgaaagaaatacaacgggatgtcaggcggtccgaggacgtatgcgatattccgtgaaaacacgaggagttttttacaaaagttcccagccctctcaccgggagcagcccctccaccctaaccgccacgcatgcacaccaccacagcgcccaaattttgattaaccggcgcaccgcttatgggcggttggccccgcgcacgcgagtagcaggagggattagcagcgaggtgtaaaactataagatagcccaaaaaaaattcaagaaaataagaaaaatggtggagttagggaagttattgattgatgatttatcaaaaatcagattgatcgttacttgtccatgtatactgtataattataccggtgatctttctggactgtactgagtattcggttgtgatgccaaaacagaaaaatgctgaacaaaatagattgcataaagtattttcggcaagttgaaagaaagacaattgtgtatgggtggtagggatggcaatcgggcgtgacgggcacgggtagtgcctatccatacccatgcccgtgagattatttgtgcccgtgggtatacccattactacatgacgggtaaggatggttgcccatgcccattgcccgcgggcgccttatgcccgcgggcgtgcccgtttacccgccacaacaaaagcagtggaacaaaaagtctacaagctactaacttcgaatcgaacttaaaacatcaaatattctccgcctcggtgtcgtgtctctcctctgtcggcgatagagtaagaggagagaaataataagggaaataaaagggaaaccgtagaaaacaaagaacgtggcttatgtattctagtggattttactcctagcctacatgtaagttagatttcgcgggtaaacgggcaaagcgggcatgggtagtgattacccatacccatgcccatttacccatcgggcatagcttttgaaccaataagatacccatgggtataaaatggagaacaaacccaaccctaataggatttttacccgcgggtaaacgggcaaacgggcaaacgggcataattgccatccctaatgggtggtgtatgtatcgctgctgatgtttcttgaccgagttaaagatgaccgaatcactgcatgttccaatgttttgttggacaggatcacgttacttatcgtgttgccggttggtaaattgaaaaaggtgctgtgaataatagacacagggtatctaaataaccttttggattcatagacacaaaagttgagatggccgagttggtctaaggcgccagattaaggttctggtccgaaagggcgtgggttcaaatcccactctcaacacatgattctttttttttaactttcctcaagccttcaattcctgcagggtagttttaagcctacacctccttcataatcatctcaaattcaccccaagctaaattaagcctcaattcaaattcaccttacaacattgtaaattttgtattattttcttttaatccatcagttcttttttatactcatctcaaattcaccttacagctaataaatgaagcctcaattactacttcagtgaacatgtcaacgattaaattaagacggcaagcaggcatcatctcacggtgatcactgacagaggtaaacgaccactgttgcctctaattgactaataatcgcaatataatcatcaaatcagttaatcacacatgacatccatatcgaagacccatgcaaagcaaaatagagtatggctagtagtaggaggaggccttgtggatggtgaggatggtgagcatgaggaggacgaggtcggcgaaggcggcgatgagggcgacgacgacggcggccatggcgcgctcgcagaagggcccgtacacgtcgcacaccttggcccacctcacgtgcgcgttgccgcgctcgccgaggaggccgaactgcgccgccgcccccaccgccgagaagagcagcgccatcgccaccaggtcccccaccatcaccggcaccaccgcgctccgcctccgcaccgccgccagcgccgccgcgctgaacgcgaacaccatcgcgttcgccaccacgaagtacctgcatgcgtgaattcggagaaatttgttcatgttttcggccaaattttcgaagaatcttgcacgcttcgcaagtcgagctctcggatacagttcgtccgctacaggccggggttggaatcctgaattctgaaatcgacggccattagcgagtgcgtgccctctcgaatgttcagtgcattcgtcgcatgaagccatcgtcgcatgaagccatcgtatacggccccaccgtgtattcgtgaaataagccaaacagagcatatttgtaaacaaaaaataatctgtgaataaaacttatatatatatatatatttagtgatataaaagtattgacttaaaaaataaacttcaataaaaaaactaaaaatcaactcaatttaaaatttaattgataagtatgagtataaacgaaaagatgtggccgatagataaccgtcacagtcacgctttatcgtttattcaacatcgttcttggcgtgacgctttcgatgcaaaatcgagacaccgctcgctcgtgcatgcacgtttgatctctagctgcacaagtaaaagactttctcgaagaaacaggggatcaaagggagtagtacaattaggtagctttgcaaactatgggaaattataaacgggtggtttatattcgctttgttaatttttggtttcccaaatcaagcagcaaacactgctcctaccatccgaattaacgtaggctacatttgcacgcaactcaactggcatggcttgcatgattgatggaagatcaattaagatgaggatcaatggacggacaccgtcgatcggtctcctgttctccagtccaggctccatcaaatttatggataagatgcatctttcagtaattgcgattgttcgatggctacgaccactactactacccatttgcaatggctgggattaaactgtactaaaggatatatattatatatattccgatatagtagagcattttcttttccttggatggatgaataaacggtgttacggtggtgatcttgataacgaagaaagcatcatatccattttaccttctccaaatctctatccgtatcgatttctctcgcctttctgtaaaggccaaatcaacggtcgttaatttgggcctctcctcatccaaatcaacggtcgtgaaggaaagaaattttctgtggctgctgctgctatcaacaaacaatgtcacccacagtgccacatgaccaactcccataattttgcatagattggcaataagccatggttgtgtatcactttcaaaaatagtaggaacactaacaccaaaaaatatttgcgaaatctctttgtctatccatggatgaacacgtcaatgaaaaatagggtttcaaggttcgccacgatgctagaacgtgatttgtatgtgtaaggtaaaggtggcaacaggagttgaagtggatggtactagtggtaggctgctggtggcaatgcttgggttgtccttgtctaattctgtcctgggttttctttagctaatcagtgtgtccactactatcaaatactaccacgggtggataaaccttcttctgtcccggtttgcaatcctctatagtcccgggttataaactgggaccctgaattcgggactaaatatggttatctttagttttgagcgaaataattaggaaaaatgtggttttcggccgacccagtaaagatcaattcttcagtagtatactacaagaaccgtaatttacataaataatttaattatttcaaggaaacaactttgaaaccacacagatatatatcaatcattaattaattaaacaagccatgcatgcatgcattctactatatatatattattccgatgctgaaaaatttcaccatcagattactaatgaaaccgacaggagtactaccaagcataaaaaagaaagtagagcatcctgaaaatccctaattatatagtagtatctgttgtggcatccttgtctgttgtagcatatcataaaagttctttccattaattaggtaggagaaagagagaaacagaaggcgccttgtttggacgtgtggaattaaagcagaggccagcggcagagaatggaaggtagtagtaggagtactagcaattaggacatgcatgcaaagacatttcttcttgcgtgtcatcgtctttctcctcaaaaaaaccattccgtttcttccttccttcctcggaatcgatcccggaaagatctaccgtacaggcacataatgacgctaacacttcactagaggctaagagcatgtacgagaaaataaacctataaacaaatattgaaaaaataaaagagaaaaaaaaagagtagcgagttataaatttataattagctgtagcacggactgtaaaacgcaatatgtatatgacaagtgagactagtgtagtatatatttataggtaactattgtataaattgacgagtaagtagttggctatactattaaacttgctctaatattaaacttgctctaataataaagatgcatgtgtgcttaatttgattgtgttctatgctggagaatgagacttaaattattcaagaaagagcttgttttgttttcgaattgtgagggagaagtagatcgggatttggaaattggaatacaggtcatgtgtaattggcaagacatgcatgtgcctgtttggacccattttttttcaaacctacatgacatatgtgtactccttgtatactttgtcctatgtaatgagtgtgtcactggggctagctactgttgcatcaccaaagtagagtaatcacacacgagagaaagaacagacagaacaaaagagaacaaaaacacaagaaggatgtagtagagagaagagagaaatgatcatgctagctgcaactgatatggtgaattaaggagtggctgcagttgattaaagagcggcagtgtactggaataattgagaaactaattttgtaggcgcatcatatatcagtgttcatgcacatgcttggatggaaatcaatggagcagtagagagagacttacacgaaggcggaggagtaggtccacttggccgtgacgggcacccgcagcggcggcgcgagctcctccccggcggcgatctggacggtggtgctctgccggtcggcggccatcaccacagcggacgccagcgtccccagcaggacgaacacccgcagaaccacgcagcacgggtccaccggcggcgccctggaaccagcggccaacggcggcagcgccgcgccggcgcccgtgtagtagccccggcggctgctgtagtcgaaggcggcggcgccgccgccgctgccgttcaggccgggcttcccccgcgacgactccattgctggcgcgcggtgcggtcagcggttgccgcgctccgctgtgcgggaggcgctcttctccttggaatcgtgggtaggcgagaggagcagagcgcgtgtgtaactactggctggctacgtactactgctacctgtgtgagagatgtagggtacggtattgtggtgtagatgtacacaagattttgttgttgggtggggtatttatggtacagagaggtggtatcacctccaaggtatggttaccctcacatgtgagtactatcataccgatgctcttctagcgagtataataagcgatagaaatggattttcatctcttgaggagatgtctcctcgttgtttgtatgtcatcgaaatagttataaaaaattaaaaatttaacaacatagattaatatgaaatatatcactccacaaatatgtaagaccaaatttaacttttgcgagttgcaacaaaaagaacaaaataaactgaaaataaactgaaaatagttatcgtacattcgcagatatatttgttatttttattataacttgtagaagtaaaattttaacttgcatatttgtggagtgatatattttatattaatatatcttaccattttgtttcaaatttttttatgactatttaggtggcatgtacgaaatgagggatttctcctcgagggatgaaatcactttcccataagtgaagtaattagcgaactttaaaaactatatccatcagatctatgtttagatacaggatagaggagggggaaaaagaaaagcaaactacagatttatagccaactgcaacatgggttccaagacatcatgcgtgtatgagagttgtgccaggtattaatcgtatagtatatatttatatgcaaactacttagtccataagattggttattggttaaatcttagagctattaattgactatactatttaacttgctctttcttacctttgatgactcctgcgatcaaagatggtgtgggatcttgcggctggccaggcttgacgagggcgctcatgcggcggcggcgaccagggctggatgaggacgtttgtgcggaggacgtgagagacggcggcagccgagcaggatgaggacaggactccgatggtcgcaattgtcgatgaacactagtgagggtggcatccatggcggatgcaggaggcagccgagtttcttttccatctatgcccccacaaccttaggatgcgccatacaaccaggcgataaattagtcgttggcttgttccatgtcattacaaaatcctataggaagttggtatcatccattatatatgtgctctaagacgctaacaccattgggtttggtttgaactgaaaggtatgaggtctcaaatcaaacatgttcatgctctggccaagcctaacccaacccattgttatccctgatgactactataatttagataacaaatcaccaacaaattaaattgtaatggtgtttagcattacatttgtttatatttggagaaaaaatacattttttttagcaaagcactaaagtgaattactcaaactaacacaaactagattctgattggagtgttaagtatgcatgtgatgtgttgatttaatgagttcgggtgtcatgcctaataagcgtgcacatggtgtggagaatgaatgcaattaccttcatgcataatttgcgtgcagcatgattgggatatcttcattattattaaaaaaatccacaaatgaatcataatttgctggcattatatattttaattacttctattaattatgctgtcattgtgaactaaattctacaaaagatgtagagattaaatcgatgttacataaagcaagcaaacatgcgtccatggaggttctagagcctagatgcaccaacatgaaataaatctaaacctgtcttttcgtgatccttccgatatatacactcctttgtcccccagttccatgccttgccggcctcctcacacttgattgtgtgcccccgcttttaaaaaaactcgtacaaatatagtgcgactcctctttgtctgtccatgacgctgaaccttctactgatatgacggtgtggctgattggattgaatccgttctgctcccgcaccaccccctcctctgtttcggccattttctagtgccacttggtaaggaacttgtatcatatattcatatgattggagtatatgaggttgattgtctagtttgacgcatcttctgttagaattgattatattttagaacggggaaaatgatgataaatcctctctcccaccacttagacgatttgatggcatgttaattggaagtacttcataaatatttattattatttttgataatggaataaaatgtatacttattatgcttgattattaatttattatagcgagaaaaataatagagattagtatatttatgaattatatatatgctttcattaaaataaacccggtgatcataaagattgttgtaagatcttatacaacatgctttgcttaacacaccctcctcttttattcaattctaacaagtactccatccgtcctaaaatataacaatttttagcactcaggatttgtcctaaaatataacgatttctccaccaacattcccttcccaaccaatcacaactctccaccattcacttttcccacctacctccacttctcaaccaatcacaacctctttctattcaattatacctactttcttaataaccgtatccaactctaaaccttcttatattataggacagagatagtatgtaattaacataaaagcatctctaaggaagtggctatttttgactctccaaatgtcctatttggcaacttaccaaaaatttagagagccaagtacgttttactccaacaacatgtccattacactctccaatttaatagtgggtcccatatgtcagtctctgtgttgttcttcacccacctctctcctcctctcttctctgcagtgcggcacggctatggaggtggcgccggcaggagtagcgcgagcgacggaggacgacgggagctacacaggtggcggaggacaatgggagcggcacaggcagcgaaggccggtgggagcgatgactatggcgacgtcgaatccatgcgcgcgaggcgacgacaatggcagatccgttccttgctagcctcgtcttcctcgacagccatccgccatatagcctccctccttcccttgctactccctcgccgtcgcgccctccctccctcaccgttgcgccgccgcctccgctccgctcgttgcactggtcggccggcggttgacccgcggcggtggataacgacgaggcagcggacggcggaggatgcgagtgagcagcgatggaggcgcttgacccggcgacgatggcgagcacgggcagaggatgcaagcgagcgacggtggataacgacaaggcagtggacggcggcggcctccgcagcggtcgacggcgtggcggacaaggggcagcgctgacgtggtcaatctaggaggagggggatgttgctcccggagggagagagaatatgagacgggaggaaagagggagaggggaaaaggcgtggggcccacgattggctaggcaattttagctggctaaagttggccagtgcgaggaggagtttggccagctggatagccatgctagtctgctggagtgtgtttttatccgaaattactaagttttaatttagaggagatagagaggcggttggagatgctccgctcttctcctccacctcctgatctccattctccagtgcctccgtcgcacatcgtctcacatctctgcccttgtgtttgatcgcgccgtcggtgtgccacgtgggaatcgaagaaggataacaccatcgatcggcgggcgtccagtgtcgtgccaaacggctgacgtgtgtagcattatcttaacatacttattaatttcagggtgcgacgatgaagtacgggacgtacgacggccgcgcggcgccgaacacggacacacgcgtacgtacgtgcgtacaacgtgcaacaaccacgcgatcaaacacgtacgcacgcggcggcgcgataggaagctcctcgtataacatcagatcgagccatccagcgcgggggtgaccaactatcaccgcccgcaaaacggcgggtcggcatcggcatgggcagcatccggtgaggcccgtgcacattacgaaaatataccgttaggaattacttcatccgttttagaactttttagtattgtctatatttatattgttaataaatctaaacacacaagaactttttagtattgtccatatttgtattgttaataaatctaaacacacatatatatgtttaaattcattaacatatatatgaatatgggcaatgctagaaagtcttataatatgaaacgaaaaaagtatatatgtgcagtaaaaatctaaaaactattgttgtattaaaaaaatgaacgtctgatattcgtccatattatcatgagtaaaatttttactcgtaaatttacttatgataaaaattttactcatggtgacatgaacgagtctctgacgtctatttttcgatttaagggtagttttcaggttttcaatatatatatggtttgccccacatattttcatgtgcacataagcacaaggaaaaagtacgaatgaccttgtgcatgtaaacctaaaaatatcgtggtcgatcgaattaaccccccaaactcgaaaaaaccaaacattttaattctcaactcttcaatctggatgaattacaccctccagcactattttgaatggtttttggctaggctgcctgatgtggcattttgaacgtggaaaaaaatatttctaaaataatgggtccacctatcagtgctccatatctcatgtgttcttctcttctacctccccatctatccctagcgtgggcatcgacgccaccgacaagccctctcgccacctctgccaccagcctctccatcgccggtgccggcagccacattagcacctcgacgccctccttggagcagcacacaccaaggacatttaggtacgtcttcttccgcttcctccctccgccgccgtcgcctttgtccccacacctctttgacttgggcagcgacagtcttgccttgagcccttccgcctcatcctttctagccatcgccgattcaagagaaccaaatggggatcaagaagaggtgatctggatttgctgcaaggaggatgaggacgtggcggtgtcgtcgacgatagcgacgatggcaccaaaagatttgtgattttgtaatcgacgggcagctaatccggcaaggttgtgtttgtcaatgaggatctcgagctctctcagggtggcggcagaggctcgagacgtgcatctagtggtgatgggcggacgcggagctaggggtgcgattggtggtgatgggtggacacagagctcgaggtgctggtggtggatctggctgcaacagagggagaaggggcagatcccgttgtcggcgccatgagactccagcttaacggtagccgctgtcgctgtcggtcatcagcttagcttgtatggttgcctccacactgccgaccccgacgactaggatgacagagtgttcgccgcctccaccatgtcagcaagaaaagcagataaggggaggggaaaaattgcagcattgacaactgggctccactgatttgttttttgtttttgctggctaggctgccatgtgtattgtctgcattccatcaattttggtctgaaatttatttaaagattcaaatttcagttgtcaaatttgtgatcaaataattctaccatctttgtttattttgcaaataagtgtttttttttgcattgagaattttgttgtcccaaataggctagcatataagtatgagataagggcaacataggctcagtttgaaagttcgtttagcttttgcaattctatcatttgtcgtgatctcattttctaaattgttaaacggtgtgtgtttgcaaaacctttttacatacaagtttatttaaaacaatactcatttttcaattttatatttgttaatatttaattaatcattcactaataacctcctgtcttgtttcgtgtggaacatatcagtttaccccaaatataggttggaacgcagccataatcattttgaaggaaaattacacttcaatatattagtacaagtcaactcacgatcaaaactatttggacgaggcaaaatttatgtgtatagcaaggtttgagggaaaatttatgggctaatgttctaaaaaaagaactaagccgaagttgcctaacacgtttgaaaacgatactagtggtgatatccgtaccactaaaatatctctaactagcgcttgtctaaatttagagttaaaatatctttatattttatatttcaagatgaatgtagcattattctagtactccatacaacataacctctccatcccataaaaaaaattaaatttaaaaatatactgttcatccaagttttttttaaaataccacccgcgacgtcacgcccacgtcattttcgtgcaatggttgtacgaaatcgacggtatatttttggaaaaattgtgcatcccaaatatcctagaaattttttcaatgaacagtatttttaaaaatttaattccaaatatgacacatcctaataatataataatatgagacgattacaagtcacaaatcgtattattattattatatttttttaatggaaggagcgatgcacaatctaaacacatcgcaagtcaaacagaaaaaaaaggataaatgaattaccatgaacggttgtttggaaaaaaaaagcagcccaaatgcgacctgggcctcatacttcatcgatcccctcccgacttccctcgacaagaaaattgtgattttgctatcgcaaaagaatgatttcgctggaatactattctttcaaagtgattaaatgctattttgggtcttttggttagaaatgattttgctctattttaatttttgttttgaccaaaatacccttgtctcttttacctgtttgaccagatcgaatcgatctcatccagcctcttcggctcgaggagggaagcctcgccgccgtcgcccatggtggcctacgcgcggcgccgccggcgccacacctggctataggcgggctgaagagggatgcgctctgccggctagacgccacggccgagcacaagcaggacgagagtggcctgccgtgccgctgcagcaggggcggacggcaacgtcggcgaagatcgagggcacccgccgccgcatgagcgactctcttccacgccctgccgagaagcctcgccgccgtcggagcccacgtctattgctcccatggtggtgctgtgcctgcgtgcggcggcggcgtcgccgctgcaaacatcacgccggcgcccccgcatcggctccggctctggtgccggcgcctgcctccgccgctcccccacctggtcccgatgccgacgtccatgctggagtaaggcgccaatcgcgtgctccgtggaggtggccggcggtggcgtagacgctggcttgttggagcgagcaccgcatcgggatagtaggggaggaaaaggggaaagagagaggagggagtatgacaggtgggaccacgtcgagggtattttggttagacaaaaattaaaatagagcaaaatcgtttctaataaccaaaaaacgtatttcagtgaataccccttagtttaggatagcattttaatgaatcactttgaagatagtattccagcaaaaccattcttttgcgatagcaaaatcacaattttctctccctcgacggcgccgcttcccaacgtccaatggcgagcagccggctctcgatccggcgggtgtagtctccgcggcgtcggcgacggcagcgggaagcttcagcttcggccagatcgacggcaccctcgccgccggtctccgatgggaccaggtatgcccgcctctactcctaggtctgtccgtgcgccgcgcttcggtgccgatcgatcccagtaactcgttttatcccacatcgccgattctgatcaagcgcgacctctttataaggtcagttcgactctacttcatcgcctcaccaggggcacccgccccgactgaatacagcgaaaattatcgcccctgtgtgcatcggctgggcatgtttgtttatatacccccttccggttaatagctgtaaaaagaagaaaaaaaaggagcagtgaaaagattcaatacggcaacgataaggttgtgtcagtcggtcctctggttggaggcagcgctagacactagcgccttagcttttttaaaatttggattttttttttctgttgcatccttttttagtctgtcttaagccaagagaagcttaaataaagtcttaaaacattaagatggagtaggagaggaattgcatacagctgtttcgatatgcccttactgctagcagtttcgccttaagatgcaaaacttctatacattgctgttttgatatgcccttactactagcagtttcgccttaagacgcaaaacttctaaccgactgaatttccatgtttcgactggatgccggtcagagatgacttggcagatgaataattttggattcgtactctgcagatacgatggttagcatagtattagtagtgccttgtcatttattcactgaattttggcttatatgcagttctatttttaatagtaaatttctctgtaaaatttgcatttatatctgaattaatttacgctgcaggactatggcagtaaagatttggctggaacatccaatattttcagccaattgtctgaagatgtgattaccaaggatgcaaataactagcaacaagagcaggtatgtgcagagttgcagacaaccgctgagactcaaccgaattcatccaggcatagaaacggaaaaatagaccatagcagcaatagttctgatcaggtagatgaagaatccaacattttgaagagtcttttatgttgctcagggattcatgtaagtaataatttctgatcc

SEQ ID NO: 8327 - DNA, 1288 bp, Oryza sativa
  unsure (1)..(1288): unsure at all n locations
tttttttttgctctataccgctcatatattcagcactttatttctttttctatttttaactcaaaatgttggtaggcacatatatatttttctactagtttttgaagggttgtttcatatctttcaacaacattgcagctcaggtcatctcatagttgtaatatccatattcgtttgatagactaatttgcagtcttatttgcatgggcccaaatgatctgttcattttttgtaatgtagatgtcaatgaatgtgagcaaaatcaaagcccatgcccaaaaggtgcaacttgtcgcaatacagaaggatggtaccattgttcttgccctgtgggaagaaagttggcaaaggaaacaaacacttgcaacccagacatcagcctgatcataggtaaagacctaaaagttaggagcctgatttacccttcttaaaactagataagctgcaaccctacacccaactctattctattacaggaagctataatgcataagtttagctgtcagaatttcagcattatgtaaagggccccttatttaacatgtacatattttccatttgcacagtatcatagaattgacaaataaatcggtgaatgaatagagctggaaagcatatagcagcatgggcatgtgactggtgtaaggatcatctacatcgaaagaatgacgtcttcctctacttgatccttagtcataaaatatccctcaatttttatgatcgtcttagcttttgtttatattcgtgtcctctcctttttaggaataatttagaaaaatatgagaaactatcaaaccaatataatcgacaaaagaaattaaattaaatccaaagaagacataagtgattataggtagaatcattatgttgtagtatactaacatcacctttcagtccaccacagtgagtcagtttgacatgcttttattgtattacatgcaaatacatgatgataatgtaacaagcctttttatactctttgaagcaggtgtcagcattggctccattgttctagtgattatcattttcttcgtgcgtataatttttgagagaagaaagcttacagatgtcaagaaaaaatacatccaggaacatggagggctgctattatttgagaagatgaaatcagaccagggacttgcatttaaggtgttcactcaagcagaactagagcaagcaacaaacaagtttgagaaaagccagattcttggaggannnnnnnnnnnnnnnnnnnnnnnnnnnnnnnnnnnnnnnnnnnnnnnnnnnnnnnnnnnnnnnnnnnnnnnnn

SEQ ID NO: 8328 - DNA, 825 bp, Oryza sativa
  unsure (1)..(825): unsure at all n locations
cattcgtcgcatgaagccatcgtcgcatgaagccatcgtatacggccccaccgtgtattcgtgaaataagccaaacagagcatatttgtaaacaaaaaataatctgtgaataaaacttatatatatatatatatttagtgatataaaagtattgacttaaaaaataaacttcaataaaaaaactaaaaatcaactcaatttaaaatttaattgataagtatgagtataaacgaaaagatgtggccgatagataaccgtcacagtcacgctttatcgtttattcaacatcgttcttggcgtgacgctttcgatgcaaaatcgagacaccgctcgctcgtgcatgcacgtttgatctctagctgcacaagtaaaagactttctcgaagaaacaggggatcaaagggagtagtacaattaggtagctttgcaaactatgggaaattataaacgggtggtttatattcgctttgttaatttttggtttcccaaatcaagcagcaaacactgctcctaccatccgaattaacgtaggctacatttgcacgcaactcaactggcatggcttgcatgattgatggaagatcaattaagatgaggatcaatggacggacaccgtcgatcggtctcctgttctccagtccaggctccatcaaatttatggataagatgcatctttcagtaattgcgattgttcgatggctacgaccactactactacccatttgcaatggctgggattaaactgtactaaaggtatatattaannnnnnnnnnnnnnnnnnnnnnnnnnnnnnnnnnnnnnnnnnnnnnnnnnnnnnnnnnnnn

SEQ ID NO: 8329 - DNA, 771 bp, Oryza sativa
  unsure (1)..(771): unsure at all n locations
nnnnnnnnnnnnnnnnnnnnnnnnnnnnnnnnnnnnnnnnnntactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattacatggacaacaaataaaacccttctgcttgttagcttcggccactctcaaaaaataatgcacaccatcaataaactctttggaccgccggtcagcgtacatccattgccgatccatctacatgaaatgaaaaaaaaatcgtacacaaataatcattcgtataataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaatttttgagacaaaaaagtctgcaaaacatagctccaaatgtaatatggccaaaaaaacattggagaatgaagttgctaaccttttaggcatc

SEQ ID NO: 8330 - DNA, 782 bp, Oryza sativa
cacttagtcctcacaccgaaacgaaagcagcagcagcggaaagaggcaatcctagcggggcttaattcttccccggtgcgcacgagtgaggacaaagtgtgcagaaaagacttgtgttgttccaaacgtaaataaaagcgtaaatacttacagaagaggcacttagtcctcacaccgaaacgaaagcagcagcagcggaaagaggcaatcctagcggggcttaattcttccccggtgcgcacgagtgaccatgaaagctgccagatgtaagtgtaagggcagtctatgacctatgaaagctgccagatgtaagcgggcccggccatccctgtctaggaccagccagggtacataaaatgacaagtaatatacagttccaaacataaataaaagcgtaaatacttacagaagaggcacttagacctcacaccgaaacgaaagcagcagcagcggaaagaggcaatcctagcggggcttcagctccactccacaggcaaaacccaattggggtctgagccttggtcttctaacttggtcttctaacttcgtcttcagctcagaagcactatacttctgaaaagggggaaataacagcaaggctgagtacaaccaccgtactcagcaagccacaccaatgatgcagacgtgcaaggggaacacaaggacggtttgtggctatttgcataaaggcggttgtaaaacattttattgagccaaaaagcaaaattgttgagtaattaaagtaacattaaacctccactgatcaacgctacaccactttg

SEQ ID NO: 8331 - DNA, 623 bp, Oryza sativa
gtgattttccaaagaattaatcttcgagtgggctaagacccattcattaattccaacacccactgcctatcaaaccaaatatacactacacgagagctcgatgtacgtatacataaaccattcaaaatttcattgcgtatcgatttgttaagttgtttattaatttcatatattgatatgtcattatttttcgaatgatagcgtattcacatgagggaaaaactcccacataaggattttatcacgactgttcaagaacaactgatggggttcatcaacgaagaagtccttaatcccgatggtgaattctactacgacggatcgacaattcgtaacgtcggtccttcctcttctgacgtaacgcaggcgtcgaagtcatagctatagctagcgagcaaatgaattgtactatacatgcatgtatatatatatatatatttatatatgtacgtacatttactttagagttaatatatattttggtaacatatatgtacataaaatgttaagtgctttaaattataaatatgtgtgtaatatatgtatttatacatatatacatacgcatatatatatatatatatatatatatatatatatatatatatatatatatatatata

SEQ ID NO: 8332 - DNA, 15168 bp, Oryza sativa
  unsure (1)..(15168): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctcttttttctttatgagttacagcttttacttaaacatttaattatctatctatctatctatctattatatactaaaagtccattaaacatcctataaacgctattaagccaccacatagcgctcctataatcgctcctacatcgtcacgtggcatttaattatttagcggtcgatttttactaatataccgtggatctattattttctaccattagatttatttatgtaaatagaaagagataaaaagaagtgcccgcatagcattcgcctgttgcgaacgtctccgatccgtcgaatccctgttacctaatgagcaatgctacacgtaataaatttatatcctaattagcgttaattagcactcatcagttaattagtactgtgtaattagcatacgtaggtgttattaagaaatttcagctccatgcatacaaaagtagcaagcccaccatatttagtgtggtattttttttcagtatttaatagcaacacattatattcaataatttatatcctaaattttaaacatgccattcatattaaagccctattcaaaatttttttaaaaaatatctgctcataaactttgtacaaaaataatcctttgtatccataaactttacatggcaaaaaaattctattaggaaactttcttcggtaattaaaaaaaatcaactcatgggattcaaaaaataaaaaaatgtaagattaaaaaaatccattcacaaactttctatggaaaatgtttatattcataaactttaggaaactttctacaacaattaaatatttattaataggactttaaaaattatacgcaaaatgcaccattttattatatgataaaatcactcaataagtagaaattataattatgactacatccgcatgcaaaattattttatataccgaaacatgcatgtatttccagcttgaaagaaagggacatgtatatatcatatttttttcagatcagatagacttgcatgcactcttctagaatgagcccagcccacgtgtccgttcgtgcaaactccttctcgcacacgtccgcgcaacagccatctcggcccgcatgtcccacccctcccatccatacatgtgcttgcgtacgtatgtgcctcccccatatatttcatttatcttctattttcccttttagttagatagaaaaaatatttaatgatttatacaccgccacatactatttctataatcgctcctacactgccacgtggcatttaatcatctagtcgtcaattttcactaatatactgtggacccattattttctaccattagatttatttatccaaatagaaagggataaaaaggacgcgcatatcccacccctcccgtccagtaggtgtgcttgcgtacgtatgtacctcccctatatatttcctttctcttctattttcctttttagttagatggaaaaaaatattttatgatttatacaaatacaaaatgataaaaaagggcccgtataccctccctgcctgtccagtatgcatgtgtacttacctctcccatatattgttttcctcttttagttacatggaaaaaatattttatgataacaaattttaaacaattatattatctaaatcatatagataatttttatttgcgcacactattagattatttactataaaatttaaaattgaaaatctaaattaactatattattaaagaaattcattattttagtcatatatattctacgaactatagcttttgttcactaattcatatatttttaagaaaaaatcataatagattttaaaccttctgattaataacatgggtggacaattttgacaacaagaaacctaaccagttgaactacgctcactttattatgttggacataaaaacaaccataatttttaagctacattttttaaatactcatatgccttttaaaccggtagaaccactatttctaatcattagatctatcttatatatgaaaaagtgtttattcatggtacatgacatttcaaaaatattactgtgcaatgatacttcgttgttatagtattcctactaggttgcgtggagtctctcatccacactacatgaaatgttcatagatagatcgtctctcaaaatatatcaatcatattaggctatataattaaacccatgtatttcgtggagcttcatgtcccacccaatacatcttttaacatattatgataatatattatacaattaaaaaaagaaaacaccttatttttattttacacttattttactttcgttgacatattttctaaagaaaataaatctaccttcttttcaaatgatgaagaagattataaataattgcttatagatattacttatatatgatatatataagggtaataggttaaaatattattaaacaattaattaatgctgacaaaaaacaatttatggagaaatcgtggtagatgttctccggttaatatctcgcttttataaatacctcaaatttagcgtacacgtatgcccgcgcgaatcttcctagttttgttaataatagtgaagaagcctaagtggataataacataatttatttatttattaccttcaaatggcgtacgatcattcactggtatatgcaagcagcgaacctcgaataccctgcagattcgagatggagggggaaacaattaaattgaattgtggtttttttattcagcaaaagactacagctataacttggtgtagaggacgattgagtactggagacaagtgcacttatataaaaatataaacaaaagtagttttttgtactacagtactactactacaacagttactggcacaaactcagaataacctaagcagaaaaaaaaaaggaagtgtttatatcaaaataatttaatggaactttgcagaaaggaaaccaataaagtcggcaaaggaagatcataagctagttaactccaaaagtgtaaatatagctagagaagtcgttgtgtctttatcagaagaaagaagtcaccttcccaaagacttgtggtgcaaaatgagccccattccaacaccatcagttcctgttgtgcagtcaaatctaatcagaaattgttaacacgcaatactctaatttaaccactcaggcgacagcctttttgggagatcttcctttgtttcttccataccaggatcctatgtcttcaaaatcacggtgattttatcgctgacatgtggaccaagttagaacttactgtatttattttccaagagttttgacagtagtattcctctgtttatccgagttagcatatcgaaatatatatatattcatagctgaacactaccccaggaaatgaaaaaaaatatataatggtataatactgatatgaaaaatgaatatgtggattatgatcctgcagggacatggcaattgtctcatcatgtgatttgctgctaagtctggtttttactctgtaatataattgtagccgcgaacaaacagtaattagctgtgaatatttggacggaagcaacgtaattaacgtatacctggcaagaagagcagcagcggcgcgttgtccaccgccggccggccggcgtcgacggggcagaaccaccgcggcgggccgccgtcgtcgctggagacggccctggccgccgcgaagtagtccttcaccgtgacgccgccgaacccgtcgtcgtagagagcctccaccaccctgcccgtcctcacctccgccgcatcctccctcctcttctcctcctcctccacacccacctgccgctgctgctgcgtctccgcattcacggacaccgccaccgacgccgtccccacggagctcgccgcccgtagcgtcgcggagggccgccgccaccgacagccgaggccgccagcggcgacggcggggagcgtgtggagcgcggcggacatggcggcggaatgcgcggcgcggctttggtcggagaagcaggggggaggagaggagaggagatgaggcgggggaatgattgattgatgcgcgcagagctttttgaggggcgcaaaaaaaaaggggggggcttaaagaggtgacgtcacccgcagattgccatgtaggagtactacaggtgtagcgtggccgttggtgcttttcattttttttttggttgatggtgattctgagtcgtggttggcacgggagccactattaaaagtattaaaagagagaggggaaaaaaagaacagcaatgagaattttgtagtggaaacctcaagattcttcagtaaaaagtggtgatctttcaggatggggtgttggcttggcttggcttgtggctggagaagataaactactgtaaagcattttgtgccgttgcacaaatggacagataccaaatggggggtgcacgtgctttgcatagtgtggtgggctggaatcgtcggtaggactgcaaaaaataatactacgcgtgtgtttagtagtttgggtgtaaagtttttaagtatacgaatacacatttgaagtattaaacgtagattgataacaaaacaaattataaattttacctgtaaactgcgagacgaatttattaagcctaattaattcgtcattagcaaatatttattgtaacatcatattatcaaatcatgtcgtaattaggctcaaaaggtccgtctcgcaatttacatgcaaactgtgcaattatttttttttcacatttagtgtcctatgcatgtgtccaaatatttgatgtgatatttttttgccaatttttttggaatataaacaaggcctatgtgtatttgatttacctacactacacaaagcatgtaccggagaggtgttgtagtaattttagtttccaaaaacaattactctctccgtttcatattataagtcattttgattattttcctaaacaaacttatttagatttccaagtttatagaaaaaatagtaacataacgtatatataatcaaaatatatattcaatattacattaaaaaaactaatttggtgtggtagatattataacttttttctacaaacccaatcaaatctaaaatagtttgactagaaaaagacaaaatgactaataatataaaacggagggagtactatctcaaatgaaacatatgtcgtttacttttaaaactttgaccacatatttgaaatatttgttaaagatgatgaggggtagatttatcgtgaaaattactttcctttccttttcttgataatagttaaaaaaatactttcataatctcatagacttgttagattttacaagttaattgtaattaaaattccgtggttaaagacccgtcctataatggcaaaatagaatatacggtatatatttgtgaccagaaaaatgtaggaatgtcttctttttagttagataattggtaggaatacctggttggtaaacggaaatgaaaagaaaagggcgaaattcaacctcgtgtagggtaaggcacggccgtggaggtgacaagaagcgtggcacagcaccagcagcatactagtactgtacttttgtggtgggcaagccacatctcatcacatgccggcccacgaggctgttgcgtcccacatggcccacggggtcatcgtttggcttgtttgcagatgaaaaataattcctgaataaaacttttacatatgtgtctttagcaatctaaaaataaaaactgaaaaataaattaagatgaaaaataaatctcagaatcaactctaaatttagaattaaaaatttaaattttagtttataagtaattataggcaaaaagatgacaggctagtcgcgacgcgcgaccgtttagatttagaatcgatcgtgtcgactcgcgcctcttggtgtcgatcggttgcttagctcacttggattttgtgcccggccaactataccagcgcagatgccatgtcgacgtgtcactgtcggctacgcggctggctccgatcgatcactgatactgatacttggcgcgagcgtgcgggccacccaacagaatggccaccgcctagttcccatgccaatctgccgagaatgatgtttttgaattgatgttataatatatcctattgaagtaaaaattattggcaatgcctatattcaatttggcactaatctagaatatttttctctattatctataccatcaatatttggcatcatattaaagcaatccaagcatatgtaataaatctctaccatatacttatacacataaacagactctcgcgtcgcccctcccccttggacgatacgggaggcgacgaccccgccggcgtgcgtcccccctccttcctcctccgcctcgccgaagcccgagcggccgtcggcaaagccatgcggccgcagtgacggcggcggcggggcttcattttccccttgttgcgctcgggcaggggggctgcgcgggacggaggaaaccgcctagatctgtgctgctcggccggatctggcggcacggcggtggcatcggagtttgggagtgctggcagcggtgggaaagtccgccagatccgcatttggatctggtggggaggcggctggcggcggcgcacgattgtggtggcaacggcggcagcgacgcccgatggtggcggtggcgggtgaggtctggcccacggcggccggatctggccaaacagccgttggcgacgacaatgactgtggctgagcgacggcggcaagcagcgggcaacgacgacggttgacggaggtgctggaggctgaggcaggcgccacgtgcgcggaggtgcatgaggctgcaacggcggcggaggcgcagaagggccacgatgacggctgagacccgggaggcagcggcagacgcaacggcggcgcacggaggctgtggatggctggcagggattgcggctggcatggccagctcagcgatggctcagccggcaaccagcatgatgagcgcgtggagtgtggccggcggtgccggtgtggcacgccaaagtgcgcagcaggaggtgaagctggttgagatggagaccggtgaggtggcagcacggggagactggccagcggggggcgctggtgcagtgaagcccatgcgccggcaaaggtgttgatggcggtggagcaatggtgcatttgtagaagatcggcaggtgatggacagcgggtgaaaacccagcctggccttggccggatcgacaacaatgacgttcgagtgccattcccctccttagagcgttgtcatgccatctcacccctcaagggtggctgccaggtgaaagctcagtctcggttctctttgagaccttgacggacggcggtggcggtttcccgtcgcttctctccctagagacatcgtcgaggcatccccttgccgaagcccctcaagcaattggtgcaaccccgctctagattctagtccttttgtggtggcgttctagtttctacaagttggccgcgtaggagggcctagggggagaggagttacattcttctctctcaccctcaatccctaaatcgtgaagacttggatagagtggagcgttgtgttgattgtaagggttgggttttgggtgatctcgactgtcttcctttgttggcctagcggcggtcggtcacgcttagcagcggccggtccgtgctaaccttctcctagatatgtgtgttggcgttgtcggtgtgtaggtggtggtatactttttccattttcctggttatgaccatctagggttgtaatctcgtaattttttcctgttctatcaatagaacttcgcaccgtcttagtgcgagtcgttcaaaaaaaataaatctctaccataccaaagatttggtagtgttaaaatatgccaaaaatttggtactaccaatgatatcattggtaaggtagagaaccaaacggccatatagtacttcctttatccaaaaatcttaaatcttaaaccaatgttcttttctcctggagataaaagataaagatgaaaattaagtgttttacgaaaaataaggtggtattaacatatgattaattaagttttaattattacaaactagaaaaatagattaatctaatattttagagcaactttcatatagaaaattttcacacaagacacactgtttaacagtttgaaaagcgtgccataaatattcaatattttatccactctttgtagtggaaacgaacatgatagtctttatacatctataagtggaggagttgtccttttgttttacaatgctaaattaaattgttaactggaactcgcaggccaggttctcagcgagcagctccggtgccacactcctgaggttggcaacgcttaccgtattcaccaggccgttgattctcttcctcagggtgtcctagctgagacgctggtactcggcggcagaggcagcgctgtcgttggcctccctcgtcgccatccgtgccgtcatgtggaagggcgggatgtagatccctttggccattcgctaaccggggatcatctccggcagaagtggtggtggtgggggcagcattggagttgtcggctaggaataggattcagctccttcctattaggggttcacccgcgagtaggggtgggcaaagaagaccgaaccgaaatgaccgagaccgagaccgaaaccgaactaaccgagaccgaaaaattcgaatcagcactttctacaaaccgaatttagttcggtcaaattcagttttagggctcggttaaccgaattgaccgaaaaaaccgaaatatatcactggattaggcccaatacctcttcctccaaaaaccagaaaaaaacttatcctcacccacgaccccccagtagtccacccccaccaacctcctcctctcggcctctccatccacccccttcccatccccatcccctcctccccagtgcagccatgctggtgaccgacggtggagctcccggatagcctcccgcaggctgttcctctacctcccgtgggccatagcctccgcgccgccgcttccgacgccagcgctacctgctactgctgctcggtcagctggtgactggtgagcggcgtcaggaggaggatgaggaggaggaggaggggggggggggagagcgccgacgagggtaggctcgcgccggcagagagttcgaacgacggcgttgagaggaacagcatggccggcgcggcggcggcagggtgggccctgcctgggattcctctgctttggtggctcgcgtcatcgtcgtatccgcaccccggtggatgggatctggagcttctggtagtcggtagaatggtggagatcgacgggacccaagtcatggcaagatcgatttgatttgatttgcttcttttttttttctgaatcatatgcggcatcatattgtagttcttcatccgacttacttcgattcattgatcttgtatggagtacttatttttgtgtgattaatttttttttgttgttcatatgctgttatggttagttcagtctatgaccgagaccgaaccgaactaaccgaagaccgaagtgctcgaagtgctcggtcttaagttttcttgaaaaccgatcagtcttgtgattctgaagaccgaattttccaaaagaccgaagaacctaaccgaatttatcggttagaccgaatgcctacccttacccgcgagagagtatgcggcgcagcggcggtggcggccggggaggtgggagacagcggggtggcgaatagccgcgacctacgaggacaccacgtcacgacttacgagtgaaaagtcgaaaacttgtactacatacctttttttattgaaacttctggccctaattttttagggtgaaaagctttgacgtattacgttggatatacggacacacatttgtagtattaaacgtagactaataacaaaacaaattacatattccacctataaactgtgagctgaatttattaagcataattaattcgtcattagcaaatgttcactgtagcaccacattgtcaaatcatagagcaactaggtttaaaagattcgtctcgcaatttacacgtaatttctttgcatgcttgcaagcgaccaaggagggccgcggggggatgacttcagtgcgagcaccattaaagagcatgatggcccaacaagtgtcggaggggtgggaaaaattcggtgttcgtggccgccttcacgtacggaatccggactcccacctaggggtgcaagtggggcgggctttttttatggcccgcagtcccgccccacaaaaaagcccgtaaatttgcgagcgggccatcccgtatggaccttgcaaaattgtttggcccatcccgcatagcccgttgggcgccaccacattagggcacgagactgggtctctgggagacacgagacaccgccgcagccgagacaggagacggcggcggtgagacgacgccgcggcggtgctactctcgtcttcctcgtcgcccatccatcttcctcggcgagacgacgccgcagcagccatccccaacccccacgtgtgttcggggcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttgatgagaagtgatttctactcatttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaatactaacatccttatgtaccagtttgatgttgttaatcacttgtcaggtcatttagcattattagtgtttgtggctctgctgaatctgtgagttctcttgcatgttcttgagctagtacctctgctgaatttgtgagttctctgacatgtttcttgagctagtagctctgaatctgtttcctgttcactgtcctcttgatgttgcaattttatattttcttccctctcttggtaggtttaatctgcaattttatagctttattccttctcttgctaggattaatcctagctaaatttgggacagggagtagttctgtgcttgtgtgaatattttcacgtgaaaatagtacagttttgtttgctgattgatgaatattatgccaatgtgggctgtccagtggtgcccgtcgggctgaaaaatctgccaagccgtgcggggcgggctgccgtttgcccgcatagggagtttgcggctggtgtggggcggggcgggacggcccacaacccatcccacttgcaatcctacaagtcccacccgtcgccgccatcacctgcaagctaaactgggtgctgtgtgtcggctgccgccgacacgtgagcacagcgtcgccagagatgctgcgggagatgggctgcgtgttggaaatatggtcataattcgatatattttaattcaaaatattaagacaataaacatgacacatatagggtatgaactagtgcaattgataaagtgaatcatcatgagcatgcttaatataaaataagcatcaacatagacataaaaacgcaataacattgcgactaacagtagaacttgaggaaataacgtgagtaggttatacactgaggatggccctccactggagtttgaggcagtattgcctccgttggtgttgacgggaacctccttctcattgtctccaatgttgctgtcgtctccggtgttcgacatgttggcaaagacgatgtagaggaagacgaacaggagcaattgcgcatagcgctcccaaaaacttgatcgtccgcctatccgtgcaagtacgcaagcggacggagttctggaggcacctgctcgtcccgtgcacctgtgcacgcaggtgaacaggactggggaaggatcatgctgggcaggaaaagagagagaaaccggcaagaggaatagaggaagaacaaaagaaccatgcactattgaaatcattccctttggcggagtatgtatatgcgtgcgcaagactaacgttcgggaccatcaaccgagtgtttaattcagtaaccgatgcgctcgttaatatgaccaatacagaatcaattaccgtgtttattaccgttcgagaccatcaaccgcgtgcttaattcaataaccaacgcgctcgtgaatattatcgtccgttataaaacgagagagatcattccctttggcggagtatatgcgtgcacaagagtaacgttcggaaccatcaactgcaagagtaacgttcgggaccattaaccgcgtgcttaattcggtagccgatgcgctcgattactgtgtttattaccgttcaggaccatcaaccgcgtgctcgttaatattatcgtccgttacaaaacgagagagaattcccatcattaaaacagaatcaattaccatgtttattactgttcgggaccatcaaccgcagagagaattcccaataaccaatatgctcattaaaacagaatcaattactgtgtttattaccgtttgggaccatcaaccgcgcgtgcttaattcagtaagcgatgcgcaagagtaacattcgggaccatcaaccgtgtgcttaattcagtaagcgacgtgctcgttaatattaccgatacagaatcagttaccgtattttctcaaccggtcaacaaagtctatccactagcttcatatttaagttgagacctctttacttttaaggtggtattattactcatagcacttcatgcgagtcaataaaatttagcccattaatgtaacactgcgttagcgccgtcgggaaagctctctgctgcgtgggcactgggcagccgaatccgacccagtcggagcttgagtcgttcagtacttgagtagcctatccgattgacggtcccagagttcatatggtcactataatctctttttttttaatctaaaatatacccgtacgttacaatgggtgaaggctattttacgtcgtattgtcttaaattacatatgtaactttagtgtatttacaatataagttttaaaattacatatgtaagtttttaaattacatatatatatatatatatatataaatatatataaaagtagtgtataatttaagtgtaagtactatatagtatactatatatatatatgtgtgtgtctatatatatatatatatatatatatatatatatatatatatatatatatatatatatatatatatatatatatatatgggcacttcatatggggcaccatggtatctaatgcacaaaattactcaaatttttcaaaattttcaaattgtgagtatatacctagttataataatttgattcatacctatacttatcaacaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatataggagtaactcttttctttgcctaacacgatgggtaattaaatggtcatacatgtcgctgtttgcctaaataaatatgatgaattcatgttgatgggtaattaaatggtgatacatgttgctgtttgcctaaacaaatatgatgaatgtatgttgtgcaatgttcaatgggcatggcgcatttccccgcaaaaaaaaaaaagggcatggcgcataggagaactacgttagcggcaccagaattatgtcacctggtgataatcgactgtaatctggtgataattatgtcaccagaattatagcaaatcctttttcaaagagatttcttatacgactcctcctgtatttccaaaagcgaactaatttaaaacccgacttaaatagggacctgtatttccaaaagcggacgaacttaaataccgactcatatacggatgacgtaccaaagtatcggtaaaaacatcttcaatttttataatagtagagaagagatgcgctgccacatcggtccttctcctccgtttcatattaagtcaaaattttgactaatttataaaaaaaatagcaacatctacaataaattagtttcattaaatttaatattgaatatattttgataatatatttattttgtattaaaaatgttattatttttaacaaacttgatcaaatttaaggacttttaactagaaaaatgtcaaacaacttataatatgaaatggagcgagtatgttttttaagacttacatgtggatccatctttttaaattctaatttttattttcttattgtgatgccaggtgagtgccatgtcgaaataaaaaccaagttaacctgccacatatgcaaccacatgagccaaaactgatctcaaaactattgaagaggttgatttacactggttttaccagttggaagagatacgaaatacctggtcaagggacgtaaaatgatccatagatgagggacgtaaaatgaacttattccgcatataattgatgctccggcccatttagtaagttaattaaattccaaaagatggtggttggccgttaaatatttgctcgtcttgcaaagttgcaagatggggatgatggcctccgttcgtaccgccgcgatacgcgaggctgcttatcccgtacgtaaaatcatgtcgtccaccggtcgatcgcatccatacacctcggtaactaggattcaatgaaacatatactccgatttttgattaagatatgtctcatcaaatttcaggtaattactccctcccaaaatataagtgtgtccagattcgtagcactaggaagtgtnnnnnnnnnnnnnnnnnnnnnnnnnnnnnnn

SEQ ID NO: 8333 - DNA, 5854 bp, Oryza sativa
cttattttttaaggagggggtaagtatattttagataaagaaagtactctagtagtagttaattacgtgtacatgctattgtgtttgcttaccccccctattgtggttatctaaattacccccttaaactctaataccagacatttgataatctgaacttgtaaatccggacgaatcaccccctttacttaatccggaacggttttcagccaatatgacagcaggttctcaaacagcagcatatccatggattatggatagattgtggttcttgttaaaaaaacaaaaagctcttcaaatgttcagttacgctcattgagctgactgaacccaccatgcagttgtatgaaggtgtagattggcagatcaggacttcaggatgaacaagtatcttcctagtagttcttaaaacagttcagcaggggacagttgctttgccatttagagcacccatctgaaaacagaacggtgttcccacagcaccactgcaccagctcgtccaatgatccagtccatgtagcaacagaaaaattgttacaacttctaagtatccatgataggcataaaaccttaaagcttcagcttccctttatgccgcctgtgaagcttctgcttcttctaggcgcagcttctggtaatcgttagcatgcattatgtcctcatgattgattgcactctgagaaaagtagaaaaaaggtattcttttcagaaacaaaaattgacccaaattattcgtgttagagatcataatttattttcttacatgaatgccctgagcacaaaaaagactcttcaaaatgttggatacttcatccatgcctagaagagctcagctcagtctcagaggttgtcggcgcagccaaagctgcacatggctgatcttattgcttcatttggaatcccgatattgacatcttcagacaattggctgaaaatatttgatgtttcagttcaatcattattgtcatcgtcttgcagttcgaacaaatccttcacatctttggctttaaaaaaaatttcacctctgctaaatttttaagtttagtgagtagttgtgtcaactacccattttgttgtaccagaaccgacccaagcggctgtgggatgccaccactaggtttctagaactctttctcggccaatagtctgcgtatgcttttttgttgaatgcttcttgtgttgtatgcctttttgtttttgtttgataatgcttgtgcgagctacaatatggttatgaaatacattagatctattcacggggactactttctcatttgttttcctgtaaaatgctaattttgtagagaattactgttgaaaataaaactacatataagccaaaattcagtgaataaatgacaaagcattactatgctagcctagcagtaagggaatatcaaaacagcaatgtatctcctctccaaccctatcttaatgtttaagataattggctgaaaatattggatgtttcagtcaaacatttactgaaattattggatgatcagtctatatactatcacatctcctctcccatcatataataatgttttaagacattaagcttgtctctgcttaagacacggttttctgattattgtgtgcatggagtatgttgtatggaggagtgttacggagtaatcgaactattttgcaattggttgaattatcccatgagtagcaatgtcaacagggaaaaaaaatctaatctacaaatttcaaaaaagcaaagcgctaatgtctagcgctgcctccaaccgagagacccgactgtgtgcctctagggcatctttacttcttttttttttatggatgcagctgaccggcagggggtcgcctgccgtgcccccgtaagtagggggatcttttcactgctcctctttttttttttttgcagctggccggcagggggtcccctgccgtgccccgtataggggatctttacactgctcttttttttttgcggctgaacggtaggcgggtacacggccctaccgctgcccattgcagtcggggtgggtgcctctagggtggcgatggaatagaatcaaatcgagctaataaacaggtcgtgttgtctcagaatcggcgatatggtacaaaactaattgccggatggattcagtccgagccaaagaacagcgcgcatatcgacctaggagtagaggcagaagcatacctggtctccacggaagccggcggcgaagggcgccgtcgatctaagccggtgctgaatcttcgcgccgccgatgccggcatgccgcggagagtacatcggagatccagatcctcctggagttttgacggcgcgtccgcagccagctgctcgctgccggagccagaattggggaatcggcggcgtcgggggaggagaggaagcaacaaggtgaggggggagatcgagggttcccatcgactcaagtgtcgatgcaagccctatacgggctaggcttctctcttcaggcctgggcatcgagcccaagctgctgcaggcccagtccacgcctgtttttcttttctttttctttttttctaaaggatttttgtttgtgctcaaattggtaatgcggttgtttggttttatagcggttacaagttgaaataagtaagccaaggatattgatttgttcacgcagccatgtatcctgcccaaaagtttggcagaggacaacagagtttgccatttatagagtacccgtttgaagactttggcccttccctgtttgaagtttctggtggctaagaagggtctatttagattggtatcattttaaaccataccattatttaataaaataaacaaatatatagttgcatttagttagttatcaaatattagtaatgcataggaaattttggcacaacatatttattctcttctactaaaatttggcaatactgtcaacttgctaaaaatttggcaataaggtttattttggcagtaatctgaacatgcctctgcatcaggctattgagtgttgacttcaacctaagtttccaactcactttctcgttttctatgcacaaatttcccaaattgctaaacgtcttttttttgcaaaaaaaaatatagggaaattgtttaaaaaaatcatattaatccattttttgagtttctgatagctaatactccctcaccaaattgatcatcatataatggaatccaaaacttctcaaattgaacatcatataaccgcattaacatggatttcatcggaatacaattaatacaatatgggagaagtgtgtgcacgctacggtgtaattgacatgatgttttaatcgatacatgtattgtgggaggatgtgtgcatggtgtcttgattaatgtgattttcttggtcttagtgtataaatatatatgatgatcattttgagataaagagagtggttaactaatcaagcattagttcattgttctgttttgcgtgtgtaggagagtggttctaacttctccaagagaacccatcaagttcaagaacacagaggatggtaggtgcctcacagcagcacaaggtcttgcggtccatgtagcaacagaaaaactaccatgatttctgagcatccgtgattggcgccaagcttctgcttctagctgcagcttatgttcatcgtagcattcactatggcaacatgattgatcacaccgagataatcagaaaaaagaaaaggacatcattttgagcaataaaaaccgaggcaaattatttgccttagagatcatatattgttttgattccatgaattgcctgaccatcaaaaaggatcgtcaaaatgttggatccttcgtctatgaatggatgagctcggttcatattgaaccccggcattcgcatgttcagacaattggttgagaatattcgatgttttagttcaatcattatttccatcttcttgcagcgttaagaaatccttttacgtttctggcttaaaaatagggtctttcagtactatgtttctcccctatcggtacacctctaatttccctagttttccatgcgcattccctagcctactcaacagatgatttaatctggtatcgttattagatactacaaatgaaaatttgcagagaaaattactgctcactttatattttaatgtatgatgccgttaattttttaaccaacgtttgaccattcgttttattcaaaatttttgtgcaaatataaaattatttatgccatacttaaagaatatttcatgataaatcaagtcacaataaaataaattataataacataaattttttgaataagaaaaatagtcaaatatttataaaaagttaacggtgtcatacactaaaatacggaggggtactttacatttgggtatgatccaaaccattcatctgccagatcatctgtcactagcatccaatcgaaactcggcaaggtggttagaaaatttggcatcttcacagcgaaattgctggcagaaggttagcaacacagcaatgtatctgctcttacagtcttagagcaaggataataatagtagctataaacaaactatatgcttatgtgaaagagacaggtaaagagaagtagagagtgttggctctcatgcacgagttagctcaacacaagctgcaagaaatatgcattaaattcatagtgagagaacgagagaggatgacaaagataaaactaaccttgtagctaacataacatattatacatgttagctataatattgacttatgataagtagtgagctttattgcttttatatcatgtgcacgagtatcagagtatgttgaatgtgagtatcatggagtgcttgaactagttatccaaaggaaatttggaattggtagattaataaccaatgagttcaacaacaaaaaattcatcaacatatttttatccaaaggaaatttgaaccggtggattaggattagccaacgagtttaagaagaaaataactccatcttacaaatttggaattggtggagtaaccagttagatggtgtttgaatctcctaaagataaagattaagtttattttgcaaaacaaagtagtattaacgtatgattgattgagttgtaattattacaaacttgaaaaatagattaatatgatattttagagcaattttcatatagaaagtttttgcacgaaacgcaccgtttagcagtttgaaaagtgtgccacgaaaatcttaatcttcatctaactcttattgaataaaaagaacgggaccttaatgcaaccggaaaaaaaaaagaatttcatctcacaatttttttaaaagccaagcgctatgtacacccctagcgccctctgtagaaatatttttttttctttcgttgtattccatttcgttcatgccaccgattatttaggattttaggggagagagaacctgaagctgcatacgatagtttagatcagtaatcttttcaactaactcatggacagattacatctctgcaaacatgtttcttgttatttctaatcccagctctctccagatatatttaacatacttacatttgaaaaagaggtgtccctgatcctcatcaagcctcctgcaaacatggcatctagtatcaatatgcatcccacgccgcttcagatttgaggattacagaaaatgtccggatcaaattgtgtcccttaggtgtgtgactggtctcgtaattcctcttattagtaaccatggatcatcattgcaaatattgatgctttagccattcccaactctccaaataatgccctctttcagcagctcaacaccttttacaatacttcgctatgtgtatgacatattcccgatcagatgggcagataggatatcagcagtagggaaataccttgctttaaggatcctagcacacagagcctggatctt

SEQ ID NO: 8334 - DNA, 1540 bp, Oryza sativa
  unsure (1)..(1540): unsure at all n locations
ccagtcttatcttttagatactcaagagcttcagctctagattttctaatctacattggaagccccagatatttctcattttgtgtttcctttgttatgtgcaacatttgcatcacctcacttctcttctgatccctagtgttcttgctaaaaattacagccgactcgtcgttatttatcatttgccctgaaggcagctcatataattggggagttccttgcaattgtgttgcatccttcccgtttgcacgaatcacaattaaagaatcatcggcaacagcaggtgagagatgcatggtgctccttggcaaattttaaccccaccaactctttcttcattctttgccttcagtaatatagcagaaaagccttcagcacagagcaacaaatatggtgataatggatcaccttgcctcaatccaaatggttctcctcgtatacggtaaacaaccaagtccagctatatttccatgagaaaaaccatcaggatagcaattagtaaacaatgtttaccacatatttagcagtagttgacaaatacctagcactgatgttcgaagaaggatagcgtagtatatgggaattaaaaattcactacttctatataagagcagagacctgaggcaaaaaaatacgaaggatcgatttatggaggcaaataaccaacgacctggacaggtactgcatgtaatttgaagtgcaattcataaccattacataatcgatttatgagagaaattcaagcccaactgattgaagtgcagagcaaaatgtttgctatagaattgatgctacatgtgaaggcagaccataatattagaaagctgtaaaatataaacatggcgaatactttttccatttttagataaacatggagaggaattatgtaggcagggacaaactgtacaaaatggttgaaacatcaaaagtgaataataagttcccgcatgggcaatcagaaaaaagaaattaaaatgctggtactagtcagataatgtttgcctaatatcaaattcaagtagtgagttcagttacttcttgctatctcaaagaaaataacaaattagagggattttacgatgtttgcgaggtacaaggaggtggggcgacgtgagccgttgatctgcgaggggcaaggtatggaaagaaaatattgtaataggtggcattaatgtaaatatgatgatattagaatgacaaatgtgtcttttacacatatgaaaaggtatgagaaggtatcgatggaattagcttgtagcctgttgcgttgcatcgttcttagatacgttctattcgtacgtaaggtttacgtgttcttcgataagttgaaaggtggagaattgagggctggcggtgaacgtgtggccggaggcggtggttggagggaggggcggcggaggaagaggacccggaggaagtggtccaggactgcctatgttcgccggagctagaagcggccgcatggtctcgatctgtcagacgattggggatnnnnnnnnnnnnnnnnnnnnnnnnnnnnnnnnnnnnnnnnnnnnnnnnn

SEQ ID NO: 8335 - DNA, 656 bp, Oryza sativa
aggtaaattggtccaagaaaccaattcttgctccatggtgtagcatcgagtggcatcattgtgacttgccgaattaaaatcccttgggttcacggaactagagctgggcgtataaagcagtaatggatcaatttcattttccctgcttacttctactctattcttcttctttgctactttactcctcagaagttgcagccttagctccacttctttcatttttggtctctgttctcctctaagcctcaagcatatctctgcaagcgaagcaatctcatcaatttcccactggtctgcttcttccaaaacctgtacatctactatttctgatgtggtattgttttgctgtctttgaagaaagtgatgacacaggttctgcttttctccaattgaattgaggaagattggccttttccttgttataagctcaataagtattacaccaaaactgtaaacgtcactcttctcatttaattgtcctgtatgataatattcaggatccaagtatccaaatgtaccttgcactattgtgaccacgtgagtttcatcaatagaaacagatcttgaagcaccaaaatctgaaacctttgtagtgaaattatcatcgagaagtatattggcagatttcacatctctatgaaatattggtaccgagg

SEQ ID NO: 8336 - DNA, 1462 bp, Oryza sativa
aaagcttacaaatgtcaagaaaaaaatacatccaggaacatggagggctgctattatttgagaagatgaaatcagaccagggacttgcatttaaggtgttcactcaagcagaactagagcaagcaacaaacaagtttgagaaaagccagattcttggacatggaggacatggcacagtgtacaagggaataactaaggataacattacagtggcaattaaaaaatgtgcactaattgatgatagacataagaaggaattcggtaaagaaatgttaatactttcacagattaaccacaagaacattgttaagctactgggttgctgtcttgaggtggatgtcccgatgctagtgtatgagttcattccaaatggaacattatttgatcttattcatggcaagaaccgtactcttcatatccctttcagttctctcctaagaattgttaatgaggcagctgaagggcttgcatttttacattcctacgcaaatccaccaattttgcatggtgacgtgaaaacatccaatatccttcttgatgagaattacatggcaaaggtatcagattttggcgcctccatattagcaccaaatgatgaagcgcagttcgtgacaatggttcaaggaacatgtggatatctggatcctgaatatctacaaacatgccagttgacagagaagagtgatgtgtatagctttggtgtggtcatcttggagatccttactgggcagatgccattgaaacttgaaggttctgagctacagaaaagcttgtcatcaagcttcctattggcaatgaaggagaataatcttgaggccatgctagatagccaaattaaaggtcatgagagcatggaactgctcagtggacttgctgagctagcgaagcaatgcttggacatgtgcagtgagaataggccatcaatgaaagacgtagctgaggagattagcagactaagaaaactttcgaaacatccttggatacagcgtgatagtgagacagagggctatctcagtggaccatcaaccagtaactttgaaattgagcaaagcactgagtacacaaggaaggacgaacaaatgcccataaacccaagcacttcgtattttatccggtgataacaatctgttacaagagctttcctgttttccttattgattcttaacattattctttccaattcactggtggttctatattgcaactgcacaatactttctgttggtataataatttgtcgttgtatatgcccacaacatttttatcatttaccattattaaacgtattctattatagtggccaaaccatatctcctcaggtaatgttgtttaaatattcaacggaagtcttataaagctctcaaaacattgcagaacttggtgtctgctgaagtttatgtttccctttatttcacaaatgcgacatgaatttaatcacaaaaatgacaaggaacttacttgg

SEQ ID NO: 8337 - DNA, 8550 bp, Oryza sativa
aaactgtaaaccaaacccgatacacaaaaaagggccgctctcacggattcgttcaatcgatgttgacgaaatttgaaggacggatacctggaatggtcggaatcgatttgcaccggctggatgggatcgggactgaaatcggttcagaggcatcagagccaagaggattaggtgccaagaggatgcatgcatcctctgaatgcaggaaggaaacgtgaccgtgccgccgccgttcgtccgttcctcgcctcgcagcctccgcctctccccgtcggccatcggacgccgagccgtcgtcgttgtctgcccgggtcaatccgcggaggatggaggcgtagaccaccgcgaggcaggcgccgaggccccgaccggcgaccgtgtcctcccgcggcgccgtgcctggttgatttccgccctgcccctacccggctactcggcttgcccaaacctggttgattcaagtgtacccttgttactttgtcaccccattatttggttctatcatcctccttaaaacttttaaaacttgaaccgtactataagagttcattgtctctttgattttcatttttataatctttaaaagtttaacgagatcattgtctctttaattttcatttttataatttttaaaagttccgttaaccgctgccactatactcctctgcagcccgcttgctgcctcctctttttattgtaattagggttttaaaaatcaaatataattattatttaggttcattttttattttctagaagttccgtcaactattagtggctacgccactatactcctctacggctcggcttattgaaattttaaaaattgaacatgattattgtcgacgtttgatatcgcgactatggtatttggatggtatggggaccgtcggtatcagggtatatgcgagattgaggtaaaagaaatggagacaagaatttttatacaggttcggaccccttatttgataggtaatagccctacatcctgttggccaaaaccggtgttgctctttattcatctggatcacacaaatacaatatttgggataacctatctagttgtcatcgacttagcggctagataaccgactcgtagtcgatgacagggtagtcttcctcctcaagtacgaattcgtcgagatcatagatggcgtatccctcttgctgacccctgcaggtaccggatggggtacgtctaggctaatctttgatgtcgagatctagcggcgtgtgcatatgttatgtcttgttggtcttgtggctttgtagattgtggtaggtgtgtcctctctcctcctaggggggcttgtatttatacccataagtgtgtccccttgtctaagtagaactagggagataaatatggatacgatcggactaatccttgtcgtttccatgcagaactcttctggtcattccttatccggaactccttctatatacaaggtttgtttccatacaaggcatggtgtgtggtgggccccgccgagcttagtcgattaatattgggtatgtggtatctatgaccctgacaattattattggggtttaatttttactttctataagtcctgccaaccgtcatgactgtgctgcttaatggcctgcccatcgtccctcctcattgagattctatttgaggttttgcttatagtttttagatgtcacatcaaccgccaccactctactcctttatagccctattgcttctcccctcatttgtcatggttgtgttctagatgcacttttttttttgaaattccatatttttcgctctgatatttttttttataaattgtattcctacttggacttttatttttatttttctattttcagaatttattttatttgttatttcgaattttaattaatctcgtcatgtgttctaaatgaacccttctatcaagagtctttatttttattacaaattttagttatttataaagtgtattagtagttgaactcttaatttttttctaattcctgaatttattttattttttatgttaaattttaattaatctcgtattatgtttcatatgggctattatttcaatattccttttctattttcaattttagttgtttcaaaattgtattcctctttgaactgtcttttttatttttcttacaatttcggaatttattatactttttattttgaattttaattaatctcgtatttggttcttatgtgtactatttttctaatattgctatttttaattctgaattttagttattttaaaattgtatttctacttggactctctttttttctctccgattataatgtgggaatttttagcatccacagcaaacgtggtgcttcctttcgaagctgtctcaataatataatagatttgtattagcatatgggatttgtggggtttgaaattttttatatgatttgaacttctaaaataagacttcccaacgacaatttcctgactatactacaccactgcctctcatgtgtgctagtttataagaggtgaagccactactctcattctggactcgatggtggaaacagtgctctcaaattctctgtttttttctatttctttctttgttgctggaagccgacaaaatggatatcatgccacttcatccgtgtggtttcgatgaaatcactacttaaaaatgattttttttggatattatgccactccattcttgtcgtttcaatgaaatcactactgcataaatgattttttctgtatgatgacccatatagtttataggcggaccataattggtcacctctgcaaaaattgatatgcttttttcatacaactcgttaagagactcgtatgtaaaaatcaattatcataggctggcatcttaacttgcccacatgcgatgcatgcaagcctcttaagtggtccgtatgcaaaataccccctgccaccaacccctaccaccaccttccgctcattctctccccactcctcccttatcctgtcttctcctctccccactgtggcaggagcaacgcggactacggcggggcaaagatggccctcacctgcatggagactagcggaggaggtgcgtgtcaacggcggcggcagccttcccccacacggagactagcggaggaggtgcgcgtcaatggcggcgaaagcggccttccccctcgcggagaccagaggaggagacacgcgacgacaacagtggccctcccccttgccgaggctggtggaggaggcgcgtgacggttgtgttaacccatgcatattcacacagccatgcttaaataaaatttattagaaaaaaatatatatatactattataattaattttttatgttttattaggaatgtaaaatttggtataaaaaaattctatatgccttgtttttaaaaatcactaagcaatgatctattacagcagaccgacagacaatgattagctgcaaagaaatgacaaattcgggtcaaacacaccccaatagatagtctggggtgtatatatatatatatatatatatatatatatatatatatatatatatatatatttcatacaaactgatctcacgagatggaaaccaaatcatgcagatgtaaagtgatttaagaatgtgaatttgatttggtaagtaatcaaggcaattagcttaggttcatcccgaatccattccatgtttcttaaacaccctccccccacacggatccggcggtggccgccctcccccacgatgacaatgacctccgcgatgacgatgactggcggtgatggtggtggaagcgagtggctggtgggcggatccaccgcccctgccctcggaccggcggtaggggctggtccgacggctagggtttcaggatatttttcttttttttatttttattcttttcgccgaaatcattttcgcatgcgattggcttcggtgaccgcatgcgaaaattcggttttcgcatgcagttgcgttacccgcatagaaaaaatgacgattttcgcagacaccttggtgcggacgggcctaaggcctgcgtgcgaaaatctcttttggctatccagaaaaaaaaatccatttttagtggtgaatgccactcactaggatgcaccagataaataatactaagtacgatgccttctagatgtagattatagtgccatttcggagagttttagccattttatcagcaaaataccccttgttgttagggttgaaattgattcggatagtttccgtccgttcggactatttttcggattcagatagtttcgaactatccggaaattctcagattcggaaataaattcggataatttttctcggaaaagaaaacgaatatagtaagggtactatccgttggaatcggaaaacggtcgaaaactatccggatttttttttcggatatccatagacattgagcaaattttagaaaaaacacgtatatatacataacttttttatacagaatcagatgaagacaaactttatatcaatattgtagagctcgatgagatctataactttcttactgactatttttattatttgagatcatttaaagatctaaatattcattataatataccgtattattttttacaaaatctcagatctacaattcaaacgacatctgatagagatgtgttccatatcaaagttgtagagctcaacgggatctaccactttatagtttataacatttgtatttaaaaaaaatttaaagtataaaacaaacattgcaagtttcgaagatgtgaaataaaataaataacatctccaatttatacaatggtaagtaagtagtaaaaggttttgggaatagaaaatgataatcatatttgtatatggatctcttagaggaacaaccataaaaatcaattttcacatacggttgtgggaccgtctacaaaattgacgatataaatgttggagatgttgaactaaaataataagcaatatctcttccttgatcaagaaacttaatttgagggttttttttatataccggtaaatattcgctaccgtattcgttctgtcttgtattcgctccgtatctttatttgataatattcgttttcatttccatatccaagttttcgattccaatttaaaaaaaaatatgaaaacgaatatgataaagctggtttccgtctatttccgatccgttttcatcctacttgtggtggagagagcgagggagagcggagtgtggggagggccgagctggaccgtggccatgctcctgggctagctcccttgcgtcgggatacgctagaggcagcgagtagcaagcagacgggtgatggcaaacaacgagtgggcagccgatgctagaggtggtgtgctgtgagtgggcgacactggaggcagcgagcagcgggcgggcatgtggtgctggagatagtgagcgtgcagacaccttctccggcactgcacgaccgctcgcccacattctcgcgtctctaacatcgcctgcccttgcctgctgtcacaccatgaagttattctcccaagccaaaattaaatttataattggtctcgagaaaataccggtgtaaaagcaagagtgaaaccctaaataaattaatgcaaataataatcggaattggcatgtagaactcaattgtaacgccctgattttcgttcgggattaaaaatcatttaataatgtattatctagaaattaaataaaagttaaagctatttaatcaagtgaaatatttgagggaattaaaaatttcctttaaaaaaatcatggccgggaatattttgtaatattctttgtgccctaatgtactctccggaattttccgtgaattttcggagctcaaaaaataattataataatacaaggttcatttaaccaatttaaataaaaagaaaagaaaataatcttccccttcctccctttcgggctcggcccaaattccttcccccttcccctccgggcccgcctccctcccctctcctctttgggccgctcggcccagctcggctcccctctccccccaaagtccagaaaacccccacccggcttcccctctctcttccattggctgacaggtgggacccgtggccccacctgtcatccccttccctaccttcaagcaccccattaccagggacccgcaactgatgacattgacggcccaccccggcggtaaaactgccggctcctggcttctacgcgcacgttcgaccgtgcggacgtggtcgccacccactcctgctgcaccttttcccccactctccccgcgaaaatcggcgctggtttacccccgccacgtgcccacgtcgccactccatctcgccggccgttgccgcccgttgccgcccatcctggccacgatctccctcccccgcgcccatataaacgacccccgtgctcccctcgtccatttccccatttttcccgagcccggcactctccccacgccgctcccgtgcaccgccgctttccggcgagctccggccgcccgccagtgctgctccacccaccgccgcaccaatccgccaccaccgttggcttcgcggcgccgtgctacagcccgacccctactccatttcccctctccgcctccggaacatcgccgcctcgcgcaccacctctctccgtcgccgccgtcgcctccagccacgcgccaccgccgctcccgccgccgctgtgctgcgccgcctccactgccggcttcgccgccgcgcgggcaagctcggtctccgctccgtttccccgttccatcgccggaactccatctcctctgtcaacccgagccgccaccacctcgccgccgccgcgagcgacctccgacctcacgctctccttcgtctgcttcgcaacaacgatagggaacccgacatcccctcatccaagctcttcgtcgccggaaatccattccccgctgtgagtggtgagctccttcccttgtcgccagcttccggccgagttttcccgccgtcttgcgcctcctccctattcatgcgcctcctccctattccctaactttccctccttgttccctagatccttccggccgccgtccgccggttcccgctcacggaacaccgccggaccgccgttgccgtgccaccccgaggagcgtcgccgccatctcgcctccctttggtgccgtgccgcttggtgagcatcccctctcctccgctctttccgccgctctccgcgtgccgacccgcgccaccggtgtcgtcgccggtggtcgccgtctggccgcgcgccgccgctgtcgttcgccgccgctcggccgcgcctgtactttggccgcccgtggaccactcccatggtctgggtccacggtgccgccaggccgcggtggaccgagtccaccttgcgcccttccccttgtgccgctgacgggtggggcccgcctgttggcgccggccctcttttgatgacgtcagcggctatgccttttcctttggaaaataattaatagttgcgcaataattcgttaataattctagaaattcatttaaatggctcaaaacttctaaaattcatatctaattcattcaaactccaaattgggccattcaacttgcaaaattcatctaaaattgagatctacatgtttgtttagtttttatgtattgtttcattggtttttattagagtttttcctccatttgcgtgccagcgtgtagaatccgttgtttcagaagtccgcggtcgcgaggaaaagagttcggaagatcaaagtgaagaagcaaggcaagtcacacattccccttgagcatgttgatcccaagttataaatgttttaccgtttgcaaataaacatgcatgtcttgctaattacatgggatccgggtattacctatctgcttgcttgtgccatgtttacttgatatctatcctttgtcaacattgggtaataaatcgactagctcatgttacttatgtgacctagctagaactatatgcttagccatgcttaattaccactagctcagttgatgggataatggcagtattagacctttttagcatcagaacgagctgcgtgctcgagacacccggccatgtttcagtggccgtaattatccaactaaaatgcgactgaagggtgggctgtgggtgcatggttttgctagtcacacccatggcaattaaggaccggttcgcgggatgccctagaagaacttatcgtacttatcacaagccagcgtgggcaatggctggtcttgtagtgtagctttcctctagctgacgcatccaggcaagggtgggcgtgatggagtttggatgggccctgcgacggcctatgcggcttccggatttacctaggcacgagaggggactgcccgctgccttgcgaggagtgggggtgaaacctgaggtgtggtgtgcttggttagagggggttatgcaaagggttctgtcacggcctctttccggtatgtcgtggtggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtcccaccttaataaatcg

SEQ ID NO: 8338 - DNA, 9619 bp, Oryza sativa
gggaaagaattaagcccggctaggattgcctctttccgctgctgctgctttcgtttcggtgtgaggactaagtgcctcttctgtaagtatttacgcttttatttacgtttggaacaacacaagtcttttctgcacactttgtcctcactcgtgcgcaccgggaaagaattaagcccctatttacatttggaactgtatttacttgttattttgtgtaccctggctggtcctggacagggatggccgggcccgcttacatctggcagctttcataggtcatagattgcccggggaagaattaagcccctatttacgtttggaactgtatttacttgttattttatgtaccgtggctggtcctggacagggatggccaggcccgcttacatctggcagctttcataggtcatagattgcccttacagaccaacacaagtcttttctggtcattgcctctttccgctgctgctgctttcgtttcggtgtgaggactaagtgcctattctgtaggtatttacgcttttatttacgtttaggtatttatgcttttatttacgtttggaactgtatattacttgtcatttacttgtcattttgtgtaccctggctgtatattacttgtcattttgtatacccagggatggccgggcccgcttacataggtcatagattgtccttacagaccaacacaagtcttttctgcacactttgtcctcactcgtgcgcaccggggaagaatttcccggtcggtcacccatcccaaattgcttcaggccaagcacgcttaaccctggagttctttggagatcagcttccgaaaaataagttgcaacttgttaacatgagtattctattaatcttattaagccctagggcgggatgtcacatcctcaccccttaagagagatcgacgcccccgtcgatcaaccgtaggctaggaacgtcccctcttggccacgtccgtgtgtccagtgccagcgcatgtgccatgctgtgtgaccactccaggtccacaccagccatgcgcactatgactgtgcaactgcaacacacgcgcccccgaaaccgcgagagtcggctctgataccattttgtaacgtccgcctctcctaggcctgtctgcttacatctggcagctttcataggtcatagactgccctcacagataccattttttaacgtcccatctctcccaggccgggcccgcttacatctggcaactttcataggtcatagacagccctcacagaccaacacaagtcttttctgcacactttgtcctcacctgtgcgcaccggggaagaatttcctagtcggtcagccatcccaaattgctccaggccaagcacgcctaaccctggagttctggagatcggcttctgaaaaagaagttgcaacttattgatatgagtattctattaatcctattaagccctaggccggaatgtgccgccacgtgtgcgccacgtcggcgccacgtcagcgccacgtggtgcgccgcctccttccccggtccgtgcacccggtccaccgcggaccgccacccgagtcactgccatgtggggcccgcatgtcggcgccccctgatgacgtcagccctgggatatattgcgcaataaatcaattaatgattttttgtttatagtaaaaacacagtgaatcttctaaaattcatatctaattcatccgagctccgtttaagcccattcaagtctcagtaaatcatgaaaaatgcatagaatccattaaaaatgcttttgttctctgtttcagtagtctttagcctgtttgtattgtttgctttgtatgtcgcttagattccggctctcctgacgctccggtgtactttgaaatagtcaccgaggttcctccagcagtagagcaaggcaagtcatgcttgtcacttgaacatgttgatcctatattgtaaatgctttatcgttttcctttaaatactgcatcattttataatgttactatgggatgtttacctactgttacagccatgctattgttgtaccatgctcctttgctagcttggggatataacatgactagatattggactagggattgcttaactatgcttagttcaactagcacacaatgggggaaatacattaatgcatagatatcagattctagtaatgatgttggttaatgccactgctccggtgttggttaattaaaatatattaaatggtgggctgtgggtgcatggttttgatggtcgcacccatggcatttaaggaccggttcgcgggatgccctggaagaacttatcgtacttaccacaagccagcgtgggcaacggctgggcttgtagtgtagctttcctctagttgacgcatccaggcaagggtgggcgtgatggagcggggcttgccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgttgtggtggcatgtcgccacacggtaacgtgtcgtggggctgtgtcttgtgggtacagttgtacacctctggtcagagtaaaactattcgaatagccgtgcccgtggttacgggaggtcaaccagattcaccctgattagtctcaccctagcttagtctaatggaattgattagtccaggtggatgggtgggcctgttgcaacgtggtgtagcgttggacagtggatggttaatattaactaattattacaactgttttactgctttcaactaccgtctttaaatgctcgctttatgcaaatgaaccgttctagccatactttgattataccctgcatcataccccctattccggtatgacttgctgagtacggtggttgtactcagtcttgctctatttttacccaaaacccagagtttgagtacgtgtcagatggtggcttctccgaggagtaggcttcgtccgtgccgtcgaggatgcctgtggagtggcgttcccgctgcagttcaagtcaaggcttagctccatttatcttttaattttccgctgcatttatataagacttttctaatgtttgtaagacgtggatctgtatgtcaactttatcgtttgtgtaccccggccggtcctggacgggggttttaatgcacattctgcttggaattctattcgggaaccaatgcgggttcatacctgtcacaccctgaagttctcctcccaagcctaaaattgaatttataaatcaccctaagaaaatgctggtgcaaatcaagagaaaaccttaataaattaatgcaaataataatcggaattggcatgtggaatttttcttgagttctacatgtcgaaatacgctaacaagatttttagtggaattttcagagctctcgaaataattttaaccaattaaaattgagcacatgcaattttaatccgaggaaaaatcctttttccttctttttcctttttctttcttttcttttctttttttctttgaatgggccgccggcccattcctcctttttctccccctcctcccgctgggccggccataggccgaggcccagccaggccgccccgcctccctcctctcccggggtcgccgacaggtggggcccacctgtcgggtcctcccccaacctcccgccgcccgcgccggtcataccctgccgaaaccgccgccaccgcacccactcctccgctttccccgcgcccacgccgcgtcgcccttgcccacaccacgtcgccgccccccctccccgcgtcttccggccgcgcccgcgcacgagaggggcgagattagattttgaatcgcccccaccttctctctctcctctcccacgtcgccggcgaaatcgcggcgcctcccggccacgttcgcctccccctccgcctataaaatgctccccatgccctcctctctcgttttccactctcacagctccatcccgtgccccctaccgagctcgcgccgccgccgcttgcgccgccgcccgccgccgcactccggccgtgtgccaccgccgctagagccgtcgccgcgctaagccaccgccacccctagcttcgcagccacaagacctttctcggccgccgctttgcgtcgccggaatcccaccgaaaccccatctccctcgtgtcgccggtgagttttctctcccctccgactcaggccggcgtggatggtcgccgtgagggtttccctccatcctaattcctcctctctttttccctaggtgtcgccgtcgctcgtccgcacctcggcatcgccggtcttcgccgtctccctcgttttccaccgccggccattgccgcccctccggtgaggtctccctccccttcctttccttcttttttttccccgtgcgccgccgccctcttcgcgcgctcgccgtcacgttcggccgtcgccgctcgcgccgccgcccaccatctgcgccgccgtttgccgtcgccggcggtcgcatgcgcgcgccgccgctttgccatggtcagccggctggcttgatgccgggccaggccggtacaccggcccgtggagccggggccgtggggcccgcttgccagccgtgccctccccttgagccgctgccgagtggggcccacgtgccgccgccccttcccctctctcccgagccactgaccagtgggacctgcatgttggcgccgcccccttgatgacgtcagccctgggaattattgtgcaataaactatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcaccgaggttcctccagcagcagagcaagacaagtcatgcttgtcacttgatcatgttgatcctatattgcaaatgttctaatgttttctttcaaatactgcatttgttttgcaatatcactatgggatgtttacctattgttacagccatgctattttggtaccctgctcctttgttagctcgagttataacatgaatagacgttggactagcagttgcttagccatgcttagttcaactagcacataatggggaaatctcatttaaaatatagactgtaggttcatatgataatgttggtttagtaccaccgctttggtgttggttaattaaaatgaatcacatggcgggctgtgggtgcatggttttgcttgtcgcacccatagcaattaaggaccggttcgcgggaaaccctggaagaatttatcgtgcttaccacaagccagcgtgggcaacggctgggcttgtagtgtagctttgctctagctgacgcatccaggcaagggtgggcgtgatggagtttggatgggccctgcgacggcctatgcagcttccggattcacctaggcacgagtggggactgcccgtcacccgctggggacgggggtgaaacctgaggtgtggtgtgcttggctagagggggttatgcaaagggtcctgtcacagcctctttccagtatgtcgtggtggcatgtcggcgcacgaaaacgtgtcgtggggctgtgtcttgtgggtacagttgtacacctctgatcagagtaaaactattcgaatagccgtgcccgcgattatgggcgatcaaccagattcaccgtgattagactcaccctggtttagtctaatgaaattggatagtataggtggatggttgggccagtcgcaacgtggtatagcgttggacagtggatgaataatatgattaattataacaactgtttacttctttcaacttctgtttataaatgctcgctttatgcaaatgaaccactctagctctcctttgataattccctgcatcatacccccattccggtatgacttgctgagtacaatgggtagtactcagtcttgctctattttccccaaccccagagtttgagtatgtgtccgatggtggtttcttcgaggagtaggcttcgtccgtgtcgtcgaggatgcctgtggagtggtgttcccgctgcagttcaagtcaaggcttagctcctgttatcttttgttttccgctgcatttttgtaagacttttatgatgtttgtaagacgtggatctgaatgtcaacattgtcgtttgtgtaccccggccggtcctggacggggattttaatgcacattctgcttggaattctattcgggaatttctgggcgtgacaatacccccgggaatagttccacctcggtacaattcagcccttctgtaacaatagaaatccagagatcaccatttctagccaacctcatccttctcgaatccaaagacccagatgtcattcttgggatggattggctgactaagttcaagggtgtcattgattgtgcgaatcgcacggtcaccttgaccaatgagaaagaggaaacagtggtgtacaagtcaccagtcgcactgaagcagggaatctccttaaatcagattgaggtggagaattcggtggtcaccgaggagaagagttggaggaaattggaagatatccccatagtctgcgagtatccagaggtgttccctgaggacctcactactatgccacccaagagagagattgaattccggattgatttggcaccaggaaccgccccaatttacaagaggccgtacagaatggcagccaacgagctagcagaggtcaagaaataggttgatgagtacctgcagaaaaggtacattcgacagagtacttcaccttggggtgctccggtcatttttgtggagaagaagggcacagccgaagagaatgtgcgtcgattatcgcgcactcaatgaggtcaccatcaagaacaaataccctttgccgcggattgatgatctgtttgatcagctgaaaggaaccaaggtgtttttcaaaatagacctgcgatcaggctaccaccagttaaggattcgggaagaggatattcccaagacagccttcaccactcggtatgggttgtatgagtgcacggttatgtcttttggactcaccaatgcacctgcattcttcatgaacctgatgaacaaagtgttcatggaatttctggataagtttgttgtggtatttattgatgaaattctaatctattccaagtcggaagaagagcatcagcaacatcttcgtctggtactcgagaagttgcaggagcaccagctttatgccaagttcagcaaatgcgacttttggttatcagaggtcaaattcttgggtcacgtcattacagctcagggcgtggcagtcgatccatcgaatgtggagtcagttaccaagtggagcccacctaagacagtgtcacagattcggagtttccttggacttgcgggttattatcgtcggttcattgaaaatttctctaggattgccagacttatgactcagttgcttaagaaagatgagaaattcaagtggacagccgaatgtgacaagagttttggggagctcaagaagaaattagtgtctgctccaattctgattctgcctgacccgacgaaagacttccaagtctactgcgacgcgtcccgtcacgggcttggatgtgttctaatacaagagggcagagtggtcacctacgcctcgcggcagttgcgtccacatgaaggaaactatccaacacatgacctggaattggcagcggtggttcacgccttgaaaatctggaggcattacctgattggcaaccgctgtgaagtatatacggatcacaagagtttgaaatatatcttcacccaacctgacatgaatctccgacagcgaagatggttggagttaatcaaagattatgacatgagtattcactaccatccaagcaaagccaatgtggtggcagatgcattgagcaggaagagctactgcaatgctttgtgcaccgaaggcatgtgtaaggaattgcagcaggagcttgaacatctcaacttgggaatcgtagaacacgggtttgtggctgctctagaggcacggcctacgctcgtggatcaagtcagagcaactcaagtaaatgatcctgagatagctgaactgaaaaaagaatatgagggtcggaaaagcccgggatttccttgaggatgaacatggcacaatctggatgggagaaagattgtgcatacctgatgacaaagagctaaaagatctgatactcaccgaggctcaccagactcagtactccattcatccaggcagtaccaagatgtaccaagatatgaaagaaaaattttggtgggccagcatgagaagggaaatagctgaattcgtcgcgctctgcgatgtttgttagcaagttaaagcagaacaccagaggcccgcaggattgttacaacctctttagatcccgaaatggaaatgggaagaaattggaatggatttcataacaggtctgcccaggacatcatcgggccacgattcaatctgggtagtcgtggatcgacttaccaaagttgctcatttcattccagtgcatactacttatataggcaaaaggttggcagagctctatctctcaagaatcatgtgtttgcatggagtacccaaaaagatagtatctgatcgagggagccaattcacttcaaagttctggcagaaattgcaagaggaattgggaacccgtctgaacttcagcacagcctaccatccgcagaccgatggtcagaccgagcgggtcaatcaaatattggaggatatgttaagggcttgtgcgcttgattttggtggagcatgggacaaaagattgccgtatgtggagttctcctacaacaacagttaccaggctagtctgcaaatggcaccgttcgaagcgttgtatggccagaagtgccgcacacctctcttttgggatcaaaccagcgaacgtcaactgttcggaacagaagtgctaactgaagcagaggagaaagtcagaaccgtcagagagatgctgagaattgcacagtctcgatagaaaagctacgtagacaaccgccgaagagagctcacttttgaagcaggggattatgtgtacctctgcgtcactccgctccggggagtacaccgcttccagacgaaaggcaagttggcaccacgcttcgtgggaccatacaaaatcttggaacgaagaggagaagttgcatatcagctagaacttccatccaacatgatcggtatccatgacgtgttccacatgtcccagttaaagaagtgtttgagggtacccgaagaacaagccgattcagaacacattgacattcaagaagatctgacttatgtggaaaaaccagttcgcattcttgagaccagtgaaaggaggactagaaacaaggtcaccaggttctgcagggaccagtggagccaccactcagaagaagaagcaacctgggaaaggaaagatgagttgaaggccgcccatccatacctcttcgccagctcttccgaatctcggggtcgagattccgtttaaggggggtaggtttgtcacaccctaaag

SEQ ID NO: 8339 - DNA, 173 bp, Oryza sativa
cctctctctctctctctcccgcgccgcttagtcgccacgccgccgcctaaccacttagccgccgctcgccgtcggtcgccgccgtctgccgccgctgccccacggtagcgccgccatgcgccatggccgccgcctagccacttagccgctgctagcatcgcccgcgccgatgc

SEQ ID NO: 8340 - DNA, 227 bp, Oryza sativa
cgtcggcgtcggcgttgtcggcgttcgtcggtgaaagagagagagacagagagctacatcgagagagagagagggcgggggctctcacccaagagacgtggcggcggcgtctgcggcggaggcggcgaggaccgccaggtgacggtgagagacgacggcggcgtcggagcggggttggcctaggcagtggcggcgaaggagaagccgatgctcgatctcaatggaaa

SEQ ID NO: 8341 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnnnnnnnnnnnagcagtggcatgggctgctgcatcgtcaccttacggagacctgtccgggctttcagagtttccatcactcagagagaagcaacgcagcctttccaagttgctaatgctagtactatcaaggttttcttatcagaagagagtacgacctaccattacaattttacaataggagatctcctctccgatgagataaatgaaaccactgttgcatctacttcggcgtacctatcaacctttatcgcagaccaaccaaactgtacaatagcgcagaaggatcctgagcggtatgcttgtggtgataacaaatgtttggatgcggatgacgaaaatggaggctaccgttgtgcatgcatcaaatatactaatagcaatccctacctcgacggtgactgcgaccaaggtaactctaactgcatgtttacttacaaacatactacctcccactggtggagaaatcgtttgtaattccggttcgtaaccccccttagtcccggttgtccaaccgggactacgaatccgggactaaagatcgatttttagtcccggttggtaacacgaaccgggactaaagatctatgtaccattttttttatttgcatggccctgtttgctgcatgggtgattatatatatatatatatat

SEQ ID NO: 8342 - DNA, 8970 bp, Oryza sativa
gtacgcgtcgaatggtcccaaaaattggctcctcacccttgcgcaaatgaagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcgataaatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatcttattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtgggggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgcaatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgattctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctgggcagggcagggcagggcagggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcgataaatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacagtgggcatactcgcatacgtagtagccgcataagttagttcccttgacctgctttgcacactacatgagaaacgatgagagatttaatatactctttatattaactgtaactagagattcaattcaatataattttggatcatgcatgtactccctggaaaatgaaacctccgtccaagttttgctttccaagtcccgcggaccaactgacggaaccgatcccaagccctacatgtgcagttgcaagctatgattaattaaatattacccgagatcaacataatagcaacagagtcccgcgactttgaaatagatggcattatattacctgtctatcagttggaagaccttgtcaaaaaccttctcctctttattcattgagtcgtacacagtgactctgcatgcgtccaagtcgaaaaagaacaggacccagtggaatctggaatatgcgtgagatgagataaatatcagaatgtacatgttatatgtatgggaatgaaatttgttcgaacgacaataaaaactcactctgtgttgtacggcaatagtatgaacgtcttgaaatgctgctgcgttaggagatggacaagattgtcctctgtgtctttctcgtacttgtcgagcatttcggtgttgattttccgagggtcgatgaacccagtattgtaaaccccccgccgtcgggccctttgaatctccattctacaacaatgaaaggaaattattattgcttacatatatgccaggagctaattattgaacgaaacaaatcgaactcaaagatacttacaaaatccatacgcttaaaagagagacgtcgagggcgtcccgatggtacagattgaagacatccttgaaatggatccatagaacatcttctccttgcaagaagttggggtttctgatcctcgctccgaacatctctctaccattggcgctcatttccatgtaccgttcatggaatttgtacatttgtgtcggtagggactgcagctgctcaggcctgacaagcggtttaccgagttcaaacttgtatgccacttccgccttcgggattggtgcgcctccaaccaactgagccatggttagaccggtgtccgaaatgaaatccgttatgccaaagtcttcgccggtcaccaacggctcgaccacttggtgtggttgttctccaagctgaggaactggtttggacttcttgtaataggctttcctaagtgttcggtcatagtccgatagctttaaggcctccttgtttgcggtggacatttccttgaagaaattcttcacgctcgggtcaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggtaggaggtggagcttggcgagaccttgtcttgggaggtgcaggcggacacggtggaggaggaggcggaggagccggaggagccggaggagatggtgcaggaggaggtggcggaggagccggaggagatggtgcaggaggagacggcggagccggaggagatggtgcacgagatgccgcttgtcgcccaaggaggatgatgtaccgcttgcgccatagtataatggtgtggcttgtgtctcgtagatgcgtctcaccatctcctcctgggtagtccaactcgaggtcctcgtacacggcttccaccagctcaacttcgaccctcgagtatcctgctggaatcggcctgcagtggtaagtccctgaaatgtccgttgggatggccattcctgacgccaccttcacgtgatgagaggttatctattagtaatcaacctaagcagcaacttgcggaacgtacgagtcaaaaatcatatattacatcgagcataccttgattgataagttcttgaagggaatatgcagctcacatggtgtccgatgcgtgatctcatcaacggggcaggtggtttcgtcctagatttgcatggcgtccatgctatgtgatactacctgccccgttgaggcgcagctgctacgattgcctgatgggctgaccattgaaggaggtatgtacggctagggatcgtgtgaccgatgtgctgccatgcgttcatccaccttccgggccacctcctcttgcatgctgagctcgtagctcgataccctgtactcaagatctgcaatcttcgcctcggtatctctcttgctcctcatccgactcctgtacgtgtggatgtcctccttgaatcccatcttccagggaatcacgcctttccctcgtgttcgtcctggatgctcgggagtctgtagggtgagtgacagttcgtccttctctctgtcgggtcggaacgtgccctgagaagaggcttccactgcgcccgttagtcgattcgcagcctcgcgtatctgatcgctgaagaccaaggagccatcaactgggttgagcgttccaccgtgagcatagtaccagaactttgatcgattaggccatttagcggtggccggttcgatacccatctcaagcaagcttgcctctatctcctcccacttcggcatcgcgacgctatagccgcctgaccccaagtggtgatggtacttcttcttggcggcattttctttgtttctttccatcattgcctgcccttgttgacctgtcttgtaagcaacgaacttgtcccagtgatcccttagcttcgggaatacgtcaaagttcggtg

SEQ ID NO: 8343 - DNA, 3831 bp, Oryza sativa
attaaattgttaaaaattgtaactaacatatgtaaatcccacatgcatgatttaaaacttttaaaaattctaataatcgtatataattagcatattcatgatattaaattgttaaaaattgtaactaacatatgtaatcccacatgcatgatttaaaacttttaaaaattctaataatcgtatgtaattagtatatgcatgatattaaattgttaaaaattgtaattaatcatatctaactagcatattcaatacattcaaaatagtttacaacaattacggcaatagatcggcggtgacggttgtccgcacgtactttctcctcactattgttccttccttgtaatcgctacgtgagtaaagggtgtcttcgtttgataggaggatgctagggtcaaccatcaccgtgaaagggggttgcctatcaaactgatcgtaatcctcgtcagtcttgtcctctactccgacagtttttcttttgcctgggagaaccacgtggcacttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaatccattggcaccggaacagagggaccttgagaggtccatagtcaagttcccatatctcctcgatggcaccgtaatacgtgccagttgtaccatcgtgtcccatggcatcgatacgaacaacattgttctggttcgtgctcttcatgttttgggctcttgtgtagaatgtgtacccattgatctcatatccctggaatgtcgcggtcgagccagatggacccctcgccaggaaggccagttgctagttaatcgtctcgttacccatgagatgttgtcgcacccatgtggggaaaatataaatgtgatgccgtgtaatccatgcatcggacttaccgatgtttctggcgcgaactagagccaagtgctcctcgatgtaaggagccaccaatgaagattgttgtaaaaccgtgaaatgggctttacggaataaattgttatctaccatcattattgctttccttccgagagtcccctttccccgtagtctcccttcatggcgtgattcaagtaccccgattgggcgaaggtcttcaataaattctacgcagaattcaatgacctcctctgttccataccccttggcgatgcttgcctctggacgagcacggtttcgaacatacttcttcagaatgcccatgtacctctcgaaagaaaacatgttgtataggaacacaggcccgagaataccaatctctttcactaggtgacaaagtagatgcgtcattatattgaaaaatgaaggtggaaatatcaactcaaaactgacaagacattgcaccacatcattctgaagggcttctaacctatccggatcgatgaccttctgcgaaattgcgttcatgaaagaacatagctttgttattgttgcccggacattgtctgggaggataccccttattataactggtagcagctgtgtcatcaacacgtgacagtcatgagactttaggtttgtgaacttcttctccttcgtgcttattattcgctttatattcatggagtatccagacggtaccttgatgctctccaagcattgaaacatactttccttctctgccttgctaagagtgtagctggctggactcaagtaatggctgcctttctcctgtggttccgggtgaaggtcaccgcgttgttccatatgcttcagatcattacgtgcttccagtgtatctttcgactttccatatacacctaggaagccaagaaggtttacgcaaagattcttagtgaggtgcatcacgtcgattgcatcgcggacgtccaagaattcccaatagggtaacttccaaaatatggagtttttttccacatcgccgcgtgaccatcttcgctctctataggctagctgccaggcccctttccaaacactactttaagatctttaaccatagcaaacactatttttccgctgcgatgtttaggcttcgtacggttgtccgccgtatgttcaaagtgcttgcctttcttccgtaccgagtggtttgctgcaaggaatcgacgatgacccatgtacacaaccttcctacagtgcttaagatacgtactttctgtttcatccatacagtgagtgcaagccttgtaccccttgttggactgcctggataagttgctaagtgcaggccaatcgttgatggttacgaacagtagcgctcgtaggttaaactcctcctgtttgtcctcgtcccacacggggacaccttccttcttccacaacagtttaagatcttcgaccagtggtcttaagaacacatcgatgtcgttaccaggttgcttggggccttgaataataatcggcattattatgtacttcctcttcatgcatagtcaaaggggaggttgtagatacacatcgtaacgggccaagtgctatgaccgctgctcatctctccaaaaggattcatgccatccgtacttaaaccaaaccgtatgtttcgtgcgtcatttccaaagtctttaaattttctgtcgatgtttcgccactgcgaaccatctgcggggtgtctcagcatcccgtcctgttgacgttcttcagcgtgccaacgcatcattctagcattccccttgttcctgaacaaacgtcttagccgtggtattatagggaaataccacatcaccttagcaggaattctcttcttcgttagctgcccgtcaacctcacctggatcatctcgtctaatcttgtatcatagtgctttacaaacagggcatgcttctaggttctcgtactcctcaccgtgatataggatacaatcatttggacatgcgtgaatcttctgaacttccagtcctagagggcagactatcttcttagcctcgtacgttgtctcgggcaatttgtttccctccggaagaatgttcttgacgagtttcaataaatcgccaaatgccttgtcactaacaccattttttgccttcctttgcaagaactccagagtggtatccaactttttgtgcccctgctcgcaacctgggtacaacgacgttctgtggtcctctaacatcttgtccaatttatgggcccccttttcactttcgcagtcctccttggcatcctgcaacatctgaccaagatcatccgcaacgtcgttataatcagcatctatgtcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattacatggacaacaaataaaacccttctgcttgttagcttcggccactctcaaaaaataatgcacaccatcaataaactctttggaccgccggtcagcgtacatccattgccgatccatctacatgaaatgaaaaaaaaatcgtacacaaataatcattcgtataataatgacagtcatacaataatgataaaataatcacaaactctttcaacagtcatacaataatgacatatcattattcatacaaaaattataaaatattccaccgaataattcttatttattattttttaaagtttaaattcttttaattctcaatttagtttgttttcttttattta

SEQ ID NO: 8344 - DNA, 10778 bp, Oryza sativa
aaccggggccaaagatcccgggggggcctgacaagccctgacagcatttgaaccgggactaatctgttaccaaccgggactaaagatcaaatatgcccgttaccctttttaaccgggactaaagatcatctttagtcccggtttttgttgcaaccgggactatcgtggaattcgaccgaccgacgaaagatggtttctccaccagtggcacgtacttcgtactgatgtactccctccgtccgtcctataatataagagattttttgagtgtttacttgcgctgtttaaccactcgtcttattcaaaaaaatttagaatcattatttattttttttacttactttattatccaaagttctttaagcacaacttttcgttttttatatttgcacaaattttttgaataagacgagtggtcaaacagtgcaagcaaaaactcaaaatcccttatattatgggatggagggagtagtagttatatgtggccttctttaaagttacactttaatttggacctattcttattacgtaagttgcatattggactaggtgatagcaaatccgttcactttatagaccatatctattctattatatacttaaaagtccattaaacttcttacaaacgctcttaaaccgctacgtggcacttttacaaacgttcctagaccgccacgtgacagcgtctaatctcaccgtcgatttttacttaaatcgatggacccgataatttagaccattagattagattagatgtattttatttaaaggaatcaaatactatactgttggcaaaaaaaacaaaaatataagtactccataaatacgtacgtacgactgaaaaacaatcaagcttacgtcactcccaagccgccaggtgggactcagctcctaagttatcaaatggcgttataataaattaaaaaaatctgttgattttttattaaatcggtggacccattaattttaaccattagacctccctaaaattaaaaatccggtagccttcacctccactatacgtccgcaagtacgtactccctccccttccctctgtccaacctccaactctccccttctctcttatttttagctaactttcttaatattaagattttcaaattacgttaatctaaaaaaaatcatacgtagaaaatgtgctatatctcttcatgtggacgtgcacgtacatatgtacgtaccctctttgttctttctttcttttttcttttctccccttcttggttagatgagatagaaaatcaatattcatattaagtatattttaagttgcaaaaatacagtctaaaaaaatctagaaaatgtgagaaaaactaaaagatctaaccattattttttatttaaattgatggatccgttatctcggaccattagaataaatctattaataatctgtcctaatctccatcaacgtaacgactagagaaaggtacgtgcgtacaacttataaaaaaaccgaaaatacatatacaactgtaatgtaacgtacagtttaaaaatataaagtgcaaaaaacataaaaaaaatcaattacttatatcattaaaacgtacatttgcttccttcttctctcctcacgtatagatgaaatcgtaattattattagtgataataaattttaagaaattataactttataaacataaattatacatatcatcatatatatgtctaattagctccacaatgtttggaaataaattttataaaactatattattttacccatgatattaacaatataatattttttttgtttacttaaaccgttgtacctattatatcaaaccattattttgtatcaaaaattttaaaaacacgctgtttaaaataaatgttatgcaattatgttttgtaccattaacttaccaatttatgatctatattaactaattttaatttaattagtgaacactgtattttatactatttttaataaaaatatcttgcccatcaataattttcaaatacttatagtttcatttattaccgttatatcttatattatctcagctatagttgtagtcctgtagatgtgatagatggacgcttaaagttttttttaaaattttctattaaagtggaaatttctagagttttctctaattaatgtgggaacctttagcttttgtgttgttgaaaactgatgttggggattcttatacaagcatttatgaaaatctatcaaagcttttagaattgaaagtttagcttgttttctaactagttcaagcaaatttcaattgaatgtgaaactataaattatttgttagtgatcgatcgtttgattgtaggtatttgtcatgctaatatttcgtcctctagtaatgtgattaaaacttcaaagatctttgaatttgagttattttctctaaagttatgtgtatcatttgaaaaattactaagacattatctgttttcaaaaaaggctcaaatttaatctaaatgtgagtatttgaatccttcgggccccattgtatatatagtattttatatatatctttgttactgcttggccagaatataaatgttcaataatatatattttttaaaaaatggaacagggtatgaacccactcgaaacaggcagaattgttctaggtcatgtggcaatatgactattcctttccccttcgggctccaagaagaatgctccgcaaatagaaaattccttctgaattgtacttccaagcaagcatttattggaggatcatacacgcaatatcaagtgacgaatatttcactagatcaagggcttctgtttgtcaacttttctcagcacgaagaggcctactcagaattggtagaaataagcagagataacatctcacagtgggtggagtcctggattgacgaattcaacgattttgacgtctctcagcattacggtatttggaagtggtttgtgaccaacatgacttgtgaaaaggctaaaaaatcatctgcttatgcctgcattagcaccaacggtgagtgtactggtgtcacgcatggacatgtgcatttgggatatcgttgcaagtgctctactggctacgaaggaaatccgtacgtacataacggttgcataggtaagaaaccagtttgttgccaatatcgacaaaaatcgttattatgaacttcaattagtagccattgtatatttgttttgcagatattgacgagtgctcgatacccaatgattgtaagggaatgtgccacaaccaagcaggaggctacagttgcactcgttgccctcatggcacatctttcgatccagccgaaaggaaatgcacttccaccaagcaacataatattgtcttgggtatttctcactttaaccgatcccttttcaataagatcacagtcaagtacgaagcataaccatattaattacctatgtatgtaggaattgccagtggacttagctgtggctttggagtgttaattcttaccttaagtgtgacaatgttattttggaggtggaagagaggcattcaaaagaaaattagaagggattacttccataaaaataaaggtttactattggaacaattgatttcttgtgatgacagtgttgcgcataagacaaagatattttctttagatgaattagagaaggcaacaaacaattttgactcaacacggattctcggtagtggaggccatggcactgtttacaagggcattttatctgaccaacgcgtagtagcaataaaaaaatccaaaattgtggagcagagtgagattgatcagtttgtcaatgaagttgctatgttatctcaaatcatccatcgtaatgtggtcaagctttttggctgttgcttagaatccgaggttcctctacttgtttatgagttcatatcaaatgggacactatatgatcttctccatggtaatttgcaaagcaaatgtgtattaacatggtggaatcgcatcagaattgcccttgaggctgcaagcgctcttgcctatctccattgtgctgcctcggtaccaatatttcatagagatgtgaaatctgccaatatacttctcgatgataatttcactacaaaggtttcagattttggtgcttcaagatctgtttctattgatgaaactcacgtggtcacaatagtgcaaggtacatttggatacttggatcctgaatattatcatacaggacaattaaatgagaagagtgacgtttacagttttggtgtaatacttattgagcttataacaaggaaaaggccaatcttcctcaattcaattggagaaaagcagaacctgtgtcatcactttcttcaaagacagcaaaacaataccacatcagaaatagtagatgtacaggttttggaagaagcagaccagtgggaaattgatgagattgcttcgcttgcagagatatgcttgaggcttagaggagaacagagaccaaaaatgaaagaagtggagctaaggctgcaacttctgaggagtaaagtagcaaagaagaagaatagagtagaagtaagcagggaaaatgaaattgatccattactgctttatacgcccagctctagttccgtgaacccaagggattttaattcggcaagtcacaatgatgccactcgatgctacaccatggagcaagaattggtttcttggaccaatttacctcgctaaatataacattactttttaagtaactcggtattttttaatagctaaacatacaattcaacacctaccttaaataatacttaaaatgaaacattagattactctctaaaatttgaaaacactattgtggtgtttgtttattgtatcagtctattggataagacaaaattatcattttttgtattattctatacactaggaaggtggcccgcgcgcatgcgtgggcacttgtattattgaaaggtaagtttagtgtttgttcaaaaattttgcctcaaattaagagcaaactaacgttcggataatgttattttataataatttaagagttctatttttcttaagatattttaaaaaaacattcacaaacttttgagtaggagatggattgagtacttgacttttgaatcatggttcattttctcgagtaaataataaactattgctagttaattatcagacagttcatctatatacataccgtgtagtttggccacaaataaaaaatgctagagcaaactaatcaaaattcttataagtaaatagtctcttgaaggcatatgatatagtaaaaaatggagagaagtgtatgcatggaaaaagaagaaggggcaaatgacaaaaaaggaaggggaagcatacatacccatgtacgtaggtgcatacctatgccacgggaggagaggtgggactgtgaaggtagagaggtcggacctcgtagtatttagtttgttctaagatcaatttaatctaacggtttataatataggacctaccgatttaagtaaaaatcaagtaatatatactttgctttttttctcttagaatttatgatattttctctaatttattagagcgccatgtggtagctcgagagcattttaaggaattttaatggacttaacacatgtaattcgtaaattaaccgtgtaatatatatgtatgggactacggtaatattcgttctagctttgtccatgtttatatatatgtacagagaaattaattatgttgctagcaagccattagatgtctaattaatagcaattaattgtgacacatatttacaattgttcatagtagctcttacatattcatcctatgactttgattatccattgatcaccatgactcacacgaaaaaagaatgtactacttaggggtttaggacagctgaaattgatgaattatctaatttacgtgatagctatttgaggatataaacgaatgatttgacttctaaaaagttaaaaaattgtttaaaaaacaccatttagaaatttcaaaatatagaatcagaaaaaaaaataaagccttaaacttcattttagcactcttgtcttagtaagagttctatcgatattcgttaatactattctcatatttataacataatgatttctttcacctgtacgaacaaatagtacaggatccaaatacgacataacacaatacattataattattatgtaatcaactctcggtttcagcttaaacgaagctatgtgttggaaaaaacacaatggtgcttaattcttctctcgctgcataacacctttaatttttctttttatgttattaacaaaattaatcatatccatatataatttgatatgtagcaaagctgtagcgctgcaatggtcgtgatcaccttagatgcctcagacatgatgctttgtcatgcgtgcaaaaggtaaaattacagatgtgcattgtgcaacggaccaaaaagagaactttagacgttttaattattagcaaacaatagatccgatgatttaaataatcggtacacgggttctaatgtaaatgtaaattagttaatatagattttaaattcttaatttaatcggtgcacagtataatggtgtaggctttattttaaaatagtgcattatttgagaataatagtccaaagtaataaaaggatagatccaataatttaaataatgggtccatcggtttaactgcacgtataaattagttaatatagatcttaaattgtttatctgataggtacactataattatgcaaactttattttaaaatattgcattatttgaaaataataatacaaagtaatgagtacactagtttaggtggaaattatcttacattaatttgatgggtaaacatataatggtctaaattttattttcaaaaactgtagagctaatttagttacctgtgtttataaagagttatatgatggtatattctttgtatgtaaaattatgattattctgaaaaatatataccaattatgtaaatggaaaaaagaagaaaaaagggggaaaaaagggaagggagggaagcgtacctccctatgcgcgggagaaggaggggaggtgggacccataatatttggtttgttttaaaatcaattttatctaacggtgtataatattggatccactaatttaagtgaaaatcaaggaatagatgttttgcttttttattagaatttctaggattttctctattttataaaagcgccacatggcggctcgagagcgtttataggaagtttcatgaacttttagtatataatttagtatataatagatatgcttaaatccattggtttgtggaatatatcttcggacttgggaataatggatttggtaagtgctgggactaatgcatgtgcgcacatatataacttgactgcatcaactcagcaataatttatctgtatgagatagagaatggtttgttgacagtgattgattttacttgtagtatcacccacagactctcagtcctcataatgtaagtgattatgccttcttttttacaaaattaaagaaatatcaaaagaacttatgatgatataaaaggtgatgtcggtgatatgggcccgggggtatgtgaagtatggggaagtctccttcccgtctagtcacgtggccctacagcctagctctccccccacacctcgaacgacgcagaggcagccagggggcctcggggtgccacgtcacacccctcgggtcctcgcgctgcctcgcctcgaggccctcgcccgaccgccatgtggcgaggggagtgagtggggcggagacccaggctgaaccgccatcaatgcaagggcggatgtgcggcgctgcccgattgacccacgtcaatcgggcgtgaccggattgtgaccggcctgtcgccggtcacgtccgatcggacgggcggaggtgcccccacatcctaccctgtgctcggtggagtgggggcaggtatgccccgtcccatcaaagcatcatctggagccccctccacgtgagatgaaccgccgaaagtctccattcatttaaaggagaatgacaaggatgtcccccatgtcaggcggggggcggcgctgggccccactcgacaacggacggctgcttagcttccgagcgaaggcacgaacggtggtccgatccaggcggagtgggcctcccctcccgtgaaagggtaggtagaggcggtgcatgtggtatccccttgaactataaaaggaggaccttacccaccgaaaaaggggacgactctcagttagcctaaaccccaggggaagaagagcgagagtgctccctggagtttaggaacctttgtaacactcaaccttaaaatcccacgcacaggagtagggtattacgctccatagcgacccgaacctgtataatcccggctctcgcgcgcggtctcggaagattctaggcggacacacgttctcgatcaacgcgccctttcccccagccgaactcacaaaaggggggtctctcgatctcccgctagagaggatcattcatcgacaggtgatatgtgagggaataaagtagtataaaaggtgtgttggtggtaggtcatcaggcactataggatgaggatatccaactttgctaatcttgatcattagcaattggtttgcgataattattcaattttgttgttaattactgttgaaattataagcacataatgatttaatttattccataaataaatcatgacattgcagatgtaaactagattgaacgcatcattagatctacacatgtaaactaagaagtaaaacatggacagatcaaatatgcgcaacatgtcgaacacgtaccgaggtggcggaaagaccggttgctcggtaggaactactcgcggttgtaagcgtcgacgaagttgcgaagcacacgagtggagaggaaggcgagctgtcacggatgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagcctacgagcgacggcgcagtacagagtaggaggcaaaccctagattgatttcgtgtgtgttgcgtgaagacggcgactaggtttatatagagatagatcgcctaatcagggcgcccgcgtaaaccgaaccggataagtcgcgcgtaacttatccagactccatgtcgttttcacgcagcggatttttcggaatgtttccaaaacaaaacaaatccgaatcccgcagcaaaacaaaactgcaaaaggaggctgcatctgagcaagggtgaggagccaattttccggaccattcgacgcgtacgtcgtgcacgcgcgccgcctgccctgccaggccatgccagggagcgcacacgtgtgtttcccctcttctctccaccacacatgcttcaagtggctaggagggcatcctcccttttaaggaggtcccgctctcctaaaataagcaaggtgatactaaactccacatgcatgtcatcccatgaggtgggcttttgtaattttccaaagaattaatcttcgaatgggctaaggcccatccattaattccaacaattactcccttcgtctcataatataagggattttgaatttttgcttgcaacgtttgaccaatcgtcttattcaaattgttttgaaattattatttattttatttgtgacttactttattatctacagtactttaagcacaatttttcgttttttatatttataaaaaaaatgaataagacgagtggacaaacgtggcaatcaaaaactcaaaatcccttatatcgtgggacggagggagtagtaattaaattgtcaatgttgactagatatagttagtctattttattgttaattagtacaatttatgataagattaatgataattaacgtatgttattattagttaatagtttattgttttcattcatttaatcatcatccatctaaccaaacaagactctgctcctgagttttaccctttcaataactaaaacacccttgttgtggagagagaggggagcgtggaagaggggcgagctggatggcaacagagcctattcctcggcagcagctgtgctagagatggcgagcacgcgggcgagcgagcaagcggcggtgctagagatggcgagcacgcaggcaagcgagcaagcggcgctggaggcagcgagcagcgagtaggcaggtgtcacacctgaagttcttctcccaagccaaaattgaatttataatttgtctcgagaaaataccggcgtaaaagcaagagtgaaaccctaaacaaattaatgcaaataataatcggaattggcatgtggaatttttcttgagttctacatgtcgaaatgtgctaacaagatttttagtggaattttcagagctccagaaataattttaaccaattaaaattgagcacaagcaatatttaatccctgaaaattcatttctttctttttctttttcttttcccccttttctttttgaatgggccgccggcccattttcctccccctcccctccccgctgggctggccgaaggccacggcccaactgagccggccgcctccctcctcccttcgggtcgccgataggtggggcccatctgtcgggcccgtctcccacctccagccggcgccaccgcatcccgcaaccgccgccccgctcgctcccgcgtctcccgagccacgtcgcccacgtcgccgcccgcgcccgctttccccgcgcccactccctttttctcccgcccgcgcccgcgctcgagacgggcgggattcaatttttgaatcccgcctctctctcctccccac

SEQ ID NO: 8345 - DNA, 675 bp, Oryza sativa
tatccccttgaactataaaaggaggaccttacccaccgaaaaaggggacgactctcagttagcctaaaccccaggggaagaagagcgagagtgctccctggagtttaggaacctttgtaacactcaaccttaaaatcccacgcacaggagtagggtattacgctccatagcgacccgaacctgtataatcccggctctcgcgcgcggtctcggaagattctaggcggacacacgttctcgatcaacgcgccctttcccccagccgaactcacaaaaggggggtctctcgatctcccgctagagaggatcattcatcgacaggtgatatgtgagggaataaagtagtataaaaggtgtgttggtggtaggtcatcaggcactataggatgaggatatccaactttgctaatcttgatcattagcaattggtttgcgataattattcaattttgttgttaattactgttgaaattataagcacataatgatttaatttattccataaataaatcatgacattgcagatgtaaactagattgaacgcatcattagatctacacatgtaaactaagaagtaaaacatggacagatcaaatatgcgcaacatgtcgaacacgtaccgaggtggcggaaagaccggttgctcggtaggaactactcgcggttgtaagcgtc

SEQ ID NO: 8346 - DNA, 264 bp, Oryza sativa
  unsure (1)..(264): unsure at all n locations
nnnnnnnnnnnnnnnnnnnnnnnnnnnnnnnnnnnnnnnnnnnnnnnnnnnnnnnnnnnnnnnnntgtgacaatcaaacggtaattgtcaaagtgaatagttctaaggataatatcaatcgtctagacctgtgacaagacgattgaggtctgtcacgaaatcaaaaaactccggagctataacgtcggattacatccatacagcgagaaacctgtcagatcccttcgccaatggactatcacgaaatgtgatccacaatgcatc

SEQ ID NO: 8347 - DNA, 749 bp, Oryza sativa
  unsure (1)..(749): unsure at all n locations
nnnnnnnnnnnnnnnnnnnnnnnnnnnnnnnnnnncttatgataatttgcctcgtttgttagccaccattgcccagaggaataataatacttactatgacctacatacatttacatcgggtgatgatcgaacaaagagtgtgctgcaaagagcatttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaaccaagcaaacagatgagcaatctcgcagaccacaagttgaaggtgacgagccctccatacctcttggggcattacatgatgacccaccaacaatgagaaggaggtcagggt

SEQ ID NO: 8348 - DNA, 21748 bp, Oryza sativa
gccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaatgctgagtgcccaagttttttatgttccagatccatctaagttaagggtgaaaaagggtcgacgccaaactagacgcatcagaaatgatatggatgagtcagaagtaggtgggaggactttacgctgtagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgaaaggccaaggcgtcgtcgcgcagcaggcgattccatggtgtaacaatgctatcgatttaggaaataaaacgctgttgtgatgtgatgtgtgttcggacaaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagctattgttgtaatcagaaatattccgtatggtgacacttttgtttgtttgtactcttgtttaatatgtgttagtaattcgcttatgaacatttattacttatgttgactaattatttatatgtttctgaccaatctatttgatgcaggtatggcgtacgacacaccggcgctgttgaaccgtgggattgacaggaaccaccgctcgttcctgtcagcagtcgagggtgcatagctcggcaccttccgtccacgcacgtcgcgcgagtggttgcgtgtcgacccccgtcacgttccttggtacgcgtatgttcacatttcaactcaactttgctttgtgttgtacttatgtttgaaatttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcagaacgtgtcgtacctgctcgggctaccgctggcgggagcaccagttggtcccgttgacggtgttgttgggtggaaggaggatatcactgcgcgcttcgagcaggtgatgcgccttccacacctaggaccggccaacacccttcctccgtactctacagtcgggcctagcaaggcttggttgctccaattcactgtaagtaaataagttgttattatcagacatgcttatttgcgatcaacaaagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgctgcagtggagctggggttctgccgtgctagcagccacgtaccatgccctctgtgaggcgtgcacgaagactgacgcgggagtgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtagggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagttttaccgtctccagccgagcgacgtcatctgggagccgtacacagaagaggtcgtcgctgcgagagcaccgctaggactttcgtccttgcacacgcgacccggcttactggctcaccatcctgccgatggtgttcgacattttcgttgagcctcactgcccgcagcgtgtgatgagacagttcggacttaggcaggtgtttccgggcaatgtgcagtcgaccgtcctccctgccgaccactcgtgagttcggattgttcatttctaaatttttatgatacttacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccaagactacttcgtgggggtacgtcgaatttgtattagttcttacaattatttcatttatcttacataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttatgtttttgtacgaaaacatcaccccgtcgtaacttgatgttccatcctcgcaggacctcgtttgccttcgagcgcccctagcttcagagcagtgcgacctacagcaccggtttcgcacggtacagttcaacccagagattagttcatttttttttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctcttacggagcgtcgatccctcgcccacacggtactttactttttattaatactattaaatacatgtatgaaactgatggtccttgtccagcaggatttgcagccgggatcttcggtactggggcctcttcgtctcacgccggtaggactagtcctactagccagttctacgacgacgacttgcacggtgcacaccaccacgacgtactaggctcctctcagcttggaggagctccagaggcgcacactcaggagcagccagaggtcacacctgtacaggcaggacgagttggccgtgtcgtacccccggaccgactcacgtactcccaggggcacattagggcgtagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcctctacatagttcttttcattcatatggtgctagaacaacttatgctcacgacaacacactttcgtacaatggattgacacagtcagagttacttcaagtggcgggccgataacgcaacctgaaccgaccatacagttcattcatgcttggatggagtatgaacgtcgggtggaaattgcaagcttagactggaggaacaatccattagggttacataaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccctaccaaatatttggtagtgccaaaacttgcttatattttggcactaacaaaatatttgtacggtaacattccaaataggcctaaaaaataataaaattgtattttaccagtcttggagattttaatcttgtatagttttcaatataaaaaaatttgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcaccgccctctgggatggcgatttttaaaaatcgccctcccagagggcggtaggagaccacttctgtcaattttcaaaatgaaaaattattttttaaaacttttaataaaaaaaattaaaaataaaaaaaattctcttttacctgtaaatgtttctccaatgggaaaaggaacaagcaaaatcatactccctctatactaataaaggaagtcgttttggacagcgacacggtctccaaaacacaactttgatctcttgtttctataaaaatatctattattatatactaaaagtccattaaacttcatacaaacgctctcaagctgccacgtggcgctcctataaacgttccgaggccgccacttggcacagcctaatctcaccattaatttttatttaaattgatggacccgttgttattaccgttagattagatctatactgccgtcaggggtggagcaaaaaaaaaaagacgtcggggtcattaccgattaaaaaaaccgtgaaagctgcttggttttcgtcaatccagtagttttagaacttttttttattacggagttattatgaaaaaaaaatcgatagtttttttttcttctagaaactcatccaatgggattgcaaaccagccagctaatcacaaagattttaattagtgtatgtgctcatacaagatgaccaggtggactgggtgcacattcaactacaccataggtaacgagaaatcacttagctgatggtttttcgaaccaacacccagataacggcatggatgacttcggatatcggcaccggtcgtaaaatctgcacctataatatatgtaagtgccggttttgtatcaagaaccgacacctataccaatttattggtaccgattctggaccatcatgccacgtggctgggcttatatgtgtcgattatttataacaagcggcacccaataaatcagagaaatcgaagaaattatgagaaaaaagaaaaacatctacacatcgattttcagttaatacggtggacctaatattttacaccgttagagcatcaccaacagattatctataattttctcctaaaaatttgtttttgttattcttaaactgaaaataggaagtgaaaaaactcctccctccaacagatagcctaaattcaatccccaaaacttaaaagtgggcccttctattaaactaccaagagaaaattccgtttttttttctttcacacgcagaaagatcgctatctcccacgcgcgggaacgaaggagagaggtgggattgcgtgattgggagcgactttcatgcccgcatataaacggagcgaggaaccgggggaagggaactccaaaactcgggtaggagagtatgggatctgttagagttgatttttgaactaaaatccctcaaaattagttttgggaatcatataggtagactgttggtaatgctcttagatctatcattttttttaaaaaaaatcccaaaacccatcaaaaatcttctcctccaccctttcctcctggacctcctctcctcacagtaactacgtgcatacatccctccttatttccttccttctttctctaatttaactattgaactttaacagataattccattaattttaatcattacatctttatgaaaaaaaatgtgtgcacacgtattagttatgtacttcatccacccacctgactcttccctctctcctatttttcacctatcttttcctattttctagctaacacttaatctatcaaaattaataatcggatttctgaatttagattcaagttacttttttttctcattctttttgaattattgtgttatttataattaaatgcacaattcaagatacatatacgtataaatagcttagacttctaatataaatgttttaagagcaaatttttaagcatcatatcttaaacaaatattaaatttagatcctataaacgctcctaagtcaccatgtggcaatcctaaaaacactcataaacaaccatgtggtactctaataaattatgaaaaaataaattataagaaaaaaagaaaaacatctaaccatttatttcttttctttaattggtagggccaatattttcaatcactagatccaatcttaatcttaacctattgatgacgctatccatgagtcagcaacaagtactccacatatatgttccgttcgcacgagagagattccgactcaaatgaaaaaaaaaacaccatatcatttaacgtagctcactacaagaaagcgaggcatcattcatctgataaaatcttccagactaaccgtaatgccgtgttgcagtccatcgaaaccaattttttatatgttcactgtagacaaattaaaatatgaaacatcaaagaataagcacaaataaagtttgacattacctaaacaaacagaaaaaggaaatttgatcgtgtcatgcatagaggaagtatggcttaacatagcaattgatgataatcgagaaaaataagtcacaactaacctaattagataaaaccatgtataagaaaatattactgcagaaatgttgtatgataatgatagaaacatagtacaaaatgaatttatttcgtagctaaacattgtaatcttatatgttactttgtatagtttgcatctttagttaatcatccaaaaaaagctataaacacaattaagatgatgtgatctgaaaatttagatcaaatatagatccaatatcataagcaaaaattaaggtggtaaggctttatgaaagaagaaacaaaagagagagagaactttccaccagattaatcatcgaggtgctagaaattgagagatgagaaaaataacattagttatacttagtgatggttaagtatataattatatatatgattgtagcagacataataaattgccacgaacataaaaaattctaattatgtaacacaaatttcgaagtggaaaatggtaggcactatttcatgcccattgcaagctagctaaaaatattaaaaaaagggtctgtgtgattttttccttactcacctccctctttttttttctaaggtaattaagttaaggctgaagggtatctaatatcttctatattagtaagttcatttcatcgtactttcaaagactgcatgcacttgcaaatatagacatagataatatacctaatacatattgatcacggtatgttttactgaaaaataaagaatcttcaatagctgtaaattttaaattatatattcaatttatgatctgtttgaaccattgtatttttttattaaatcaaaagtttaatatctataccaactatatttaattgctaataaaattattatattttggacccacatccattccataaaaaatcataaaagttctcattaaaaatcaaaatatccactttttttaataaaatcaaataacctataaaccgttaaccttaaccttaataatagcatcaatgggcctattgactcacaaccaacttaattatatctctcaatgtgtatgtggatgctatttacttaatcccaatgccttgataaaagacatgatcttcttttaaggataaatgaacgatcttatgctgtgtttggcgttaagggttgggaaactttaatcccttggaagttggacattaacttatagcccaaaatgcgtatatcacgttgctcaaatccaactaatacaccaagaaaagaagaaggagagaggggtctacagagctgcccttatggatattttactaataaaaaatgatttcaaatacttatttgtacttataaattatctaatcactaacaatggaacatactgtctatggagtaaacaaattggagggctagccggtgcatcccggtgtgcatgcatgggtatataatttttttttctaagatgaaaagaggggcatgaggtggtgtttggatccagggacttaactttagtctctgtatttagacactaatttagagtattaaatatagactacttacaaaactaattacataaatgaaagctaattcgtgagacgaattttttaagcctaattaatccataattagagaatgtttactgtagcatcacataggctaatcatgaattaattaggctcaatagattcatctcgcgaattagtccaagattatggatgggttttattaatagtctatgtttaatatttataattagtgtctaaacatccgatgtgatagggacttaaaagtttagtcccatctaaatagggtctgagatagttacatgtattattcatatacatgcaggggcacttttttttcttctaagtatgatgatgcgagcatgctgccagagacacgaattaacaagttcaccgtccatagtgagggaagacgaataatttggttagttggactctgcacaatatgttagatcatctacatatccaatggttagaaataatggtttaaaatagagggtcatatattttgtttaataaactaattatcaatttttcaatataaatcaatagagccattaattatatatggttgtgtatgtaatgtcttttataacttaagttttttctctttccctatggaacctcaagagtcatatgtcttaggtaccatcttttataccgtaagttaccaaccctaatctccaataggtaattttataaataacaattaaattcatcatgcaattctaatgaagaaaattcatgagaaaacataattatgaaacgttgcagatattatttcgctggtataccgccgttataagtttctcaaatttatcctacgtacagcacatgcccgtgcgaatgcgtgagctaccttcctagtttattaaaaagtgatatatatatatatatatatatatatatatttttatatatatgtatgtatgtatgtatgtatgtatatgtatatacatacttttatgaaagtatttttcaagacaaatctattcatataatttttacattttcaaattcaacaacttgagagttatttatgatttatattcccaaggtttaacttaaacattgttctaaacgacttcctttataactatggagggagtatctggttgcttagggcattgggcttatctgaaaatccatcataagtagtatgttctaaaaacttagcatcaaccaggaaaaaaatatcatcagttttttttagcaaaaccgtagggcattggtcttaaccaagaggttgactcaagtcatcacctcaccaaacaattatttttggtagtgaagaaaagagacaagttatttttaggttttttttttctttttctgtcttcgccggtgtcgagattgagtgatctcttcaacaattttgtcgttgatcggccgagtttattagtacacaagattgaacaaattaaaaaggcgggcatatataacaactacttcatccgtcccaaaataaatatatccgtcccaaaataaatatagttctgcattgttaattttcaacgtttaaccgttcgtcttattttaaaatattttatgattagtatttttattgttattagatgataaaacattaatagtattttatgtgtaactaattttctaatttttttcataatttttttaaataacatgaaccgttaaattttgggcacagatacccgcgattacacttatactctctccgtcgagaaaaacaaatttagaattggatgtgacacattccagtacaacgaattggatagatgtatgtccagattcgtagggctaggatatgtcatatctagtgttaggttggttttttataggatggagggagtattttagaacggaggcagtatgactatgactctcgagtagtcgaatgcatggataatgacgtgtgaatgaactgataaatgagatcgatcgatcatcaccagacgtgacgtgacgtatggagatgttcggccatttcgttacaatgattaattaaagcctagccgtgatagtggatgattagtagccgtcagcatcatcgaagtagtgttatataactaaggtgtacgtatcacctgcagcatttaaggcatgcattgcatggtcgattattgtggaccaaagcctctggctgccatcagcccatcagccggggtgaaaatgatcacaaaaattcttaattgatctagcgccgttttcttataaggatactgatctcgttgttttgggttatatataatttttttggggtaaaaatgaccacggaaattcttgattgatcgagcgccgttttcttataagaatattgttctcgttgttgttttgggctatatataaattttgtttttttaatttatttctacatcgtattaatatcgacacttagtagtataataaatgataaatatgatcatctagaagagatactaccgattccgaccgtgcttttacttcatcagctcattacgtacgtcgttcgatgtttgcaaagatttgtcgatcgactactgcctagctgctactactacgtacagattggacgtatgtgcgcaacatgaaataaaccagcgctatactgattctacgatgagtcatgaatagattgcggtagaagtaaagatgcaatctagagaccagctagctaattaggccagaagcaaagaaaaagggccgctgataaagggaaaggatccggcccaaaagttcacaatctagcagttagcaaaggcgctgtcgtgctctgccattctttccccgggcgttcttctccgacccccaatgccttcgcttgtaagcttcgtcctatatactcctatcccatattgaccgtcctatacgcctcctcctagcgatcaatcgtcaagggctcgacgcaggtgaatatgcagcagcatactccgtatacatcctacactggcttccggccttcatctttcctgcacttcccgtgtactagcatcatgtatggaactatggatgctacagccagcagcacggctgtgcctgtcttcctccacgacctatattatggcaccacgattttcataaaaaacagtgatttttttacattgtaaattatatatactagaaaaaatacccgtgctttgcaacgtgtaaatgctattttaattttattattgttatatggtttagctaggataaaatttatcgtgggaattcgcttggatattttttaagaaaatcatgagctataactaggagcccgtatttcaattaggagccagtatttcatatcaagttatcatgcgagtttttttaaagagatttcttatataacttcttttgtattttcaaaagaaaatgtgtttaattccaactcaaacacggacatgcattttcaaaagcgaacaaatttaaaaaccgacccaaacacggatgacgtaccaaaataccaggaaaaatattttcaattcaatttttataatagtaaaaatttgtattgtgtaattacattgtaaatttaatatacttacaccataagtaaggggctagaaataattcaaaatgattgattatctagttgatattacctatatagattcacacatataaagtaaaaaagcaaagagagaatcggtagagatgctgaggacttgaggtggactgtgaacaagaacaacgatccagcacagagcatccaatttgactgtaatcagccataaaatatggcgacaacattttacaaatccgtttataaattagccctaacctctccgtttgactgtaattactctgattttaacccagagaacaaccccctaaaaaaaaccaaaaaaacctaaaaaaaaattaggcccaagtaaccaaatccaatagcccaaaacaaaaaccaacagcgcaagcctaagagaaccagatgagttgagttgagagtctaggacaagccgcaactccctcccttcggcttcacccgtgccacaccgccatcgagtctgggccgatgccccttttataaatcaaccgttatctattgtaccagtataattcttacccatttgtttgtttgatgttaaattgtgtatattatcataccaacgtaccccaatacctatattataagtccatgggtatcccatcgacagtgtgtctctcttattgatggctgatgaagaagacatcggcagtggtgcaaaggtcgtggcacctttgtgcgtgcaacatgcgtggacccgaccccaggtgccgtcgtgccgggtgagaccgaccaaactacagggaagctgctagctaaaagtgtggataggatatagccattcatgtttagttggatatggtgattaattttttttatttgtatggatagaatgattcagtttattttttttggaagagtataacatggatgggataagccaacatttttagtgggcctatttgtgatataatttttttatcaaaatataatcgatcttgttttaaatatttaattgtaataaatataatgatgtaatcggatcacgaattagataaacggtttaggagaaaaaaatcatttgaagcttgctaacagaaaattaaaccaaccaccgcctatcaaaatagaccacatcaccccaaaccaaaacatgcatggcttcattgtaacgtcccgccttcccccaggccaggcccacttacatctgatagctttcataggtcatagactgccctcacagaccaacacatgtcttttctgcacactttatcctaaccctggagttctttggagattggcttccggaaaagaagttgcaacttgttgatatgagtattctattaatcctattaagccctaggcctggagttctttggagattggcttccggaaaagaagttgcaacttgttgatatgagtattctattaatcctattaagctctaggccaggatgttacattcatacgactaaattggtaggattcactcaaccatcatattgagagaatattttcttttctggactgccccatccaccatatctctcaaccatacacaacaaaaaaaatcgagcaacatcttccatccagataggggtgaaacggtacataaatttttcggattccgaacctattttcgaaaatggaatttgtcagtcagaattttttggaaacgaaaacgaattcggaaatattttctcggaaacgaaatcgaaaatgataagcgcagtttccgtcgaaactcggaatcggtcgaaaactttccagaaattttcttggaatttgtagaaattttgtgactaaaataccctggattattttttaagcactgaatagtgaataccatggtgtttggctgttattttttaaaaataattgttattcaaatttgaagttacataagaatatttttttcatgtattgggatttatcaacagtgttactctcttaaacatagataatttattccgtacattgcgttttgtgatgtactgttgagacttaacaattggacctatatgattgtgttttatgatgagctaacatggcgacccgcgcagattgcgccgctagcattgttagattttttttcttatacaatagtttaaatattttcacattttattattaaaatatattaaaataacaacataattttaaattcttggttgaactaataaatgtgtgatatttttattgtattgtatatacgtgatagttatttataaattatatttctatatggactcaagaatcatcttttaatattccttatttttaaacttcgaatttcctttgttcataaattctattcctatatggattctagactactcttccaatattcatttttcttaactctgaattttagttatttataaattgtatttctatatgatctctaaactcttctttcaatattttttatttttaaaattttgaatttcaattattggtaaactgtattcctatattgactctagacttcttttttcaatatttcttttttaattttagttatttctaaattgtattcctatatggacgctagacttttttcccagtattccttatttgttaatttcgaatttcagttatttataaattgtattcatatatggactatgactcttctcccaatcttactttttttaaaatttttaattttagttaattctaaattgtatttctatacagactctaacttctaattttactttttcctattttttaattccgaattttaattaattctaaattgtatgcttgtatggactctagtctactatttcaatattccttatttttaataccgaatttcagctatttttaagttgtattcctatatggactctactttcgaatttcctttgttcataaattctattcctatatggattctaaactactcttccaatattcatttttatttatttataaattatatttctatatgaactctaaactcttctttcaatattttttattttttttattttgaatttcagttgttggtaaactatgttcctatattgactctagacttcttttttcaatatttcttttttctaattttagttatttctaaattatattcctatatggacgctagactttttttacttagtattccttatttgttaatttcgaatttcagttatttataaattgtattcaaatatagactatgactcttctcccaatcttactttttttaattttgaatttagttaattctaaaattgtatttctatatggactctaacttctaattttagttttcctattttttaattccgaattttaattaattctaaattgtatgcttgtatggactctagtctattctttcaatatttcttatttttaataccgaattttagctatttttaaattgtattcctatatactctacttttttttctccgattaatgtgggaatttctagaccgtgagagcaaacgtggtggctccttttttctattagtttccatctgggctcttttttcatatattagaatttttaatatttctctctaattcatgtggaaatttttagtctatgaaagtggtggctcctttttttttatttctatttctttattaagataatagattgagtttgccttcttgttttgatatcgtttcagctctatggtattttagagcatcagttagttgctattttcctgaaatacttgcttttatctcacaattttttcatcgctaaaagtcggatcccttttgatgtctttttggctggtagagagtttcataaatagtactcaatctttttttcctttctttttttgttgcggtggattgtggagagatgatttctggcgtactatttatatattaccatggcatgtaatttgtgtacaattcagattgcatgaatctgacgatgatggttttttagtctgtcttttattagtgtctcacacggtttcaaaattagtgtccgatacgttttctaaaggaaaaagcacgaattactccccagaactatcacggtcgtctgaattatcccatgaaccacaaaaccaaacattcttcacccccaactatgtaaaccggacgaattaccccccctcgacccaatctgcggtggttttagcctacgtgacagtccagtcagcaattctatttttaaaaaagttatgggacccacctgttttcctcccactcttcctctctcttctctctcactcttcctctctctcatgggcggcaggcaggggacagagcagcgtcggcctcggcgggtgacgcggaggcggcggtggcaggcgagggacagagcggcggcgggggccgcccctccggttgacccggagtagtcgcgcgtcagggtgttgtagtcgaacgcctcagggtcgtcgagcgccgcgaagatggacgccgcgtaggccatgctcccgggccagtcggcggcgagcgcgcacgccgcgaggagcggccgcgcgtgccgcagcgagcggtcgacgccgagcttgacgtgtcgcgcgtgcgccttcctcgcctcgtccaggctctcgcatggcgcccggtgatcccttcccctgaaggcggcctgctccgccacttgcgcctgcgccggcgactcgcggcgatcccgacctggtgctgcgcctgggagagcactaaaccccccaccatctatactaccatcggcgagggagcggtggctacatggagcgccggagacctggccttcacaagaatcgtttaccgcgaggagtaaaaatcgcacgtctcgagcagtcagctagctaggtaagctcgtcgtacgtgctcgttggcggacgatgcagacgtgcacagtggcaaatggcagcatgccagcttgggtcgtgacgaaaatggttgggctcgggataagatagtacatgcctcctccgccgcaccccgccgccgctcgccacccagccgctgctcgcgcccgcccctgcgcggcccttcctcgccgatgcctcgcctcctccgccactgcgctcgcctcctccgcggctcgcctcagctcctccgcccgctgcttgcatagttgagagtgagagaagagagagagaggaagagtgagagagaagaggaagaggaataatggaataggagtatgacaggtgggacccatatttttttaataaataaaatgctgactgtactgccacgtatacgccacgtagaccaaaaccaccgcggattgggttaggggggtaattcatccggtttgcatagttgggggtgaataatgtccggttttatggttcaggggggtaattcggacgaccgcgatagttcgggggggggtgattcgtactttttcctttctaaatgggtgaatacccaacatgatccttgaactttcacttaaggatcaatttagtccctgacatttcgtgttgtccaaacaaataccttaagttcattgtgtgattcaatatggtccttagaccctctaaacatgccatgtgtacatgccacatcatctatgcatgtaaattcaatatttaaatgtcctttacacccttatgtttttataggaaataaagaaaaactattgagaaaacacacacaaaaaaaagtttttgaccattggcaaaaatatgtagcattgatagataaaaaaaataacattttttgttttatgattgcttcttcttattttcttttctttgtttgatagaaaattgaaggttaaaatggacatttaaatgttatcttacatgcacgaatgacgtggcatgtccatgtggcgttttaagtgggtataaggactatattaagccgtatgataatttttagggtcctgtttggacattataaaatataaaggactaattcgacctctgagcaaaagttgaaggactgaactgactattcaccctttctaaatcgaaagaaaccttgtccgtttcctggatcctacgaaagcaatctacaacgtataatctgaagcaaaatatgttctacggtcttgatcttttctatatttccttatattttctttcgattaatgtgagaatttctagcgcgtgagagcgaacaatagaattcggaaccggcagagtttgattagtactggtttgtctttcaatgtttctaaaagcggtgtgaacacgcggattctcataacattatctgtttccagtgtataatatgatttggttttcctttttaaagtttttgactgctgtccgattcaagtatcttagtatgcctttttttttcctttcttcagtttttaactaatactaatcctaatctagttctatttttcttttttttttattaatgtgagaatttctagaccatgagagcggacgtggaggatctttttttattactttatagatataatagatagattgttgaccgttgagacttgagaattggatttatcagtttgaggggttttttattccgataaattttcgttaccgtattcgcgccggtttattttatctccgttttcgatttcgataatatttgatttcgttttcgtatccgaggtttccaattccaattaaaaaaaataaaaacgaaaacgataaatatgctttcctcccttttccgtaccgtttttaccctacatccacagactaatctaccgaaccaaacgcaccgtccgtccgctccccccgaccatcaaacagaccgaacaacacaacgtttgaccgagctgcgggcccaacgcaccgtcacacacacacacagtgacacaggtatgaccatcacacaaacagtgacacaggcatgcgtggagattccggttcaggcaccgcaccaccaaccccactaccactatcgccaccttactccggccgaagcctcagcggatcagcccgttcggcgatttctaccagttttacacgcaccacggcgtggggctgagcctcaactgagtttgattgggatggtgggggttgttgtgcagtgcagggcagtgggcagagcggtggctggccggcctgtcatttttggctgctccgtagtatgttctgttgtctgcgccctcagcttgatcagtttgcttgactgccccccatgtgcaatgtgtcttctggaaggcggggatcgctcgttcgtatcatgatggatctctgaggtgtaaagagctactgtgagagagagagagagagagagagagagagagagaggatacctgcagctgtggcagaaagattagtgcatcctccctcttttagtattgttacgacgtgattattatttctggaggaggaaaacctgcttttgatcagtactacagaagggtacaacctatagcttcgacagatcacaggtacaatttgggtaggcaagtgacaaattttgcatggatacagtgattgttggctagtgttgacacgccgcgtcgcgggctcacggcatgttcagagttcggaccgaccgtgtttcaaccgtccacaactcgtgctttaatttgccattccccaacaaccaaaatattctagtactagtactaccacggagtactactacacagacatgcaatcccaaaatggacggaagctgcaagtggcagttaagctaaacacaaacacttcaacatcacgcatgcatgtggatacccgcggaaatatgcatcaggccgttgctcgtgtccgtcgttgcagatcaacctatatcaccccaattaactattccctctccccacttgtagctacttcatgcgtgcagaattgcagaacgcagatctctcctcacggcgaacggtcggtatgcaaggcggcgaccgatccgatccagccacgagagctagctgactactgagttgacgcgcgcggggccaacgccgccgcccatacagcggccgcccgagcgagagtacccgtgcgcacgcatgtggaaaacgccggggttgatgagtccgatctagcggtgtgcgtgcacggttgcgtgcgttcgagtcgacacctccacgcagcttccgcctcctccgggtggaaactgacccccctgccgccgctgcgtgctcccgtctcgttcaccgtgcacggccgcttgtacgcgcgccgcgccgctgcacaagaatccaaccggtggtggtggtaggacgtccgatggggcggcggaacggggccgacacgtgctggtgcgggtgcccgtcgtgtgtgtgtttcgttgctgcctgccagcaggagcgcacatgagagtgtgtgagacgcagtaaggccaaggccagagtcaatgtgaacgaacgcggatggatctggaaggatccaactgcccggacggatcccacgaagagtaaaaagtgcggaaatgcgtagcactactgcactagtactgcagtagtatgtcgttcttcctatcctctttgacgatggttgttgtacatgttcacgtgcacgcattgtaccacgacgatcgaaaaaaaaaaagaagaaaaggccatctagcgttagcgtacgcgtttgctccgtgagaaactgctccttggttttttttactcgtcgagtcatcttcccttccaattcaccatttctttacacaaacatggagaggaaaaaaacaagagcgcaatcgctgagccgaggaggagagagcagcagccgaccacgccaccttgctttgcgctgctacctccaccaaattaataccccccccccccccctccttccacttcactcccactcccatccccatcaccaccttccccctcgtctctctcactctctcctcgccatggcgctccacctcttcctcctcctcctcctcgcggagagcctcgccctcgccaatgccgccccgccgcccaacgacgagggcgccaccaccatcgtgctcaaggacggcaccacctgcaagctctgcgcctcctgcgacaacccctgcaaccccttctactacccgccacccccgccgccggtcgtcacccccacgccgcagtgcccgccgccacctttctacccctcggcggaggcggtggcggaggcggaggcaccgtcatgtacacctcgccgccaccttcctacagcggcggtggaggcggcagcagcaccggcggtggaggcatctactaccccccgcccaccggtgga

SEQ ID NO: 8349 - DNA, 12977 bp, Oryza sativa
tacttcccattttattattacagcccgccgccgccgttttactccagcggctcgtctgtcgccggcgtgtcggccattttgtcggcggcggcggcgacattcacgctgctcctcactgggctcctactgtggtgagaactgagaatgggatagatctgctgagttaaacctatgtctttctttacactaggtgggtaatttgattgtggtttctgtaatttaattttttattttttatttttttaacttctctctcttggtgatttatgtatcgatcaggtataagaaaaaattgtaccaaactgtaaaacatgggcaagtaataagcaccagtacagttgtactactacaaatagatggatctgctgattaaattttttcgtgccaaagaaatactatatgttcactttggatcatctggttgtgtgtcggtaacaatgtgcagccacatgtcatttcaagccagcttgtctctttacaaatgatagattgttctgcaaatttttaccggtgattgctttgcatcagcaattcagccagcaacttctgaacagataatgtttctgatctgagcagcaactaataggcactttgatctgagttagtcagaaggatcaacactgtttcttctttatcgttttatttatggtttaatcaagaaaactttctctaggagtacttgaggccaaaactctaccagcaagatattgtcaggaacaaaatgtggatgctgataaatctgaacaactgacgcaagaagtctctagttctggaacgcacaatctaattgtaataactctgcgcaaacgatgtgcagtgtgcgtacaacagtgtgtttcccagaagcaagagaacactcatctcatgcatatgcatccaagaacataaattattgctcttatccaggaaaaggcgaggatatagaggaaaacaacaacttgtacagatcatcgatgttgccgtgtacacgcagaactactatattggagctttttaaaaggtttacgtgtataaattataaaaccgaggagaaaaataaacaaaaacagaaaaagtagctttatttatagctggaagctcgatgcatcattttcagtttcgagttactgaaaagagaccgtaactagaaaaagtgatagaacgaaagtggtaaggttcaaaaggatctcaaagtgggcaaaagtaaacttgtgcggcgtgggttcgccaacagggcggagcttgatttattcggatcttctagggctgacaaacattggttcctgctttgtttctactagaatcattaacggtggcctaagggcaagttttataataagagcaggtacaataataaaccgtatgagatccatgtagaattttttgctgcgctagagaagagaagggaaggtagagagaacgggcgggcagcccgaggtcatggggcccgtagcaatggtaggaaagtgataccgtcctcgcgtgcgtacatcccgctgccctcacccgcggccaccatagtcctcgtatgtcctccacggccgccgttgttgcccgcgtccatcccgccatcctcgcccgcctttgctgtggccatcgacctcgtcttacgcggccaccgctgttgcccgcgtccctcttaccgtcctcgtttgcatccgttgtgaaatctatcctcatcctccacagtcgccgccgtcgctcgcgtccatcctgccgtcctcactcgtatccgctgcgcccgccatcttcatcttccacggccggcgccatcgcccgcgtccatccctctgtcttctcctgcctccaccgcggcaaccaccgtcgcctgcgtccctctcgccatccctgtcttctgcggctactgccatcgcctgcgtccatctcgtcgtcctctccctccatggctgccaccgtcgttcgcatccgtcatgccgacgttgccatcctcaacattgtccgtcttgtggccctcgctcacgtcatcgcgactgttgaccttgtccaccgcggccatcgccacctcttgcgcccatcccaccctcctctctcgcagctgctgtctctcgctcacgttcgtcgtccttgtcctccgcggctgccgccatagcttgtgtacactagatcgtcttcgccggcatcgtcacccgtgtccaccgcaaccgccaccatctccctcactctcacctgcgtccatgcatagggacactgccccatcctcaccggcaagaagcgagaaaaaagagaactcggaaatagaaggatggaacaataaagaaaatagagggaaaagatggtgaggccataaaaataaaaaaaatatttatgttacagtaagcatatgattctctattatatatcttagctataatgtttactgcagatgatgtgcccacctattacagccggcaattggctttgttattgatcttgctctaagagagatgggtgctatctctaatcttgaccgtatcatcgactcataaatataaatgcaacatgtacactactccaatatttatttgccagtctactcttactctcttttcttttgtcttgaatttggtgtagaggttgtctagggtgacttattatctctattctctctcatctttttctctcttccacctcactatgtaaacttatgtggcatccagaagattgtggttggatgcttataatacttgccctaagctcttatcaagaagtccaattaaagattgcaaaaaaaaagaagtccaaataaaacaaatggaacttggtgacattgtattcccttccttccaaaataaataaatttaaaatataataaggtatttcacattacactgaatttggatatatctctatctaaatttactatacttgaaaatttcacatcatatattaagttgatttattttgggacgagagagcaggcagcagcttgcaggcagaggatgaggcgctggttgcaggtttgcagcacgtcgaataatagctatccttgaggggattcggtgagttgcacaagtttggacggccgctattgatattgcatctgaggcctcgtttagatctcaaaatattttgatcaaatatttgaacacatacatgaaacattaaatatgggaaaaaaattaattgcacagtttacatgtaaattacgagacgaatcttttgatcctaattacaccatgatttgacaatgtgatgctgcagtaaacatttgcaaataacggattaattaggcttaataaattcatctcgcaatttacaggcggaatctgtaatttgttttgttattagtccacgtttaatactttaaatatgtgtccgtatgctttaaaaactttacacccaaagaacttaacacaccctaaaccagcagacttgggtgggtctagctctctctatgtcaaattatcagatggatgtggaacaaaacctcgatatagatatcacgaatagtacgtggcctatacacctcaacaaaagaatcttgtctctaagcaggaaaataaacaatcgatagatcgattcgttggcatgaattatctgtaaattttaaaactttattttccacgtacaactcaaaccaaatttggggagaagaatcggagtcgggagataaagcacagtaatatcataacttaacaaaagtgaagaaaaccttatataacagagaacaaatcgaaatcagataaactgagagatatgaaacatcctttgtgacttccatccagtaataatcagcaagaaaaacacctgaactccaacaagaaaaatacccgccgatttatcacctaaagtttggcttgggtttaaacctgtgtttgattgtaaaggttgggaaccttctacttcggcatgtaaaatgggacagcacattaacgtgtaaattaattaagtattaaaaaaacatgaaaatggattagtatgttttttaaagtaactttcctatatattttttaaaaataaacaatttagtaatttggcaagtatacgcacggaaaacataggagtggaggttggaaactagaagaaacactcagccacctctctcaaccttacaaactggatgacttaagatgttttctttttagtacctagcagtacatatcataagataaattgggaaattttgatttcatgttggccagcatgctggaggtgtgtgtatttgaccactagacttttcggcttgtgttgctccaaacgacacatctacatattagaaggaagggttctgaacccataccttcgaacgaacctagtgtgaactgaccttccttccttctctcctcctccatatttccacggcctccttccaaccactgcaactatataccctccttaactgacacccctgattcaggtggtgtttgggtgtccctctcacaaaaaaaaataagtttctagggagggactcacccaaaaaccccctcacccaccccctctgtctttaattcctcacattgatggactagtcattctcatgtcatgcgccaataagcatgctcatcttttttttttttttgagaactagcatgctcatcttgacgctgcactcctctagccttcctttgaactggcatcggttgtactctgctgtcttatataattggccttcccaatctagtccttgctgaataggtgctaaattggcattcagtgctgctagtgcctggatttttggcccaaatcacaataatgtttttctaccttttgagatggaacaaatacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcaggagggtggctggcaaacgcacacggcggcggcctactgctgctgctggccaacgccgccggcgacgttattcctgggtcgcttcctccggggcgcgaaggcggaggagttgtcgttctcgggcgaggaggaggagctcccggcggcggcgccgacgttgccgtagaggccggccatgtcgcggtcggtgaaggcggcgggcacggcggagagcgcgtgaagggagtcgccgcggaggacggtgtcggcgacggcctggcagaggtcccagtttcccgtccacatgagctcgatggcgccgctcagcgacggggatggcgccggccggggcgcccacgctgctgaacctcttcagctgatccttatcgattgagagctgtacgtaattgtaagctaattaattaaagttaatttctagtagcaactgtgcagagaggttagggttcaatcgatcgatcgccaggtcaggtgtgtggtgattaattatattagttgcatgattgcatctgtgttgatcgccaggtcaggcggcggaggcatgcgatcttggccatggcctcgtcggccgcggacgccgcctctccttctccagctcctccagcacgtcctccctccgcctcccctcggccgcgagccgccgcctcagccgctccatgctgccgccctcctccgcgccgccgccgttcgcgtcaccggccgccgcgcactcatcttcctccgcgtcagcctcctgctctagctcggcctcgtcggccgcggacgccgccgcacgcctctccttctctagttcctccagcgcgacctcgctccgtctcccctcggccacaagccttcacctcagccactccacgctgccgcactcctccgcgccgccgccgttagtgtcaccggccgccgcgcactcgtcttcctccgcgtcggcctcctgctcgagctcggccgcccgccggcaactcctccccccaccgccgccgcgtcgcccgtagccgccatcaccgccgacgccgccgaggcaccgcgggccttgcagagcagagaagggagagagataaggaagggagagaagagaggaaaagaaagatgatgtggccacactgacatgtggggctatgtgggtcctatgctgactcagctgtcacatcggataaaatcggattcaaaaccacctaagaatctaaagcgaacggttttgtaagttgagggatgtcatatatttttgcggttagggtacgattctgtgactcaatgacaagttgagggacctttggtgtactttttccttctcttccccaggaccacattctcagaaggcctatggaccgcagcctgaggcctgccaactgctcgcgagccgctgcttatgggctgccgtgtacttctagccgcggcttacacgacagcccagtcgaaccggcctctacctgttttggagctctccttttttttttcctatcttggataagagcatcaccaatagcatcttaatatccggtaatttaaggatttgtattgtcaaaaatcttttccaactaattccctaatcacattcccaatattttctattttctatcccgcaattgttgttctccacatctagggatgcactttggctcccaatcacgtgagcgaacgtccttttagtttttgggaaaccaatcttaaccaatctcttcgagagataaaaaatttatgacctcaaattttatttaggattcccataactaaaattttgggatagatttttgagatgacgaccaacagattacctataatctttcccaaaaaattgtttttggtttcctaaatgaaaataggaagtgaaaaaactcctccctttaacagatagcctaaattcaatccccaaaacttaaaaataggcaattctgttaaactatcaatagaaaattctatttttttcttacacacgtagaaagatcgctatctcccacgcgcaggcatggaaggagagagacgggagtgcgagattaggagcaagttccgcgcccgcatataaacggagcgaggaatcgggagaagggaactccaaaactcgggtaggagagtagaggatctgttggagctgtttttttatgctcagagaatcattctactccattcccaattatgattttgaggaatttaatcgaaaaaactactacaacaattccctactctccctctcaaaactcagcattcccttttcctttatattctcgctctccacaagtcagatattgttctcgatcccaatttccgtctcttaagagaaactgccactcgagaagacgagcaggatggtgacgctagatgggcgatcacggagccagatgacacgatctaataaggcacggatgaagggaggtccaccttttattttagggaattaaatatagaccatctattggaaggaaataagtttttaattgataagtcttcatcaaataatctcaaaaagaaatttaggaaagagatttttagacataattacagtgaaatggaagtcatattgatcttttggtcatttggagaagacatacattctctttaaaaaaaattaaaatcactgacgatatcttttctgattaagaataaaaagaagattatcgagcatatagattttatcttgaattttattcgcacgcttttaaactgctaaatgttaaaaaactttttatatagtaatttctctataatattagacaaacgcatttttaaatttaaaataattaaatctaattcacttactaatagttttttagtttgacatacatatacttaatctctatctttagcaggctgggccatagaccatttctgttaaaaaagggaacatactctttatgtcacatgaaaaaattaacctatgacaaaatgtgacatcttacaataaatttagatataagtatatttaaatttattatactagaagtatcacattttgcagagggagggtctgggagaacaagctagctactccgcagaagaaaacatgggccaatttttatagcacggcagcaggaacctcctggagctaaagctttctcttctttttttttttttggttttatcttcaccaagtgctcgtcgctgttgatatacacccgatgtaactattcatcttttgttggtgaaatatcgccaagccacttcacttcactgacaaaaaaaattctcactctagctagctagctagtgtcacttccggtcggtgcaggcaagcaaaacgtgcacaattcctgcagttcaacgcgaggccggctagatagctgaaatatctgcagtcaatctcgctgcatgtacttactaggtccgtttcaaaataattaaggtggtgtttggagccagagagttaactttagtctatgtatttagacactaattcagagtattaaatatagactacttacaaaactaattacataaatgaaagctaatttacgagacaaattttttaagcctaattaatccataattagagaatatttactgtaacatcaaatagcctaatcatggattaattaggctcaatagattagtcttgcgaatcagtccaaaattatggatgggtttttattaattgtctacgtttaatatttataattagtgtccaaacatccgatgtgatagggacttaaaagttttagtcccatctaaacagggtctaaacttgattaaaaatttagacaagtacttaaaatggttacagaatttgattttttagatgaatggtatacgtacgcaggatgcctgctggctctagtaactcgttcgtatacgtggatatgttcagatatgaactttcggccgcctacagcggcgcgcgatcgtacgttgccgaccatcacatcatcctctcatctcgattgagttagatgctgtgatattttacgtctggttgctagctaaagtagtggcaaacatatgcatgtcccgcacatgcgcaaatcgcaattgattcgcagacgattgcatcatgtaacacgcagaaagctttgggtttgaactgatgaaggtatgttcacaagctcagtgttgggcaggcattctgttttttctctctcgagaaatcattcctctaattgagtacgagagatttagtaaaatatgcttcgattatttaatatcctgacttagtattttttttaaaagatacataggaagacacacaaactcacttcatactcacgccacaccacatacacacgtgcacgcgttcaacacatgattagactagagacttgaaggacctaaagccttcggtgtgcgggaaaaccgccaaccattttaaccaaaccccaaggaaaacccaccccaacccgggttttaaaaaagggggttggggtggggttaaaatttcccccccttcccttttcttttaaagggcccccgggttttaaaacccgcgtcgttaaaattattgggttcatgcggactattcaaaattttgattctatcataaaattttaaaacaattacaaaatcataatcataagacaagtactattttcaaaaatgaattcaacatcatccataacactcatcttcttttctcagctcgcgtcccattcctattatctccgttctcctcctccctcccttccttgacgactttaccccatagtcgccgtcctcctccctcccttcctcgactactccgccccatagtcgccatcctccctctccttcccttcctatgatcccatctccgatcgccagagaaccaatcgatgccttccctaatgtcaacagtgtcttccatcttttttccccttcactcaccagatcagagggcatcaatgagagtgtggtggacgatgaggttatgggaccaccgaaattggtgaggtcagcaaagaggaaggcaactacggtagcaagatcgactgaggaggaagaagagagaagaagcaaggtatcaaacctcatacctcgggtatcatccatgataccccgtggtatcatccatgatacgtacttaggtaccaaccgatacccatagataccaggttaccaagtaccaggtatcaggtatcatgtcgtgaggaggaagctcgggccgtcacccgcctagccggtgggtgagccatttacctttgactcctattttcttccccctttctcccctcgacacactacatcctctcctattgttgatgacgttcacgagggaagtagtcagctagcatagctgcgataccaagcaggctcctggctggggaagacgccatcggcgtggtttgctcggagtagttgctgcagcagcgctccgagccagttccttgctgtcgacagctgtggcagaggaggaggcaaaatcacgtgaacagtgtgagggacagattatcaggtgttttaattatcccgtgactttcataatgccacaggatcccgtgcggtagctgccctctattaaaaaagtatctaaatccttataaggtaaattagattatcaaaatatataaacaaaatattataaaaatattttctgcatgaaaggataatttatctaaagaccacactcctataccttacatatcatccaaattgacatcaaaattatgaactaattatgcgcatggatttatacaccaatatccatttacacctatgcacaaataacagatagactgaggaaacatatacttatatgatgatcatttgaaaataatttcaaaaaagttatatgacgatcgaatgggaatggagggagcatcatttattttgttgtgagttattttatcaataaaagtactttaagtatgatttatatcttatacatttgtacaaaattttttgagtaagacgaatgatcaaacatgaatcaagtagaatattaaaaaacggacgtagtatgaacattaacaagttgggatcatgttcatcctttatacacatgaaggataactttggaattattttagattctacaacataccaaatataagtaagttataggaataattaaagtaaataccagtacgctagatcatatatggcaactctgacacaagttttgcagccatgggcatagatatagtgactaagacctacaagagattaaccaccaatcaatatgacaatatccataccagacatggaaatttaaaatgaattagattggattttcaaaccctaaatattttctaatgaaaacacgagatgggaggtggaggaatagagatagggtgggtgtggaagtgggggtggggggagggagtggaccagtcttgatgagctaagaataatactaatgtagtaataaaggttatcaggaaagaggtgggatatcatacgtacaatcagtttagttgggcttgagcattaatttttgtggacatggggcacatggactatgagctacaagagaaatatggcaacgagcaattctcaagtaaacatttgcaataaatttgtttagcctttggaacacaaaatttatttccgcacaaccaaaaagaggggaagggatgaatgaggtgtgattcgtgtgaagggtgcacaactcattcttgataagctacaaacaatttgtactccctccgtcccagaatataagaagttttagagttagacatggttattaagaaagtaggtagaagtgaatggtgcagggttgtgattgaatgagtagtagaggtaggtggaaaaagtgaatggtggagagttgtgattggttgggaagagaatgttggtgtagaagttgttatattttaggacaaatcctacaggctaaaagttgttatattttaggacggagcgagttttacattaatttattatacctacttttggaataaactaaaatgcaggccaccacattcgcacatgctatcttctagtttgcatcataagcaataaacggtcctgctattcatcccaaggaaccatgaaaaccagctaacaataaagccctcaagaatatggagcctactatcatttcaagctaggacaatatcaggttatatattcaagtgcttaccatacaatcatgcagaacatgaattctcgttttgttttttcttctttcttcctccagaccttctctaggacaatagcttagcttggtccgtctacatgctcttcttgtctattgaatatatatatttttaccgattttatagaaatatacacgtttaaaaaaattggcagaagtataccattatcgcggtgtgtgtgtggtgggggggtggtaattgaattcgcatcgactttgcacggtgaatgcgcaaactcgtgatgtcatcacgagtttgtatgatgaatgcgccactacgtgcaaagaaaatagagagaatctattctataccatcatagtttaacaatttaccattgactttgtctctttctacaatataccgacgactttatcaattgttctacaatacgacattgggttgggcttatttttcaacaccatttagcaattaattaagtaacaccatttagcaattaatttattggccgtagtttatttaattatcatcgttagtaattaattaacaactgattcatcattagcaatggaaaacaacattccacattacctccatccatgcgaactcgtgcgtgcggcagcaagttcgtgttcccacttagcaacgacggtatatcggaattttgttataattttttgaaaacgtgtatattcttgtaagaccggtgaaaaagaatatacctttaaaaaaaaatcttgttgtcttagtgccctacttttattttgcttttctttgctcctctttcccatcgctcggtccttccaattcactacaccagatcctcacatctctgacgggatacctgtgacgggcaaacgaaatggtcactgatgaccgtcacctctgacaggtcatacgggatgccgtcatcggtgaggcatccggctgctacccgtcac

SEQ ID NO: 8350 - DNA, 18741 bp, Oryza sativa
  unsure (1)..(18741): unsure at all n locations
gtggtgggcgccagatccggtctccaggtggttggggaccaccggatctggaacccccgggctccgactgttgcctccttcacacttcgccaaggttgccagtcgtcgcctccttcaccatccgagctccttcgccggtcgccgcctccttcaccttcttgacgtacgagctcagatccattgccagcaagtcctctttcacccatgtattttgtcttgtgttgttcatattgttccaattgttgctactgtgattgatgattctgagtcctatggtgattgagattcttgtgattttgttttgtgattgggacaactgcgatggaattgtgacgatttttttgatttgtgaatgccaaatgcaatcggttgaaatgaatgtgatggtaacctaggaggacggtgtttctcttttttttgccccccttttatcacaccagtgacggtcccaattagttgggccgtttgaggtgactctcacctgtgacgggttttggttgggaccagtcagaggtgactctcacctgtgacgggttttagttgggggccgtttgaggtggctcttacttctgatgggtgttcacccgtcacaggtgactcaagtcatcagtgaccactaatctctgaccgggagctgaacccgtcaaagttgagggtttgagcccgtcagtgctgacctgatctagtgtagtgattatagcttcaatgacctccatgaggctgtgccatggcgcgattgtaaagtggagggggtgtagggagaaggacgtgcggagctaacaaaatgagcggccactaatataatatagctgcatcgtattaagagaacatggcactacggctgcgttcgggaacctactctctggcacgcaaaacggagcagcgattagagcgtgatcgtatttgggaacaccattttcaaacttttaaaaacatggcacaaagtatttgctaattttttttcaaaaatggattaatttgatttttttaagcaactttcgtatataaactttttaaaaaaaacacaccgtttaacagtttgaaaagcgtgtgcgcggaaaacgaggagaaggagttgggaagctggtctgccgaacgcagcctaatacttgtgaattgtgaacagcttactggtaaatgaatgattgaacacgtacaatattatagtacttttgcaaatggtaaaatcaaatgaaacaaaaaggggcctgagcttttagaaatggagggaatttccaagaggtagctagagagataggcatggctcttttgcctttgcatcaacgtctagcactgtgaaaccgataggaaaagcaaccttgtggcaataattgaggctcgggcgacaaaaacttacgtaacggcagcgttgacgcaaagattccccacaagctgatcgagaagaaggcagtacacaagtgacacaccagcagttcagttcaatccaaaggcacagtctcagcaatcatgctgctacgtacgacatgtttcttatcctagctagctaccatgtacaagaaatatccggtggataacctttataatccaaatttcattttgtatatgcaacttttctaatcttggtttacatgcagaatgaaaatttattttgtgttgcaaattttaataatttgttaaagagatgaagttgcgattgaccaagtgagcattatttccccaaccttccgtgctgttacaacttttctgtcgttttcacgtaaattcttcagtccggcaagaaaactttaaagatgtatataatggaagcaaatcaatggacggtaaagaaagaacaaaatttgaatccttagaaacaggaaaattggaggaatacaatgtttgcacacatcaatccatatgaattttttgaagaggctttatcagtggatgaaaaaattcttatgttttctctatacaacttgtaggaaataaaattttcctttggttttccttcaatcctactcactgaatgacactcatactaattaatccttactaatccaaatcctttggttttccttcgaaacgaacaagcccttaatacagtcaacacccataattttatatcatagaatctatcttaaatttaccaattagatttatcttaaaaagccacacgtcaataaaacttccacaatcccttcccatggacatgcatatacataagtatgtaccctcttttttcttgttctccccttctcggatagatgagacggaaaaccaaattaataattcaaaacccatcttaactatgctttaagtttgtaaaagtatgttatctcgagttatattctaactatgtgcatgtcatcaaaacaaacatgaaaatttcaaataaatcaataatatatattatataatcatatatcacttagtgagcccagcgagcccatatgacccgaataaattagaccctaagagcattagtgattgaagttaattctatatcacaatatattcataataaataaaaaatatgaataaatgaaagtaatttttatatttttgacttattataattttagatttgtggtagtaattaattttctggaatatcactaaggttcaatattctctggcacagtttacttgtgcatgtatgtatataaagttataaatgatgatcgacaatacagattatatcatcctatacaactttatcaacaaacatagctaaatacgcatgtgatcttctttaaatctgaaaaatcatacatgtccacagtaaaaaaagaatagaatttttaaatattagaaaaaaaaactaagtaacatatgccatagtaattaaataaaaagatcactttttattaccgatgttttagtttagaccatcctttaactactgttttcattttggaccgggtaaacttacctttgtttcactttggaccactcgactttcttctcaagtatatgaactgtctcaattacactggtttctacttgtcaatgaactctcatagttatatgtaagactatttttttttggtatatggcaagttgaatgtatatagataaaagaatcaagagtggtccaaattaaagtaccacaaacgtaaaaataccttcaaagtaaaaacattggttaaagggtagttcaaagcgaaatatcgataacaaaaggtgacctaaagtgaaatttacttaaaataatatcagtggctaatctctaggacatataggtatagaatattaattgtaagtgcattaaaagtgtagaactctcctactagatttgttgaagtcactaacaaatttgagataacattagactcttaaaaaaaagataaaacaacaaatgcttaatactctattaagttttagctgtcggatgatttatgtgacttaatttatatgtgtattcaagttatagctaggccatcatacagaaggggaaaaaaagtcatacaagcgtgttatgaaaaaaaaaacatatggatgttctaaaaacttgtattaaatcgttgcaaggtgaatagaatcgtagagatgataactagcatcaagttgcactaggttgctagccaaccaatcacggcactaagcagaggtcataacgagccacaagacaaacaagcgaagcctagccttgtattgaaccttatttgaactcacttttatatctatgtattattatttgtgccatttttgtttgaaacaggccgtggagtcacagatcgaagaccaaccgagctatagataaatgtcatgggaacttctaaacttcatattaatcagaacccatcatatttagttaatattatcggaattgctataaatataaatattagaaaaaattcggtaccactatcaaccatgagaaaagtagctggagtcactaaaaaaaatttcaaagaataataagttttgtattatccaaagatcccagcttttgtattatatcttaacttgataagtgcaaacagacttccagttattcctccgcaagctaagcaagctttgaagtactaactagatgatgtgagactaactggatatatgaacatcttaccgggactttatttagatcgaaaactaataaattttaatcaccggaaaagaatttaacatttagggtgtgtttggttgctgggcgaaagtgggataaggcggcccggagggaaatattcccctcagatgctggatagagcgatccggccgatttggccggatgcagccgcccgaggctcgggcgagccgggcgagcgagtcgtgtgactcgcgtcacccctcaccacgacgacgcgagcgaggcggcggatagggcggccggcgcgggcgacgagagaggaggcgagcgcggcggcaggagggggtgacgagcgcggcggccggcgagagagaaggcgagctctgcagccggcgcgggcgacgagagaggaggcgagcgcggcggccggtgcgggcgacgagcgcggcggccggcaagagagaaggcgagctcggcagccgacgcgggcgacgagagaggagacgagctcggcagccgccgcgacgacgatgagaatgcggcgacgatgacaacgatgcgggcggcgagcgccgcgggaggaggtggcggcggcggcggccggcgggaggaggcggctggtgggaggaagcggcggcgggaggaggcgagcggcggccggcaggaggaggcggctggcgggaagaggcggcggcgacgtgccccagatccagccgtgtttttttttcttttttcttttttctatgtgtatttataatggaaatagtggtgtaaaattgtatcatgtattaatttgatgggggtatattcaccatctcaagtggagaggtgaccacacctacaaatccatcatactccctccaacccaaaaaaaattggatcaccaaatccaccttcgtccctacatccaaaaaagaaactggatcgccatattcacacaaccaaacaaaaaaactggaccgccatatccaacaaaatatggaccgccatatcctatccaatcttgaccgggaaccaaacacacccttagaaaaaatagaggttcccgcgcgttgtaattgtgtgggctacctagttatcttaaaaaatatgcaacggccatttaaagtttaatttgcatatgttctttaggccgtgcatcatccatgggtctgtagcgctggaatcattttttattgtgcttgtagtaataagtgctatcacaaagaaggagtcgttcttacttttaggattgtctttagcacttttactgtaacattgtcatgaaaacagacaaggaagaggattttggagcacttttactgtaacattgtaatatgacaaccacaagttcttccacttcagtacatcaacgttattcaacaattatgtggcgagacaacttagttgccaacttactggaactaatttttatattattgtttgacaaaccaactcttggtgaaatagttaaagagtttgcccaagactccacctatcaaacttcaattcttattatctaattttacacacacttgccatatggtctacctctatatagcctaatttatgagtactaattagggcgatggaccttttttttaaagggaaaacaacacgtgattatgccttttcattgaatatagcgggagaaaaatactaccttctagagataagaaaagagaaaagctctattcactatacagagtggggcaaaaagtcacgtaaaggttttgctcctgccattgcccaattagggggatggacctatgtgtgctattaatggcatgagtgcttgggttgtcttccttacaattccactaaagcacaaaataaatcaattttgcaaaaagtttataggagtgcagcatgtataggtttttagtatgggagaatatccattacggtcgctgaagtttcgctatgagatcattttagtccctgacctttcaaattgtccaagcaagcccttagattttatcatgtggacatatacagtccttggctcatcgaaaattaccatgtgggcatgccatgtcatctttcgatgcaaatatatgatgaaatgcccaatttgcccttacacatatcatagggaaaaaagagagaaaatgagaaaaatacaaaaaaaaagtaggtggtcttgcatatatccattagagttttaacattgaaatgcaactacgtccatagaatttatttggcatggtaattatatatttagtggttgtagctaatttaactttgtatttataatccagtgaaaaaagtttgccatatatccatagttgtattgagcaaagtttgtaaattattttattcttgtatggtatatggaagggtaaattggacatttcaacatatattttgcatgagaggataatatggcatgttcatgtggcgatttaagtgggtccaatgattatattagctcacatgacaaattataaggacttgtttggacaatataaaaggttagggaccaaattaatcccgaagcaaaacttcaaggatcatgttggctattctcccttttatatcagatattgaccaaagaataaataaacgtgatatgaaaagcaactctatttttttttaaaaaaaaagagagtaccaaatggtgcatttctgaatagaagatcctcccgtacgtgttggcagtggtcaatattaattatagcatcggaatctgtagttgctgtttgggtaaaatttgatagttttggtatcccctaatgtgccacaaattcacactagaaatgattgtgggtacttcctaatactccctcaagataaaattactcaatgaaagtgaaaggtttgatcttctcatcttctattctgctcaatctgaccgttcaaggttcatacgggatggtgtgcatagtactggtgtagttgatgaatgacttcggaggatttaatcttatcatttgaacttccgttttttagagagagtttgagaagcatatactccggcataattttatagttgctgaaactttagtgggcaaccatttttttagtaataacgacataaatatatttctgtgccatttgattattttccctaaaaaaatgaaaggagacaagcatagaccgatgtgactaccacattgaaagttataaaccttatggcataaatctgggaaactcaatccaggaagaattttcctttctgctcgcatatacatcatagcaagtaagaaataaactctactttttttttcttcctacagatgccacattaccgttgattaaaaagagatgctattgttgtgggatgctcccttctaagggaattgtattcctattatgcgatccctttctaaacgaacttataggatatgaaaactttagtcttacttctatacaataagtattttcacaattcttgagaaagtacaccattctttctaatattgatttgcattacctccttgtactttaaaaaagtgctgcaaaataaaattagaaaaaggcggtacaaatccttaagatgatgcaccgctgcacaagtcatctttacctctggttcgtaagtgcctgttctcccggttatacaaccgggagtccaaattcgagactaaagatagatatctttattcccgggtaaaataaccgggacaaaagttgatctttagtcccggtactaaaaagaagaaaagcggcagtcccggttgccacttttttttcattgtttctttaccagatgcgtttttccttctattttcttccaaatcggatgggatctatgcatatcccccaataatcaaatccccaatccctaaatcaaaatataacatctcaaactatatatacattcacatcacagatcctaaaaaaaataccacaaatcaaatacatcacatattgcatctcagatacatacaataaatcacaaattctcaaaaaaaaattacacatcttaatggaatcacaaattgcaaaaaaaaaacaaacaaacgaatcggccgccaaccgcctgctcgccgccgcgcgtgggcctgcctgccgccgccctccgcagtcgccgccgctcagccacaccagcgcctgccgcccaccgccactgcctccacagccgccgccactcgaccgcccaccgccgctcggcccgccgccgccgccctccgtagccgctgacgctcgaccagccgtcaccacccttcacaggcgccgccgctcggacacgccggcgcttgccgccctccgccgccgctcgatctgcaacgagagaaggcaggaaggagaggataaggcttgaaggaaggagaggataaggcaaagaaaagaataagagagtaaaaatagaagatgaggagtttgagaggataagtcatagggattatatatggtacatcgaattttagtccaagtttgtgttatcaacctggactaatctttagtcccagttggtaacataaaccgggactaaatataagatctttagtctcggttagagtctccaaccgggaccaaaaatcccctaggggcctgacagcccatgacagcacatgaaccgggactaaagatagcacatgaaccgggactaaagatgatgttaccaaccaggactaaaaaacacatagttctattctgcttataaactgggactaaaaaccatctttagtcccggtttttattggaaccgggactattgtggtttttggctgaccgggcaaagaaggtttctccagtagtgatggtatatcttgtatgagaaaatatgtagtgaaatcatcaaaaaagtaaaaaacccttaaaaaccgaacctaaaagttatctaaatttgtaaaaacattagtagagatagataggtatagacataaaatacattcccatcaaatcttaattgtgaactcaactttatttggaggataaaaagataaatttctggacagtaacatgacaccataaatttgtctttttcgttcctttttgataaagttgagactaaacttaagatttggtgggaatatatttcatgtttatacgtatatctagtaattatttttatacatttagatatttttttagatctagtcttcacatatttgatagctttttttattcttaatcggtctcctagtaaaaagtagcaatgataacttgacagtttttttctcgaatgtgcaggagagctgtgtaatactccctccgtctttaaatataaatgattttggttaaatgtgatatatcctgatacaacaaatctggacaggcttaatatttagattcattttattagaatatgtcacatccaaataaaatcgcttatatttaggaacggagggagttacttaatagataatcgcattgttacaccattaattaatgacacctttacatgcctgaaaagcaaacccttttttccatactcaaaaacaaaccctttgtttgtctgcataaatccaagggcagacatctccaacttgcagaaaatttctactgtaacatgtactgaaagccacataaattttctattgggtaaatatagcaaacaagaatataggatgaggtttaatcaggatcacatagagagacaaatacttttctttagccaatggggattctccagaagcggatatcctccaccactcaaaagagctcctcttttgaccaaaggagcctccacctagctattatcctttcatgcttttatcttgtagcagcttggccggtcagtggatattcccaccatctgcactctaatcaacgagagttcccaattgcatacccagatgccaactcctgagagatgataaaatctatctgaatatatatataaaccatgcaaccacatccagggacccaagagagtatattttttgactagtttggctggagaaaatgaaatcctcaattgtgtgtgtatggagaaaccgatcatctatgagaatctgtgtgtaattgcctgattaagctcaaacccattatttgacagttgacacacacattatatagtaagataagatgatatacccaaatccgaagatgaagggaaaaaaaatcttatatataactgcaacactaggctagcagctccatcaatttccagctcataaataaatttaccacaaaaaccgtaaagtggtatttccatttgttcaaccaaaaagctttcttcctcctcatcagctttatataggatcttttgggaaaaaaaatgttaacacatgcggcatttctgttcttccaaaaagcccaaataactgctacaatgcccactctccctactgtgagttattgatgattctcactgactcgcacaatgttttggcctaaacttaacattccgacaaagaccacatatatagcaccatatgcattcggaaataccaaaacgaaacataatccagtagtatatcgagtcccatggaaatcgattgaaagcagggattcctggttatcccatggcaataattgcatctacgtactgttgatgatgttcatatgtagaaaacgatataactgaaatgttccccggctgacatcagttctagattttattagattctgagaaacgactgatgagaatctgagaaaaaatagacttttctaacttttctatttctcgtttattttatagattttataagtacatattattaaaatctgtgtgagaatctgaaactatttgtcggagctagagatttattatgaaagagcttctggtttttaagttcgctttttagattttgttactatatactattggaatctatgtgagagtatgaactatggccctgtttgaacttgctccaaataaagattaagtatgagcacgcaaaacgagaaatacattaatacatggttaattgagatttaatgatttcaaacttgagaaaatagatttatttgatattttagaacaatttctatataaaaagtttcacacaaaatacaccatttagcagttaaaaacatattaatagaaaccaagataaaattatgtatcttaataacaaaagagaaatggcctatttaattctgaaaaccactaaagaacagggccgagaaaccttggggcaaatgagacaccagaactgagaaaaccttgccttgcctagaagaacccacttgcgggtacgactacaacataaggaaaagcagaggaggtcatgccgggatggagtaacacacagggcccctcttttcactttccaatgattctttgggtgacccacacaaattcccctctaaatattccatctctccaatcccttatataagtgcaactacttgcatggtccatggctccaagctgcctagcaacaaaggtcttaattaggagctctctccattaggatcctcgagcttcaggaagctatctccaacaaaacatacacattcagatcaacttcagtgatggctgcagaatcagaggtcggtgactgcagtaattcctagaattaacctcaagaatctcttcttttttgtttcacacactgttcaattcagagttgatcgatgtgctaatgtacctgtgactcgaactgtacctgcagacgccgcgaataacagagcttcatgtgaggatggactgcaatggctgcgagcacaagatcaggaagactctgcgtgccattgatggtacagaattaattctcctcttttcttcagacaaatccatctagctcagcctcatacaccctccattttaaaaaatattaaatcctgactatatatctgaacatatatttgttcggattcatggctaggatttgattattttttccaggacgggggagtacctatctgaaaattctgaaattttagcattctgaaaaagtgaaaatgcacttatctgcaggtgtgagcgaggtgtacgtagatgcagcgagccagaaggtgacggttgtcgggatcgccgacccggagaggatcgtcaaggcgatcaggaagaccaagagggtccccaccatcttctcccacaccgacccggcggcgccgccgccgccgccggccgaaggcgaggccgcgccaccgccagccgacgcgccaccgccggaggaagcaccggccgcaaagccggcaccatcagaagcggcgccgccgccgccggcggaagccgaccaggcggcggctcccccggccaccgacgccaccgtcatacacatggtgcacgactacccgtacacccacgaccaccaccacgggcacggccaccacctgttcggccgggaccactggccggcgagccaccataccgccggcggcatggtcaactacgggggcggcgcgccgtactacgccgggcacagctacagccacagggcgagcccgtacgtctcggagtacggctacgtcggctctccggctcaccatgagggcagattctacagcagccatgattactactaccctgcagctgctggtggcagagggaagggagatgnaagccagatcacctccatgttcagcgatgagaaccctaatgcatgcaccatatcctaatcaacatgcttttgcctgtcaagaagtaattaaggtggggtattatatagtattgatgattagtgttaattaagattactgtaacatgagatttatgtaaaatagtattaattaagaggggtgtaagtaagataaggaaaaaaggggagcaataagatgcttaacttgtagtagtgggagatgattttccttggcaatcaccactattttttttttaccgccgtccactacacctcaagagaatccaacaaagctgtggtcctgtgtatatgatgtgtacttgaaaaaaaagtggcagagacgtcacagtatttccaggccaaatctaaaaactttgtcctgtctagcatgttgggaatagagacatttttgtattctcttgaaatatatgtacatctgatttgcatcgcataaatctagagatcttatcttctgaaatctagaacgtgaggatttttttttttttttgcttcttgcaaggaagaaactggtgtccataaaaggaggcaaaacatttatatatccagtgcagtttgctgaattttcagttcagattgacagaccaatgggataaattccagttcttcatggagcggtgtttcaagtagtactaggaacagtacgaagaacagggaagctaggtgtgtactgatgcagaggagaatttgatctgacatgagtatagtttctagtgaagggaagttttcagagcaaattcaggagaccaaactcgaccgacaggatggaaggtgtttaacaggtcgacgagaaagagacatttctgtgtaatgataagcttaaagagaagtcaatggctttcagactttataaatcaagacaaactcatgctcagggctagaccaattaaactgttaagttaatcttccattcctttcagtcatccagagaaggtatatctgctcgactgctcccaagactaatgtcagacctggaggaggtggataagaaaagtgattgtgaccccagaaaaaacaaatattgccaattaattatagactcgcggtgatttaattccacttgcgtgatgttttatttgcttagctttaggaagttataaaatactactcctaaatatgttgatttttacaaggagtagttttgttttaagaagtcttctggtttagactttaaccatcgattgcttataaaatagattgttaataaccctgggaaaaatatgtttaacagcatttttgggatattaatctatcaaattattttttattcaataaatatacttatagttttattaattgtcaataaaaatccaaattttaactatttgaaagaaaatacttcctatgaaaatcatcatatccgagaagaaaaaaagatctccaggaaagcaaagcccatttatacattgcttcaagttcaagcggcccaattcaccaccgaacagggcaagaaagtgaataagttcattttaggtctctcgatttatcttcgagtttgaagttcatctctaaaccgaaatattagatatagtccatcccccaactcgtaccatgtatccaatgttgatcctttggcaatatatctgcctctccctcatcaccctccgtcacgcacgccgggtacagcatgtcaccggcgccgtcgggttgcagtggcagttgggccgccggaagtccaccgcccagaagttagacttaacggtgttaaatatttaggaacgaagggagcaataagaggttaaagttgacatagtagtgtgagttgggagatttaacaaatctgatatttcggtttgagggatgaattttaaactccacgacaaattaaaggatctcaaatgaacatattccacgagactggatctcaggacaacatcgcaccggccggttggtcgactggatcaggcaattagcccatttacggagtaaaacaagaagaaacttcttggttctttttatatttatttttcactaatttacaaaataaataaatcgccatatcaaagggtggtttatatggacacacagggcatttttcatatagatccttaccattctctaggtggtcgttttgtgatatttcggatttatataaggtgttgttatagctgtgattgtaatttaaggactgcatgcaatttcagtcgtccatttctttaattaacggatcagatctagtgctacagtaacaacacaaacagtatcccaaactacggtgctttcgctataattcagtgaacaatgcgactcgctagggtataccatccaatttgcatctgtcgatgagaacttatattgtctaattgcagccactattgtgactgcacatgatccgaattcatgatatctccatcgatgaataatgcgggaaggggtgatgtgcaatttttggaggttagtcctctttctcaactaccactgctaggaaaccctcttcaaccccggtttgcaactctcttattggcttatttagtcccagattgcaaaccgagactaagaatctgggactaaagatcgttatctttaatcccggttgaaatactcggagtaaagatacatctttactacatatggttgagccacgtgattgacacaaccatctttagtcccggttgatgttaccaaccgggactatgggttttttttgtttttttcctccttcagtttttttattttttttactccttcagtttttttcttttttcctcatttcatattgattcacagcatagatatcacaaattcattcacacagatcatcacaaattcgttcacaacatcaccaattcattcacagcacatcatcacaaaattattcaccaaaacattcacaaatcaacaacatccacaaatcataaaaaaaaataaagaaaaactcaaacaaatcaaaatctacattgtcgtgtgccacccgaccaccggccggcctcccatcccgccgccggccggccactcatcctgccgcctcccctccggccggatctggcggagaggagggcgacgccaccgccccgcacccggccaccatggtttattctatcccatcaaccaagagagtggaaaggatctatatgtgaaatgactctcatcctattatattatataacccgtcttccggaaggatatgatggcttttttttcaaaaaaaaaatcccagaggaaggagtatttctataaatttgtaaaaatatatatattcatttgatataaaataaaaagtttcaaacatattttaaaagaaaaaggcatgagtattatctattcatttctttcaaaacataatacggacatatgcgctcataaaacacgcagaaacaattaccctatggaatatgaatatacacttaatttccctatgagaaccgagactgagccgtcatattttaaaatgatggaatcatctcaagtgtctcagtgtcaatgtgtatatctcgctcaacaataaaagttaaattgacaataaatacgagcacctatgtcgagatagactagaagttaaacatgagtagatttttaccagaagtaacctaacccgttgttcacctatggttgtgtttgcaagagcaagttaccaacactcctctcttgttttccacgcgcacgcttttcaaactgctaaactgtgtgtttttgcaaaaagtttctatacgaaagttgtttaaaaaaaatcatattgatctatttttttaaaaaaaatagctaatacttaattaatcacatgctaatgaactaatccgttttccgtgcgcactgtgcaggttcccatcctcccctagcgaacacagccaatatttaatagacaaattaagttcagaactaaccatttgaaaggttaatacgggttcattcaatttccgctgcttatcttgtgtgcacaccacctctcgcagaacagaatgttagttgatgttttttttgtagctttaacttgcactctttcggtatgaaattggtacaaatctaaatttgtaaccttctctcatgtattagagtgcacctaaggctagcttctgatggtagatactgggcgggcctaatgggcgatcgatcgccagggcgattgcccagcgatcggtcccccccccctctcccttctccccttcctcctccccttcttttcctattacagtataccaaaaaaaaattaaaaaaaagttacaaaaatttatgtataaaaaatttaaattcaaatttaaatttgaatcgggtatgtaaatttttgacttataaactttggatctaaagtaaactttaggtgtataaactttagatgtataaaaatactatatatagaaaatatttgaattatttgaattcaaattcaaatttgaatcggatataattcaaattcaaatttgaatcgggtatataaactttaggtatataaactttagatgtatagaaatactatatatgaaaaatatttgaattcaaattcaaattcaaattcaaattcaaattgaatcagatataattcaaatttaaatttgaatcggatatataaattttaagtctataaactttaggtgtataaactttagatgtatagaaatactatatataaaaaatatttgaatttaaattcaaatttgaatcagataaataaacttttggtctctaaactttagatgtgtaaacttgaggtgtataaactttaggtgcataaatttactaaaatagaaaagtaatgcggtgccaaaaaaggaaaccaggtggagggagggagggggaggagggggggaggaattgatcgctctgatcgctcgcccagtagcatttccggtagatactccctccgttttataatgtaagactttctagaaatgtctaaatttattaacatctatataaatatataaatataggtaatgctagaaaaatttacattatgaaacaaatgaaacgaaggaagtatattctaaagtttgggattcgtttgatgtcgttggtttaacccagctttccttctaattaataaacattactagctaggtttgtccgagagactcccaactctcaattatctatatgattaataagcaaattcgtggataataactatacttgggacacagtaatatatcatgatgtagattggtttctagggtctaatcctttcttgacatatagtattttataattcttgtgaaaaattgaggactctatatgttggaagacaagattaagaaaacaaataatagggaaaataaatatttttatggaaatgcacatatagctagaggactgagaaatgcaagaaaagaaaaatataaaagaaggaccgtttacgatagatggtataaaagtgaaagaattttaggagagatgaaaactagaaatttttctatgagattaggcctcatgttaagggccctttaattcatagggaaaacacatataaaatttggagtatttcaattattcataagaaagcatttcaaataaaggattgaatcatcggaattattatagaatagataatcatatagagattttagagaaaaatcaacaatagctctaacttcttagaaaaattttctttaagactatctttcatccaattcatgcagtctattcatacgataaatcctgtgtttttcttatgttttgtaataatctgttttgcacacgcattacagtaaaaaaaatctatgtattttcttgctctatttttctcaatcctgcattcaatccaataaaaaattatcatgcgcactttatattaaagacggaagcagggtataactcttaattaacaccgaaaacaaatggaaaaatgaaagaaaaaactcaaacggaaagtaacgaaaccgttggatactctaatggattgtcccgtaggcaacaccaccaccgggaaatattcgccgacaaatttagcatatcctgtttatcctttctatagcgtagacgtcagtatagttcttgctttggggagctgttattctctcctctccaactccaaatccaaatccaccgtaatcatcattcatcagtacaattaatcaacattaaccgcctcattactctttagtgacccttaatttggtagccgtacagtgacagcccatctcctccacctcgccgtcgttgtttatcagcagcgagacgcggcgaagcaaaccaaactgaagaggaatttatgcacttcaccccctggtaaaattctccgagaaacaaatcgctcccacccctcgccgccgccgccgcgttgggtgggcgggggatcgatccggcggtgcccgcccgccatggggacggcgacgatggcgacggcggtgggggcggcggtggtgctgtatttcgtgctgagccggcggctggcccaagaggatgggggtggtgggggtg

SEQ ID NO: 8351 - DNA, 10362 bp, Oryza sativa
aagcggcggagggtgcgcgcggcgaggcggcccgcgcagccgccggcgacgtggatcgaggcggtgggcacgctggcggagacgctgcggttcacctactcggagacgctcgggaaatggcccatcggggacctcgcgttcgggatcaagtacctcatgcgccgccaggtgagtgcgtcctcggattcgttaatcggccttctggtctgcttgctctgctcgaatctgagaggaacgcggcggattgtagctggctggctggttggctgcacctgcaagtttttgtgttttggatctgaaatggcagctcttgtcttgtgttggagctgcacctccgaagtcgaggtgctcgcgttgctgataggaggcatgcttggggtcgagctgtaggaacttgttcgcttagatggcaagtagtagaaaattcgcgtgtaaaaccggcgaattcagctctgattgttctctatacacataggagtttgggaatttgtgtgcccggagctggtgtgttttgtactgggctgagcatagttctatgtagtagctgttatgttgatggttgggaatggtttggtgttttgggtgaatcctctctttggcaagcccacggcagggagcgttgcaactgtgcactacccgtatctcaagctgcttaatgcttatcaccaaatagatgaatgtgcaatgttgagtagagtattagaatagcatgtattttcataagaataggattagtaattcatctggatgatttcactgaagagatggttgctgacttgctgtgagatgaacctttcgttctgaggggacgaagaattgaattgttagtcacgtaactcagcaaaggaaattggagcttatggactattccttttcatgtgcaaacattgattattgtgtgcaagtttgttatcatcacgtagatcataaaagcatttggtgtctgtggaactgatggcacattttcttgtttgggttacttttcagggaaatttacatgtcgctagtgtatatgctggaaacaattgcattgaactgaaagggcctgaaataatggaagagcttattgttctgagacgattaatcgatctttgctttcttttttctaagaaaccatttccggtcttcctggaattagctggattttccccagaggatgttcttattgaggaacctaaagcgggggtgagttaagtacaaagtagcagttattttctcttcatgtattgaagtacaatcagttataatttagactaaaaaggatcacttggtatttttctcaattcctgattcacaacatatacttacagattttaaagcctgcccatacaatcctgcgtgatgaatgcaccaaatccttccttgtgttgattcgtgggacacatagtatgaaagacacattgactgcagctactggtgctgtagtaccatttcaccactcacttttagatgaaggtggtgtcagcaagttagtgctgggatatgcacactgtgggatggttgcagcagcccgctggattgcaagaagtataacaccatgtctctgtcaagcagtcagtcaatgcccagactaccaaatcagggtacacacttctttttcgttcgtttatggtttcagaactagttgacgatacctatgtttgccctgtgaaattagctgatgatgatttttcatttgtttttaacaaacctatttaatctgtgctggtgacaaaatgctctcgaaacaaaatatgtacatatcattgtatcaatttaccatcagcatcaatttgaacctggtgatccatgtcaattttcattttttctctctttatcagacatatatttgtaggtcaataaaaaattatgaaattgaaattgttcttatacttactaggatatgttatgaaatatggttgactagaaacttgaaattgtcatgttgtgtcacaaaatggtgataataagttctgaactagttgttttaataatagttgattttattctgttaggttgttggccattcattgggtggtggtactgctgcattactgacctacatcctgagagaacaccaggagttgtcttcaacaacttgtgttgcctttgctccaggtataaaaacatagtttgatatgcattagattgacctgagcaattagtaacagttaatttttttggtcagcttcatgcatgacatgggagttagcagaatcaggcaagcattttgtgaggactattgtaaacggtgctgatctggttcctacagtatcaacttcatctatagatgatctccgttcagaggtagctccatttgatgtgctattcttcccatagatgataactgtgctaatgtgtttccaaatatagttctattgttttgagggagaaaatgatccgtttgttatatttatgtaacatgattatttttgttgtccatttaaatgaactgagtctgtaaacatggatagaatatgatgccatgatatcctttctcaaaatttagtagcagtgaagttcactgtctctaatcctcccgtcttatcccctcatctaggtaacggcatcttcatggttaaatgatttgagggatcagatacagcagacacgcttcctaaatgttgtttaccggtctgctactgctttaggaactcgcctgcaatcattttctggtgccagagatagggttgcaggtgctggtgcactgctacgacctgtttcaagcaaaactcaggtaaaatatctgaaccaaaatctgtcaaaaatgtaatatttacatgaattaatattgtgtaccacaaaatgagatagggcggtttgaaataaactaaaagtgctcaaggataacactgaaacagtcggtgcatgaaatatgcctggtctgtctaataaacatttagagatttctatctgccaaatccaaatagttgtttcaatgttgttgatgaatattttgttgcaggttgtgatgaaacaggcacagaatgttgcgcaggctgttgctagaagtagatcagcattttcttcatggtcatgcatgggtgcacgccgtcgaggtgttggtgtagttgctgcaagcgctaaagaggaaataacagtggaaacccacgtcacatctaccactaattcagagtcctatgttgtagaacaacgtggcaccaagaccatggaggagctgcagtacactgcagatagtgtttcagttcatgaggaaacagaagaagaggcccttctgagtgagcatgaatcctctagggagcatgcagaagaagaaataactgaaggtgagatgtggtttcagtacgagaaggacctggatcggcaggctgaagtggaggctcagaccaggcaggaagaagcagctgctgccaaggaaataatggaggaggaaagtgctgttctaaaaaatgttgaggataggcaatccttttcatctgatagtttggagaggcagcagttctaccctcctggtagaatcatgcacatggttgccatgcctcctgcagattcttgccctgatgatccggttgctgctgatgagtgcagtgtgggaatatacgagaccccaagggatctttacagtaaaatccgtctatccaacaccatgatcaatgaccattacatgccgatgtataagaaaacaatggaaatattgattgagaagtttgcgaacaatgatgaaaatttctgtacagactcgacagtagaataatatggatgacttgtaacatcgaagtgtatagtagttctttctgtttagctttaaccacctgatatgctcctgatatgcaatatagaaaagagatgctgtcctgaattacaatatagaagagatgctgtcctgaattagttaagagagttgtggatgatatgatatgtaaaatgtaaatgaaaaatagaattaatggatgtttattaacggaaaatattcctcatacatggtgtttctctgtttagacccacatgcgttttgtaatgtcagaacatagggctgattagccgcacgtaaaacatgattaatataatgtgctaacgaaaaataaggaactagccaaagccaaaacacagtttagaacagccctctagtgtactatacttggagtctcagttttttaaaaaaacgatgtctcaatttagcaaatactgaccacattattactacacgctactcaagatggtgattcccattttaccgctggtatttcctatttttccttttaagacttaacatatgcagttagaaacttctagaatacatgtttaagggaaatatccttataaaaacctttgtaaaaaccgagcatatttttttaaaaaaattcatgaagaaaataatagatatatataatgtatatacctaacctcattaaccttccccttttttcttctctcacgagctatcgttccttaaagaaaagggtgaaaatatacttcatacctatggtaattgtttcatgaattacttcatatatctatactgtctatagtaatttttttgacgaatttatatcccctttcatgtttaacctaactagggacattttagtaaatttttaaaggtcaaaagtgtcaaaatcctcggttcagaaactggcccgtttaatatgagaaaaaacctttcaccatcatacttatatcgttttaacgttgcaggttggctctgtcgtgtaggccccggttgcccgaggggcacagggccttccaaaaattggcgcgcgagcccgcccaaagtagggacgggacatcgctcgcaccatggcaaagcgtgttcggtttgtgggtgtcggcgcgacacgtcagtctctaaacgatcatcaacgagtcgcctgatcaccccccgcagggacgggttgaatccaaacagaggcccccccgagccttttatagcctccggccgccccgctcccctcctcatctcacgaggtggtactaaaatccaaccagccgtcatctcgtcccgtgctcgtgggcttcagagtaagaaatttgcccagtgggttgggcttggtccactaataattttaggaatgagttcactggaggtccctcaacttaacagcgagattttttttaggtctctcaaccacaaaacaagatagatatgttcacctctaaactcattcaaaccgttcaccggaggtcccttggcagtatttttgcccggttttgctgacgtggcatcctagtcagaaaaaaaataaaaaaattctatggggcccacttgtcagcttcacgcatctttttttctctctcttcacttttcttctcctcttcacttttctcttcaccgacggagcgcgcggtggacgagcgcggcagtggagcggcggccagctgcgggcggagccggcggcgggcgagcgcgacggcgggcagagcatcggtgggcgggctgcgggtggagcggacggcgaacgagcacggagccacggcccacgggtcacgagaggttcggctgccggcggcgccggccagcgacgcaaaagaaagggagggcgtcgtcggcggcgggaggtggccggaggaggaggtcgccggcgagcgcgctcctgctcctgctcctgctctggctgctaccgcgcaggcgcggcggcggtggcgccgatgtggccaggaggtatcgccgatgcaggggctcgtcgttggtcgtcgtcacgggaggtatcgccatgcgctggggatgtcaaaatgcagagagttcgcgtcttcgaagacggccatgagctcggcttctcccagcacatgcccctcgatggcgtccatcagcttgtccttgatcacatgtaagcaatcaagaatcaatcacagttaattaatccttaaacagcaaagataatcgctaaaagattgttctgtcgacttgtcttgttgccgaggtgcacctcgtcgtcgagggcgtagagcttgaactggatccggaggccgcaggagggagggatgacgatgacgccggctgcaccgccgaggccgcgtcctgcgccagggccggcgccaccgcacagccacgctcgcgccgagccgccgccagccgcgccccgacgcatcggcgccgccgtcgctcggtcgagctcggctgcatcggcgccaccgccgctgcgcctgcgcggtagtagctagagcaggagcaggagcgcgctcgccggcgacctcctcctctgcccgccgtcgcgctcgcccgccgcccgctccgcccgcagctggccgccactccactgccgcgcttgcccaccgccgctccaccggtgaagagaaaagtgaagaggagaagaagaaaagtgaagaggagaaaaaaagatgtgtgaaactgacatgtgggccccacggaatttttttatttttttttgctgactaggatgccacgtcagtaaaaccgggcaaaaatagacctccggtgaacggtttgaataagtttagggacgaacatttctggttttgtggttgagggacctcaaaaaatctcactattaagttgagggacctccggtgaacttattccataattttactaactaagtttgagcccaatagacttagcttggcccattgttagctttataccgatttagtttgagtcatttcctcctgcaaagaggtaaagcgatgaagaaataacatttgggggaaaatggcttcatattcagtataattcccacaataatagaagattgtaaatgaaccttattcaaaataatcacgaaagaatacatcattattgataatggtggtgcctgatgcggctacaaggtgaagacaccagtttcaacataactgcctttcttttgcaagtgcagtgcgaaagaataaagtgaacggcaacattccttgcctaagaaattattttttattccctttgtgatgggcgaactaacactgcccgattctctctttgcttttcttctcttaagttttaactatttccacaagacatatatacatctatacaattgtaaaaaccctgtatgtaacatgtacagcctaaaaaaagatcctatgggaaaactataccaaacaagaagctaatgctactaaaatgtagttaaaaaaatttgggagaagctaatggaaaacttgcggggacgtataatattcgctttcgccgaagaatggtctcaagtcctcttggcacatgaactccaaagggaaggaaacgagatggcccctaacggcctgtaatttttccataggatcggtgcctgccagatccccatccttgtgagtttctgttatctctacagcaacacccaggtcaatggttgtgtggccgattttctccttccggtgagcaaatccttgcctaaattgggacctgcaagaggtcaaaatagttttaaataccagaggacatgatactgcagctgaaatgcaagcaacctggaaaacaggttatttgttccatacctagaatggatgtgatcattgggaacacacgagaagacattttggtatatcttggtgtttgcctgccatacaatatcaatttgttcagttagagaatgaggtaaatgtgttcacagcggtataaacagaaaatgcagtggaaaattatcagctgctgaaagatggcaaaagttgagtagaaaacagtgcaatgccagaacccagaacagtcatattcaaaagtttccaggttgagcagactagcatttcacgataaatctcaatttcactcaccttagcagtgcccatccagatgttgttataagtcaaatcgtccacaggatccataatttgactaacctgttaaggagaagtgtcagcagaaagaaaactcacaaaaatctatgttgtacatgcagcatcaataccgtaatgtattgtgaaaacaatataaatgcttctgtcaatattctttatatggaaccattcatcaagtggagtttacacaggacgttcttctactgtggttcactgaagcaatcacaacatgaaaggtttgtgacacccaccctgaggcctaaactttcaagtttcaaataaggaaaaatagaatgcaaaaattttccagttttcttattcacaaagaaaacaggtgcacacaggctacactttacacattaacagggcatggaaccctgacatctaggaaaagatgacaaggtagatgttttccagtacaattataccaggtaaaaggatgtaagtggtgccatagtcagttatcttaatcttgacataatcagctaaaagtctatatatgtatggtggctttaaacttaaaagagttggtttgtgattcaagcaagtgaaacattgtacaaacctctcctggatgaaggccaaggtgttctgcccatagagaaagtcgtaggctaagagagaacttccctgcttcccaatgtcttccatccataattgaactgacaacctctttatcttcaataatcataccaatctaaaagagaataaaaacagatcgataatactggttatcttcaataatcataccaatctaaaagagaataaaaacagaccgataatagagtcaacagcagacacacaaatgacctccggatgccactaacaagatgtaagcatgccatttagtcttgaccggatgcagttggcaaagaaagaaaaaatatattccctaggctaggccctcctttaaaatattaattcgagaacacaacaattaatttatctgtatgtctgcaagcaattttcatatactcttaatatataaaaatcatacgtgtgcatctgtcctgaaaattgcttccgtaatgtataacttcaattgatattcagaaatacattatgatttttcaagaaaaagaaatacattatgataggaacgctgtcaaagctgtatttggaacaccgtcaaagctgtatttggaagactgtcaatgttaagatgacatgcatttgtgactggagggcgtgcaaccttaggagcagtcctctgtttaacctaataatgttggggcctgtttggagcacacaggaatggaatatctctgtgttccctatggggccttagcatgcagagaattagacaaaagaggcaactgagaaagccatacctcagaatcccttgatccaagcaaacttctgtcatttatgttagctgatccaatcagtgtcatccggtcatcaatgatcatcaacttactgtgcacatatatctgcaaaattcagactgttagcaaaagaaggaaaagaaagaaactaacattatactaatcttaatccatgacctaggaaggtaacaggacaatattaaacaaatagagtggaaaattaattcaggcctctctacctgattggtgaccaaaggaccaccatcacctagtctgccgtgtgccctgagcccataaaaggagatataatcatgggctttggaaccaaccacatcataaagattcttaagtattgaattaggccctctacaaatggtcctgtattgccagtgcataattgctctaacagatgctgctccaccgtcatcaatgcctccctgtaattaaacatgtaattaaccggccaacacgaagcatcaaaaccatcaataattgttacaacagaacatacctgaaatccaggtaaaagcggtatgacaattataacccggaagcaccttttctccttttctgctctaagtatacgcctgtataatgcttctaatacacggttttttattgtgtcatctcctgaaagacctgatatgaaaaactgattctgcatagaccagtaaaatgaagcttagagtttagaccaagtgaaatgaatctgtattgtatcatctaggtatgaaatttcaatacttccaaatatacaaattttcttggagtttgtggattacatttgaaaatcaagagattaaaaaaggttcagcacctcaatgtacacaaaatgttctgctttttcgatgagagaaaaataggcattgtggatgctcccttcaatttgagttgttcctgctgaccacggaccaacacttcgaacaacctgagttaaaatttaaaatgtgtgtttgattagccacacatgtataatacagttgaaaataatttctatttgttttttagtgttactatacaagcaacattcctaaaaggacaataaaatcatgtctcaaatactccaatccaaagctccacctgtaaaaataaagatatacaaattccatgctttacaaattcagttttatctatcggtatgacatatttaagctagagcaagacatatcttcactccttataatatttcagttcgtggtagttatggttgcttgtacacccatccctcctctttagttggaagaaatgatagcaagaacccacgaggcaaatatagacagcgcaagagaggctacaataccaacactacctctggcttatgcataatactccctccgtattttaatgtatgacaccg

SEQ ID NO: 8352 - DNA, 37777 bp, Oryza sativa
catacattaaaatacggagggagtactacggtaatacccttgcattagacctaatgcgcttaaattcacatccctcctcccacctccagcattaactgcgggcttgtatcctcaccacagatccccaattccttcactcgcatatctgtaccatgcgccctccatgcgccctcgcattgcacttcctactttgcagtatgcactatgcccactaaatggctgctgctttttgacaggaaaatacattcatagaaagagaagggtgtccggcactaaagaattgtatttattttaaggattgacagctcagttctcttttcataaaaaatatatattattttaagagcaagaagttaagtttcagtttgccaacccattatttctccagatcattcgtctaatggtgaataatctgagttgaaccaatgctagcgtgggtgttaacatgctttcaaggaggagctaggcctacatttatttaggcttagggcctgttcactttgatgccaaaaaaaaccataccaaaatttggcattgccaaaattttggcatagttgccaaaattttggcatttgccaaaattttggcaacttaccaaaattttggcaggatttcttttatagttatcaaaatttggcagcaaactaaatgtggccacttttttggcaactttaccaaaatttggtaaggttgaaaatggcatcaaagtgaacaggcccttagagggcaagatcttcattttttgcaatcatggcttagatctgtataatcctcttgatttatagttaatagttttaacattttataaaattatacacagggggaatccctactgcttctgatataaataataataattctgagttgcatgtggcaaaacacaagtcttgggtaactgaatttgtgaagttacactatccaatccagtaaccaatatagacatcaagaaattattactaatgtccctgtttgtttctccttaggattgtaagaagctgatttttaatttaagaatatgattttaggaataattttagagtggtttttgtcattttcattgtccagctcctttttgtaattgtcagcaatacaggtaaaaaatctacataaattattcttaaaaatctaactttaaaatctaataatccacaagaaacaagaagggctgaattgccagtgtagatggtgcaaactaacctgacagcaacaagttgctcggggaccaacttctccaatatcaagcacataatcgacctggtctcctcgctcctgtgtctcccaccattcgttatccatgtgatgcacattttgttttgaggtgtcataatgtccaattactgatgaaacatctggggtaccaagattgtccacaaaacctttcatctgtaaatcctgaagagaagtatcttgcttggccttccggttgggaatgggctgtttccaatgggttttatttgggtgatctgagtgaccatgattgttatctaaaccattcagacctaactctccattatttgatgcctggtgatcaggctcatgaggcaaaagcaatggaatgtcctggcatgatgctggtgctttcaaggagcttaacttctggcctttaatatcctcaacatgagtctgtttacttacttcctcatttgattctttgattttacccatgtaatggggaattaccatgtgatgttgaggcatcaataagggaattgcttgctcatttggtgctttgttcctctgcataagattgagttgtcaatttcaacggtgatagggatgagtaatattaaccagtaaacatacctttgcatagttccagcgctgaacaaaatgccttgctatgtctcggcatgcaggaccataaagagcacactgaacatcatgccagggcatgcgaggatatttagtacgatcaagctcatctttcatggtgtcctcccaagaatttggctcagattcccttaaacaagatagtaaaatgcaattagataggcaaaaaaaaaggttttagaatcattaggaaacattaatcgtgttcggtaaattaggaaacactatcctataaatcttgagataaaaatatgatgagagcacaaaacattacctaggattgtagtaatcttttcctggccatattgaaggaggaacatccacaactttatgctcaggagtatcataacgaccaaagcataaatcaaggcctccaatatagcatacttgattatcaacaataacgattttctcatgatgtgaccttcaaggcaatagccaaccataaggatctaattaactgcagaaatagtgtaaatgagtgtaaagttctcaccgtaccataagtatatgccagttgagaaatgatcagggtatcgcagaactttaacattctcatgaatgtttaaaagcctctgtttgctgtacatgctgttaattttcaatgcaagagaaacttccttgtacaaaagaatatagatctgcaaaatagtaccaagtcatagttatctgaaacttgcagttgagaagaagtacgaattaactcataataagcaaacgcagatttgcttaaaaaaaaacaaatgctgcttagtgtcccacaaagaaatgaaatttatacacactttcttaaagaattatgtacaacaaagcatatattcagcaatcctagtgatcctactattcataagatatacttattttggtatgactacaccctcaaaatcttacaatctaccttgcttccccaatcctaccaacacataagtccccagtgagcactgtggcataactaatgttgcaccccacaatacacctctgacaatttacacaggatatcatctggaaagggtaaaaaaggaaacaaaagtataacaatactatttggtcaaattttacttgaacaaaggaaactatcagttaaatgccattattggatagtattgcattttattttctaactctctagcagtcaaaataaagcaaatagtatagcaaagtgatgttagcatatgcaaacgacatttgtcttggataaaagtgatggagtgctacgcaaggtaatcgggcaatctttgcatgcgccatggataaagtgcacctacgtgagaaatggaggcaacttttgcatctttcttggataaaagtgcaactacgtgagtaatggagataacccttgcaagatacacaatgcatgtttatcacttgtaaagagcttcagaacacataatgagtatttttggagaattacattcttcctctattagcacgacatgcagcttgtatcttcacaaatacagaacattacttactttaaaatgcatacagccaatatctgcaaagttaaacttcatacacttgtctattatcatctcatgtagacagctaccagttaaacatttgatgctaccaaatctgttacaaacaaataaatactgcaaagcggcaaaataatatatacgagtgcacaactgaacatgattttagcgcttgaactgattgataacaccataaaacaatcacatacctgtacaccttgctttgcccttgattctagaagaatatcaagtctagaggattcatgatggtggaaagggcgtcgaaggtacagttctgggcacagccaccaatcagtaatgaatatctgcatttaacagtttaattatcttccactgcatggtcaaaattttaacctttttcggaaatagtagttgagctaatgaaaatcaacctccgatttggcttcctcaattgaagaagcaatagcattaaacgcagcttgcccatcaagaaaccattgtacgacgctaccatcttcagtcaaacccctaggtggtgcgaatgaaccaaaacggtgtgggtgagaccaaccctctgggggtcgtcgagcagtatttattgcagatacccaatctttcactttagcagaacttcttgttctcaattttattgtccgccccccagaagacaccttcaacaagtattagcacttagaaacttacagtgaaaaaacagatgccgcatgcccacatttattgcatgctaccatcttggtttacaataggaagatcaaggccaaggccagtatcacaaaagagcttgagttttattaacatcagcggagtactatacattagttcctacgtttttctatgacagaactatggacagctgatttgtaccaggatatatagctgtagatcaactagggagcatatgtagaacaagtactaatataaggaacgtgcagaagatgggtgataaataaacctgttatggttactagtttctcaggaagaaactaaaatcaaaaatactttcataaagatccaactcctaggaagaagctcagcgactcccatgaagcactaaagaagattcaccatgagtcagagccttaggtgtatacccactctatcttgcttaacgaaagttcatggtatggatggagtacattggacaattatagcctcctgatcttactacaattatgttcatgtattggtctggtttcatctgacaaaaaggaaaatatggtcaaaaccttttggtcattggatgtatccaacaaacacagaccagttaacaatgatttggtatgagcattatccattttgttaaaaggagatgaagactagagtatcttgtgaagtgccaggcaagcaaaatgctatcaaaatgggaaatgccttctttagaaaattttactcgttttattcactcatgtcaccagttcaggcacacgtattagagcctagaggcatactagcatattgtttttctagatcatattttaacaatgatttttttcaactaaacttagaggagcgatgccagttgagactgtcgccaactcagaaacatgcttgctttaccatatttagaagtcatatgaaactagattttacaattacatcaactcagaaacatgcttgctttaccatatttagaagttaaatgaaactagattttacaattagatacaaacaaacacattttgttttgactggacttaaaacttatctgggtaacaaatcaggttaaagaggtccatgggtcaacaaagtcttaatgttgtggaagacggtgacaaggttataagtttttttttttcatttgagggaggaacacgctgtagaccagggcatacctcaaatgcaaagtgcaatggattatgttccttaatctctcttgctagagtgctttggccttctccatttctatccatgtgaggtgatacatcaaagataactatatccaaaagctttggatcaaatggatcttggagcaaagctaaaaatcctggcttcagtacagcccaaacctatgaagaagtgttcaatgtcacgggtcacaaacaaggactaataaggataaaaatagatataaaataacatcaatgcgcatcatttgataccttctgccagctactgttgcagaaactaaaacatccacacaaacaacatatgttactgctaccttcgtcaatttttggtaagtgtccaactgtaacataatcttcctttagcttaggcccatattctggtagaaatgataacagagagacttccaaaaatttacaaacctgcattttatttcatgttacagtccaaaagagggtagcaccacagaaatatatcctaattgacaaattcgatgtttttggtgatgtatagacattataaccaaaacaaatatgacgagagtatagagaaaatataggctttttggtacctctcttgagttgacaatttccatgtttcccaagaaatggttcagatattcttgcatggcaacctttgcacgatcagaaacagattgctgacgaccaagggctggacgaatgacaggcaagacagcactagagggaacatttctgcaacaaaagttttgtattcatttcttaatatgcacaggtaaacttatggcaagtcaactactccaattgcatcaataaactggttacagaaagatttcattgctgacgttttcgtcttcgttttagtccattaaggtcaaaattattaatagaacagcattacctatttttgacagagtgttcatcatgttgtgaaggaacatgcacgtcatccgcttcatcatcatcatgcacaactggaatatgctccccaattcccaaattttgaagccattccttgacctttaattttgtttgaaaagaaaaaagaggttggttcagtttcacgactgaaaaggaggttttgttctgagcagtgatatctctcctactatgaattagcagccgagtaattagagtagaaagagcagtggaacaaaggtctgaggattctctcattttttattaagtgcattcttcatggctataataataacaataggaatggcatactagagatgcttgcaacaaatattatatgtttccacaaacaagtggggcatgatagttcatggcgaatgaaatgcaaaatagtaaaccagagaaaattatgtttttcctaatacgtttacaacatacaataaaatgtcaaaatgactgtcaacaaaagtggtgctgcaaaacttccagtaacagatttttctggtgtccaatcacagcattcagcatttcaattgaaaagataaacagatgcaaatacagctaacgaactgtgatgattatgtaaccgacctgttcctgtttctcatggaattcctcaagaaatgcacgccttttcaacgcaaaatgtagatatagaacctgtgatgccttcttatatagaagccacctaaactgatagaagaactagttaacattaccgaaggataaaatgttcataattcgcatttcacagaactgtaaaatctcaacaatgcaaaaaggtgaaatgaaaatagcatgtcctggataataaaccactttcatatgatttttttttacagaaaaggaaaaccattttccttatggaaaagaggttcaggatacgaatccatagggaacagactaatggtgttagtttttttttacagaacatatcaactagacataagctgtgatagtgcacagctcatgttattccttgacttgggttttatgtttccatgtaacaaagcatacatgtgcatccaccaaattggaacctaacattacaagaagttcaaacagtacacttccttggacccaaaaaaaatgaattacagataggcataggtagtcaactctaaattcacgtgaaaataacatggaaatttcacagtcacacgcacagcactgtatctgatcccccccccaaaaaaaaaacaaagaattcgcctgcatttgcactgaaaatttaatgatcaggtcgcctgagtttcataccccaccgaatcagtgaaacaaagtaccaaccactctttcgtgcaagctccaccaagctactcattgacatagttgctacacagacaacagaaagggaccccttcttcttcttcttcttctttttttcttttcgttttctagcagcggtggaggctcactctatcttaaaccgcacaaaatcaggtagtattttttcttttcattaaaaaaaagggaaaaacacattcagaagtcaattggaaatcaaatacgcgcaggcatcgacgaaacaaaccatcaaacatcaatttacgcaacaacactacaatgccaagcaccatggacgctgccgaatccaaccccgcctcaccaccgaatcgcgcaacccgtaccccaccccaaaacgaaaacccgagcaggaggaggggggaggaagcggacctgcttgtactggacctcgacggtgtaggagagcagcatgggcgtgatgtccccggcgtcgggccgcgacaccccgacgatcctcgcccgcggcagctcgtcgaacgcccccgccgactcgggaagccggaggaacgaccccgcccccgcagccgccgcctccccctccggctcctgcggcatcctcacgtatccccctccgtactcctccacctcctcctcctccgcctcctctccctcccgcgcagccgaccgccccccgctcatagagacacaacccacgaccacgagatttttacttccggagagagagagaatccggcgaggtgggggggaatcggggggagggcggcggttgggtgctcgttgatcggatgcggaatgcaacggaaaggaggaggagggaggaggtgaggtgacgaccggcaggtggagagggaggggggaggtggtgggatctaatattttccggttccgttttgagatggaattggatgggttggggacggtgacggggtgacggcacgggaggggcgtggagggacaggtggacgtggctgccccgctggtttcgggggcgtgggggccagccgtatgacgtggcatgggagagcgcctctagtgaagggcacacttcattcaatttggctcaactagaaaagggtcaaccatggcatctctgagcccattctcaactcaatggctagaatagtgtcaatagcattaaataaactgtcacctaaaaatctatgatgaaagatgatgtagcaagtgataaatgaggaaagagaaggaaactaggtctttgcatgagacatgatttctacacaatacccaagacatcatgtgagataagtagcattaaatttaagtatggaaaagtgatgtttgtattgaaagagtagtgtctagtactatctccattttaggttataagactttctagcattgcccacattcatataaatgttaatgaatttaggctcacatgtatgtctagattcattaccatatatatgaatgtggacaatgctagaaagtcttataatatgaaatggatgaagtattagtttcttgataatgtgaagtttataaaaattatatctaatgtcttaggttgggaatagcctgatgcaatgttgctgctagaatgtggtgacacgatagtaatctacttcctttttttaaactatgtagtaatctactagtaaaaggattcaagtcactgacacatatgggccatggcaaagtgaaaccacatgtcagtgactcaattgcttatacagtttagtcagagaatatgcttatatacagtgcgttgtcttaaaaaaatgtactatagttcacgtgaatatgagctaaaacaactcaagaaacaactagcatgttttaaatatataaaaggttttgtccacgtaattatatagccaaatcaccttatattctgatatagaggtagtaccttggaaagcaagaagctaaactctttcagtaaaaattactcacatatcttatctaaataaaatatgaagtcaccgagcaaaaaactttctatagaccaagtgtactgtaaaagataattcaatatttcatgggttaaagaaaacttctgccatgcctagtattgtttagcacttgaattgtcatgaattcatatgaccatcgaatcaagctcctatcactgactctataatcccgaactgtccttgccctttcctctctataaaacatcgtttaattaaactcgatgagaaaaatcgtttgaaaattaatcatccttcccagcaacggctagttagctcacgtaaaccatttgcattagctggtcccagtggatcgtgggacacccaattgactagtactacggtaaaaagataattaaaaacacctataggagtacaaaattatcctcgtcgtttttggcaaactacagccaagcaatttgactgatgctaacttaattaggccctctttgtttaggtttataagccaaaaagtctaagccaaaacaaacaagcagctttttcatttgtcttttttgaagccataagccactctaacactattaagccaaaagctatgttggagaagttttttttggcttatatgagatagatatatgactccaccactaaacttaggacattaaatctactggcttataaatcatataagccaataagctgacttaaaagtttaggccaataagtctaagcctaaagagggccttagtggcctcaaatgaaatgatccgtagggggtagttgatgcggacagatcgatggatggaatcagccggaggatcgcggggaaagggcgcgagaatatgcgtgttttgtgcggagatcattccttgcaagataccacctgacgtggcgcacgcaagtcgccgcgggagcggacacgcatatctccgtggcttttgattggggtttaacgtgagggtgatcattggaagaaaaaaaaatttaaattatattattgatttttttctaagaaatatgcgagatttaaatggatttgcataaatagatagtgtcacggtacgcagtacgaaatcgtaagaccaaagtgcgatagcgatgatggcatgatgacgcaagtggtcttgcagggcgagagtgctagatcgctcgctggttgccgtagcccggaaatgctactgggcgatcggattcttcccccctcctccctctcccatcctccacctggtttttttggcatcgtattattttcctattctagtaatttatttatgcacctaaagtttatacacctcaagtttacacatctaaagtttagagaccaaaagtttatatatccgattcaaatttgaatttgaattcaaatatattttatatatagtatttctatacatctaaagtttatacacctaaagtttatagacttaaagtttataagtccaaagtttatatatccgattcaaacttgaatttgaattcaaatatttttcatatatagtatttctatacatctaaagtttatacatctaaagtttatacacctaaagtttatagatctaaagtttatagacccattttaaatttgaatttgaattatatccgatttaaatttgaatttgaattcaaatattttctatatatagtatttctatacatctaaagtttatacacctaaagtttatagacccaaagtttataagtcaaaagtttacatacctgatttaaattttttatatatagtatactatatataaatttttctaactttttattttttaaaaaatttttgtgtggtgtactgtagcagaagagaaaaaggggaggaggaagggggagaggagggagctgggtattgtatagggggaggagggcacatccagcgtattgtataggggaggggggcagatccagcgtatcgtataggggggaggggagcagatccgatcgcccattaccccccccccccccccgggtagccagttagagaaccctcggtcttattactcgagcgacaccggccggaaagatgctaaggccactctcaatgggaagattcacggtcggatttcacatacgccacatcatgtgtcaatgcattaaatgtgcatgaaactctcctgaaatgcccattgagactggcctaatgacacaattaataataatcttaatgagtaacaattaattacttcctccttccctaaattttgacgccgttgacttttctaaacatgtttgaccgttcgtcttattcaaaaacttttgtgaaatgtgtaaaattatatgtatacataatagtatatttaataataaatcaaatgatatgaaaataattaataattacttacttttttgaataagacgaatggtcaaacatttttaaaaaagtcaacggcgtcaaacattttggatggagggagtaattgttaatggtgctaattgatccattaatcacgcgagtgtcatggggctgtttactgtatcgttggtgtgaagctagctttttgcgtttgctgtgtgcttggcggacccaggattttaaccctgggtgtgcctatgtcacgagccaaatcatagctttcacagtttataaaaaagtatagtacaaatggttattattttgacgttgaaccagtaatgcattcttagaggaactgagcaaaaatataacaacaaaattgcaacttattcctattgtcttccgatattattcttccctattttgaatttccttataaccttgtgttgacgtaaaaacacgaggcctgggagatctgcttaactccagtacaggtccaaaacttgcctttgggtatgtgagcgtgccatttgatttgatcctgcaatcaacaagaaacaaagacaaagaaaccgcggttaaatccataaacgatagtcgatcggctagatgccgatgacatatcatttatctttgagccgatgtcatatatgcatcgatcggcggtcattaataagtaagaaagaactaaatctatttgatcggctgtagatattaacggtatatagtccttatatcgatatatacttaaatcaagtgattgggatagatcggtcgccatgccgagacagtataaatcacttagatcgaaatatatattaataacgagactatatgtgttcatagcatagccaatcagatagatctagcatgtatcggctaatactccgatactactctatattaagatatcacagcaagtaaaatataccaaatgaaagcctaatatacttaaatgcaataagatcttaatataaagggcagatttaacatgtcaatgaagcacataagatgaatatagttaaattaggtaagatcggctgaaaccccgatactaccctaatcggcaaccaaagacatgctagagattaaaattctaatcacgactcataagatcaaactcaactgatgcagctataagtatgaaaagaaagacaatatctagacaatcaagccgctggaagtttcatagagtggtggatatcctatataatctaagtcaacattgatatttaacctaatcggctgccttctactgacagatgttagccgattgtaggttagataacgatattgtcggagattatataagatatatgataactcgacgaattacatagacaagattagagtatcataaagatggaagcactaatcccgagaacgcaagccgccataacaagttttatctcttgttgaagatcaaaactgatgcagctcaacccgaaagcaagaacttgtcgaaacaaaacgaaagtaaaaagggtggcgatgcgccgagattatattgaacgtgtgttaatttgattacatggggctcgggtctatttatacccgagaattacaagatatgtccatatcggacacgactcttatccctaacaaactctaagataccataagtctttgcggcagacttttgcccaaacatatctctaagaaaattacataaaatatcctaattaatagatacaattgacttctcaggactctatccatgcacggcaatcatcatgaagcacgtcaacctaacccgacaacgcatgtcgtgccatattgtcggattcggctcaataggctaaccccgtctgactcgaactccgccgatcttagtcgtagccgattcggactcagccgatcttcactctgttttcatgataatctctatctcgaactccgtctcgatccctcctttacatccgatccttgaattaccaaatttggtcgttaacaccttgcatcaccatcacgagagtgaagccctggatatagccttggtgatgtagaacaagtgaaataaaatactccctccgtttcacaatgtaagactttctagcatttcccacatatatatagatgtttatgaatctaaacacatacatatgtctagattcattaatatctaaataaatgtgggcaatattagaaagtcttacattgtgaaacggaggaagtatgaaagaatgcctatgttcctcctcataattgattgattcaatttgacctaatcctagagatcatgcaacatgccttcactgatttggcatttccattttaatcaaatatagccatctaaggaaggaggatgagagattttgcaacttcagatattattttttcagggttttcaattaatccctgccaatgccaaagacaagattagagttatagaacaaaaatgagaaaagagtatacatgcacagcacggctgaaccctgctggtcaccgcagccgagtctccttgtcctcgttgccttgctgattggcgcgcttgccaccagaaggaacatgatgcggacatcactatttcggatacatacaacaacaatcctccaccggtcactaaaggaccgataacaagagctcgcgcgcaacaattgaatttagtggtgagctcgttcctatattcttctttgtacgaatttgagaatagattgctacctaatgattatattgtgattaggaacaatggaggggacaatgagacacttggagaaggacttagagtcataaacgatcatcgaggacgtccaagtcaaggtggaggcccaaacaaggtcgacttcgagtgcaattcggagtccagtaccagtatgcactaaaacgggcgcccagatcgcatacgtgctcggattggggcgttctttatatggatggaaagctaagaatataacatttccaatggttttggtcccacgtccaaattctttccgaatcaacagggattgaccgaacaagttgacgtccagaatctgttccggtgctgcatcaccgtatttgggcctttgagctgtgtatcgtgttggaacccattagggttgcgtcaagggttggttgcacgaccccaaactctatatatcagtacccgccgtcacctttagggtttggattttgcttagattattctgtcgagaacaattttgccgctagatcggtttgtaagacctcaacttgtgagcttaatcatttatctgcaattttggttgtattctaccttgttcttgtttgttttcttctattcgcaaacagggattagccttctcggtaaggtcatctgcgttttgacacgggtgataaccagaggagacatggtgctgcgattgcggggctcaagagcgtgtttgttcaagaagccggatcgatttgtgtcgcgactccacccaaatcgttgattatcagaacctttcagaatatcgagaaccctagtccacatcagaacacatgcacacgccaccgcatggttcttgtggtgagctatgcgagaacgataaaccactaggccttgatctgtcgacttcttgataaaaaacgaggcaccattcatcattcaggccaactgaagcatactagatccccttttttttccgtaaattttgggtatgccggtgcccacccgacacatccccagggtccacccctggcttaagtagagtactgagagggtacatgtgggaccggccaacagaaatggcaaacaggaggaatagaaacgggaaaggggagaaaaaagaaagaagatatgttttcggatacaatatgctgtaaagggtgtggttttgtgataaaagattgctgaacttgtgaattttgcgataaatatgtctcaaagcttggtgttttgtaataatttactgatatgctagtggacggttgaagagatgggtttgcagtgcttccactagcgcttttcagtgttatttaggtgaggtgataagtcctaagaagagaggttggagaagggggcaaaattaaaattttctattgtatttgttgagaaaccagtctattgtattgattaacacacaagcaaacaaacacataattgtgaaacacagaaaatatggacaagtggaagctttatttcttctagatttaagtataagctgcaagagaagaagaggaagtgcccgagatgggtcaacctcaccttggaccttcagagccctatttatacgcggaggaggttggcggcttgcgatgtaagttggtttccatggcaagcttgcttctcccgcaagctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagttctacttcgagaaggggacatctatgggtataaatacaagccccctaggaagagaggggacacgccacgagggcacaagatacacaagccaatgcaaaccaatatgtcaccagataccgacatcagagattagcctagacaaacccaatccggtgcctacggaggccgacaagagggattagcgctatctctgatctcgacgagttcatatttgaggaggaagacaactctgccgtcgactacgtgttggttatccatgccgccaaatcgacgaaagctagataggttatccaaatattgtacttgtgtgattcagatgaataagagcaacaccggcttcggccaacatgatgtagggctattacctgtcagataaggggcccaaacatgtataaaatccttgtctccatctcttttacctcaatctcacatataccctggtaccgacgatctccatactatccaaataccgtagtcgcgatctcaaacatcgacagtgtaagggtatacctgagaggctatacccgcctacagtatttgtatagtatgagaatcgttggtgcaagggtatatgcgggattgaggtaaaagagatggaagatggtgatttttatacaggttcgggtccttaactaacaggtaataaccctattcctgttggccgaaacatgagttgcctttatttgtcgaatatgaacttggcgagattggagttgtgttatattgacctgtcttcacctctgttagcctatcccctctacttccggggagtcttgtatttataccctcgggtgtccccttgtccaagtaaaactaggaaactaagtatggatacgatctgagtagtcctttcatgcctaagtagaactttgcttctccttccttatctagaacaccttccatatatgaggcttttgtataagacttgatatatggtgggcatcgccaagcctaacacaaaagttataggtatgtcttttctataacactgacaatactctatatgttgaaaaattgaaatgatgtgagaactatgattgacatgcttgaagtaataaattgtagatgatgtgacatagttgcatgagttttaaatgctctatataataattgatagtggatgatgatgtttcatatacgtatgttgagctttgaaagtagtgtgtacaacaatatagaagatgtagatatatctttggaagtggcattattgagttttctctctttcctaggctttatatcctgcttcttgggccttgactaggctagcttctcctgttctttgaacagctattcccgattggaataagtctattttaccttcctcaactctttgtgttgattgaatcccctccctcaaccgcaataccgagtataacatcttctccatcttcaaaaaccgatacaaatcgagtccctcaacggtttggtgaccacgtggcatgttgacttggtcttcatgccatgtggtgtctacgtggcacttacgtgtcatttagaaaaataaaaaataaaaaacttagtgggaccaacatgtcaatcaaacaaaaatgtaaaacatagtaggctcacatgttagtcttctctccctttacccctatccactcaacagaagcttgatcgccagcacagtccccttctcgtctcctcgaacatagcccggcaccagatctagcctcttccccatcccatggcgactgcgggaagaagggttacagggagggccgagcccgacagagacaacgacagtttctcctctcctctcttctccctactctctctctctctatctctcttccccttttctctccatccatctcttcgagcggagaaaaagacatcgacgatagtgatgggggacggtaggctggcgagggcctcagctgcgcctgtgatgtagctccgtcgtatcgcccacgacctcaactgtgctgcccagatgtacggtgcagtggagctacgctagtcgattccccctggcggcatcgcggtccccggagagaggccgatgggaagagatctggcaacaaggagcacatggatagagtagcgctgcttggtgggggggggggatccggcgactgccactctggaagatccacgccctttggaggctggctcaatgaggactgagactgactgtggcaggaggtgcacatccaagcattggaaccatcacggtagcgtatggcggcttggtagagctcgtcgtcaccgggatgggaagggggaaatggaggtcggggatgggagtgaagggggaggggacaagaggagaatggatgaccccatcattgtcaaccattatcgcgcttgcaatagctaccgctttcaccgacagccatcgagctcatctaccgaccgcctccgccgttgctgccccatcctcgccgaccgccaccttcccgtggacgagctagagagctcgccggccactgccgacgccggagatttggggaaaagagattgacacgtgggcccgctattttttatttttttcactaacatgtgggtcccatctagttttttttattctagtaccacgtaagagccacatcatcatcacatggcacgaagaccaagtcaacatgccacgtaggaaaaaaaaccaccagccaaaccgtcgatggacttgcactagttttcaaagatagaggagccattatatccggtactatggttgtaggatgtgattcaactagttgataccccgcgcttcaccgcggaatatatggatgaatgcatcttatacattatagtgtatagaaatgataaatgtacatgtttaaataatgtggagataataatttgacattgattgcatattgatttttaaaaatacaagaaaattgcaaaatgatatgtcatatttgcatgatatttaaaatattctatataataattactagtgggtgataatgtggcacacttacatatgatttaaaatactctagataataattgctagtgggtgatgatatggcacacttgcatgtaatttaaaatgctctagataataattgctagtaggtgatgatgtgatatacttacatattaagtctttaaaaattattggacatcaactttacagtaagataagatccggggttagaaaagagggagatatgatagatctattccttcattgtcccttgctcacaacatattcttgggccttaagtgggccaaactccattaatctttgcacagccggccggttcacggttcgttggttcacaaagtaggcaacaaatcatcattgattaacgatcttaaggctgagttctttgtgttggaaactcaccttccatgtacgtaaaacttaacgatttattagcattagcgtatgattaattaaatactccctccatctatttttggtagacatattttcaaatctaaaaaaattatttttgattggcatatttcaatccaacaacctatcctcttaaagattttttcggatttaatgtgtgactccattttaccacaaaagattggttacatgggcatcgagaaatataaatattaatgaatcgctggtttacgaaaaataattagtagcatgtttaaataaatgataagtagaattacttatatttggtctgtgtgccaagatgaaatatgactatcaaaagtagacgaagtgagtattaagtttttttaaaaaaaaataatatgctttttaaataatttccgtataaattttattgtaaaagtatatgttttagtagttcgaaaaatatgcacgtgaaaaagagagagttgagttgaaaaattcaactaaataactcagcctacgaccctatttagatgggactaaaacttttaagtccctatcacatcggatgtttggacactaattataaatattaaacgtagactattaataaaacccatccataatctttgactaattcgcgagacgaatctatttaattaggcttaaaaatttatctcgtaaattagcttttatttatataattattttttaagtagtctatatttaatagactaaattagtatctaaatgatccaaataccacctaaagttccaattcaagtcaggttcttaaacgaaacctaacaacattgtttatacttttgtttttgtcctgtactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcaggttggttcgccatgccggcgcgaatgtccatcacatcggcgtcgcgtcgtctccgatgagtaaagctagtcggcggctgaaacaggaagggcgccttaacgtacgagaggacacaggtacaaattgttgtgcttttcaaatttgggcctggtttagtttctaactttttcttcaaacttttaacttttccatcacatcaaaatttttctacacacgtaaacttctaactttttcatcgtatcgtttcaatttcaatcaaacttccaattttaacgtgaattaaacataccctggttcaactcgtcagcatggcagggttttactctttgaaatccgtatatctccctcgctttcatttcttctcgcttacgttttcttgccctttggtatggttatttcatatcatctgaaattgactttcgagattttgaagaaaacaggatgatcaaacatatatgcaagaccataaccatatagagatagttcacgatttttttaggaaaaagtacgaattaccctcccgaactatcgttgttaaccgaattaccccataaaccacaaaaccggacattcctcacccccaactatgcaaaccggacgaattacccctctcgacacaatccgcggtggttttggtctacgtggcgtacgcgtggcagtccggtcagcattctattcattaaaaaaaatgtgggacccactctcttctctctcttactctcactctcactctatgtcatctctctctcacgcgcacagcggcgaggacgaggggccggaggcggaccggagtatcgtactttttcctcttttttttgtttacgagcagttggtttgatagccagaccggagtatcaattcatcatttcattgttgaatcgggccgttcaattcctctattggaattagaaggatgatctgggctattttgattataggaattctataagaaattataggatttcaattttcataggatttattccatctcttccaaaataaatcaaaatttttatataagaatctagagggagagattaagtaccacacttgaaatagcggaacaggggacagaaaatagaaaatcgaaggaatacttccatggatctaccaacatactccatccatccataagagttagacttatttcatattttagtgtttccaaataaattatttctagtctctatacatccatgacataaattgaggggtaaattaaatgttagattagaacccgaacccgaggagctatattaatacttattggttgcatgcatgcatacactcattggtccttgttacgtgcaagatgagttaatttttctttgatcttgatgataaaaataatagtgtaacttttgtgaaagttgggagtataatacaaagatttattaaattcacaattaataaataaatttgctgaaagagggagactagggagacgggatgttgttagggtgatgtgagcttttacgatgctcgtgtcataacgatgttagagcaagtttaatagtagagctaactgctggccataaatcatctataacttaatagccaattctacaatagttacatataaacatatactacacaatcaatatctggtcccacctattactacacaatcaatatctggtcccacctattatatacacatgcgtcttagagtctgtactgcagctgactacaaatctgtagcccgctgtcttttctctccttttttatcttcttaaaatatgtttatagctggcttatagtctgctattatacctgctcttagcagctatttctggttgataactatttataccgcacatgatactgtcgataccagaaatgatatcggtaccatgataccaagatatcaaaggtgtcaaggtataatggctatgggtagacgtcgatctacctttgaaagggtcacttagacattgatgagggtgaatagataatttaaaataaaataagtaagctaaaatataaaccaggttagattttcttagactaaattctctatatacccttgaaaacaaacacaatccctttcatacccttgaaatttaccttatccattcgatacccctgaaattttaacttgatcctcttccatgcctctgcagttacattttccttcgtttcactgttaagtttggttgcaaatatcttttatgcccttgatgatttatgtttgaatataaacttgaaaaacgattgaaaattttgtttgagtacacgatatatgcattttatgaaaccaatgagactaaataattagagcataaaattttgccataaattttgaaaataaaacaaatgtaataaattattttttctatttaaaattttaataggacaatgaatttttttatcggggcattcatcaaaaaatatcataggcattggtagtcctatcttttctatggatactcctcattcttatgacttttttaaaaataaaataaatacatatttttattttattatctaaaataaattttatcctaaataatgtatctcacaacaaacacatatctataatagtctaatgcgacaaacttttatattttcaataatgtaattcataaatttctatgctcattcaaagggtaaaatggtcattgttggtattacttaacgacattactagaaatataattcccagcaatggcgcagaaatactcctggtatattatggttatagatttcatccgcaagcgcacggatataccattgtagcattttacccgagagtattccaaaggtatcgtatttgtttatcccgtggaaagattatagtagagagaatcgtactaataatttatatattacttgtaataaccatagtctaagcagggggttaatataagcagagggtagagtgatacacaagcataagactattcactctcatattaaattatccgagctaagtggaaagaaaatagaaaagaatatattcctatacttctagtatacataatatacatacatcctagctataagattaactagctaatacccttattccgatgccctcctggtacttcgagaagccaccccctactgccgagtttcttacgacagcccatcatgaccatacaaccggggctaaatacgaaggaataccctccccagggaattaactaaggactatatacacgcgcggaggaatacccgtaccgagctgtcaccatcagcggcccacctctcttccgcagcatataaccccaaataatgctacctagtaatctagacaccacgcctaaactaccaaatactactctaatatcatcgtcatgacatagaataattacataagcaaacattatacacgtaccgttgcatctcccagataagctagaagtataatcaacataactcagatataaagtaaaattggtattcatatactcaaaaagtattacaacaccagagttgtataaagaagaatattctaaataaagtacaagtcttacaaaagaagaaaggagagctactggagctatacccgaactcttccgaagacttccgaactcatacttctattctattcctactccactagcttgagaatactaaactaagtttgagagagtatgagagagcttgcttgaggtgtgtggagaaagtgagaagatgagctccttaaataggctgccaatgacggttgtggcagttggaatggtcggaattgccctccaaccgtcattggggagcgatccacgccgtccagaagaaaccctgcatccaacggtgccagggaggggttcggctgaaccaggggctgggccttcctagcctattttcagtaggtggcctcctcttttgatccctgtcacagacttgtggattttggtaaaattcaacgtgtcatttctgagttcttggcccattcatctgatttccgacatcatctgattgattgatcgtctgttttgattttgattctcctctattttatgtttattctctgcaagaggttagtaatcctagtgctaatggaatatttattattctaacactatttctcctttattttggtagtattgactgttgaaactgatcgttaacgactgtcaatagtcatttctatataaatttgatggtcaactgaggggaagggtatggaaagcatcaaaatcaaatttcaagggcatacaaggaagtaagcaaaattcaagagcatataaggaattagctaaaattttaggggtatacaagggattaacgaaaatcccttatgtacctataaattctcacgtaatcccttatgtgcccctaaattatgccttatcctctatgtacccttgggttttcatctttatcccctatgcgtattacatgagttgactaatttttcaaaaaatgtttatatcacccttgtgtctacttattgcttagagttgattgaagaaaaacacccttctcaacataaaagttgattcatttataaaaacaaacatgacataattactttatcataaatttgataactaaaatttagatttcttttaaataagtttcaaattagatttgatgaaatttgttcaaaatttttactgaaatttaaacccaaataagaaacaattttggtttttcaaattccgaataaaacttcttgtgtatttcatttttttttaaaaaaagcttgaaaatttatattttgttttggaaatccggtgtcaaatatgtcccttttgatttttatcatagattaagattatttttataacaggacttgtttttaaagtaggtaccataaagtacgggtaatatagtcattttgggataaatctaatggtcaattcatagtcaactcacgacaagggtatagaaggataaaaaaatctggagcgtactaaggatgaagtaaaattcaggggcatataagagattgagtgaaaactcgtgagtatgtaaggaattttctccaattgtttatacgcttgaaagtgtttgcaaaggaaaatggaacaatcgaatcgacatgaaacaaaaccaaaatcgctacagatcaatgacagagggagtgggagcgggagcgtatcgagggatgacaaaaacactatggggtcgaagaagggctcggatttaacagacgacaaaaacgttactaatgtgtaggtaaagataacgaaaaaattagtttgaaatggacgaagtaattgtttttggaaaaatataagcctttcaaagctaataaaaactttgataatagaagttactagcattaacgacagtaggcatgatcaggattcaggattcctctctgatgcttagcacagcccctgtctgtgccctctcacctgtttcttcacctacccaatctaacatggagtactgccttaacccaaactctcccaattcccctcttcaaacaactacgccgcctccatgagctccatcacggtgcttcgctggtgctggcgccttgttctccgctcttccccttgtcttcttcgcgctctatccttcaccaccgcctccgacaaccctatgctgcctctacaggcgacttctccatctccggcatccttctcgccaggcggacggacggttggtttgcttatggaaggtggatttgttggtgagtgagtgaccatgcagtggaggcatcctccgcgggggctaaggtgaggcagattcgccggggacatggagtcatgcgtctgcgcgtgcgcgtggccaactgcgcctaccgtggtggcactcttcgccaccggttatgaagaaggggtggctgaggcgcctcatgatgtcgatcccatggtgagacatcagaccggaataccatctctagagcagcagaaaattgttagaaatctgatgtcttagagagaacaagtctagtgctatgataaacgtggcagaagtaacacttacgaatcaactgttgcatgcattcttaacattcttcattatatgctacactaaacatgaacagtcagtcatgttatccatgtctgcgagttcagtttggcattgcatataacctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaggttcattcggtaaagtctacaaaggaatgctggatggtcgatgccctgttgctgtgaagcgatacatacatggaacccggaaagaggagtttgccaaggaggtgatagtacattctcaaataaatcacaagaatgttgttcgacttttgggctgctgcacggaggaaaatgctctaatgatcgttatggagtttatctgtaatgggaacctgaatgatatccttcattgcagcaacacaaatggacgtgttcctttctctttgggcaaacgtttagacattgccattgaggttgctgaagtgctctggtgcatgcattcaatgtataatcccgttctccatggtgacatcaaacctgctaatatacttgtggatgaaaatctttcaccaaagctatctgattttggaatagcaagattgctttgtgctaatggggctcaacatactaacaatatcattggatctataggttatgttgatcctgcattctgcatgaatggaattctaaccccaaagagtgatgtttacagctttggagtggttttgctggaaatcatcaccagaaaaaaagcagtggatgggaccatcacccttgctcagcgtttcactgaggctgttgaacaagggaagaaggtgatgcatttgtttgacgaggacatcaacaatacaaaaaacatgaacttcctcgaagatattggcaagttagcagttaaatgcttgaggagggaggttgaagtgcgtcctgaaatggttgaagtagcaactagtctaagaatgattaggaaagctctagaggaagaagagggaaatctgattcagcagaacataagtgcaccaagcaactcaattccttcaaagaatgtgaagtcatcagcacagcaatttggcaatctaaaaatctttaaacaagaggaaattaagcttatgacaaaaaactacagcatgaaatttagggaagagttctgtgaacggctgtacaatggagtcattggcacaacacatgcagttatagtaaagcaagtgagaacatcttcagaaagtgacagaatgatgtttctgaagactatgagcatactgtctcagaagtatcacaaaaatattgccaatgttgctggcttccacttaggggattccatttcagagtgtgtgtatgaatcttgctgtgatttatcccagggaaatgacggccatgtttgcttctgtaaccgaaacctttatgacattatctgcaccagggaaaaactcccccttcatctacgtttatcaatagccgtccagtgtgcagagggcctggttcatatccattcattgttagctgaaaatcctgattcacattctacaggcctcttgggaaacttcaggtcgatcaatatttttctggacaagaacttcgtgccaaaagtcttcaattctaatttatcaacatttcttgggctttcagtcatgcagaaacataccgcctctgtcgatcgtcctaatgaccaaagatcacaaatatattatttagatggaagggatatttctggtcagctgttcaatcccaagtctgatgtttatagctttggagctgttcttttggaactcatcacttggaagacagtgagatacatgtctagtggaagagttcacatgcttaccaaagacttccttgatacttatagaatagaccatagtgcagcgatatcttttggcaagaaggtttatgatgagcaaggtaagtgttttattcacgaggcaattgctattggagttgagtgcttacaactgatgtccagacgcggccaaaaatgagtgatgttctttcacgtcttcggaccatctctgcagctcagagtattagaagcaaactcatcatggctacacaaacaaaaggttgcacctcttagaccaataaatttgcacatttatcacatggaacatagtgcagtcaaacttctaagattttaaccactattgtatgaaaaaaatgccttacaaaatactacctttgcagcctttgtaattgtaattcaactacaagtttctcacacattgtattgctaatagctacaaaaccatggtgtgatatgaaagcaacttgaaatacaaatctaatggtaccattttaatatgactaggcatatatgtaacttgactaacggtaaaaacttacaaattttgaagtgtctacatggcttacaaaatcgaacagatgggtacctccattatacattttgtttttagtttttttacttgtacattattactccctttggtttcaaatttactcaaattaaaatggacaatgaattctgtcatagaaaaaccaatcacatttagcggtgatgttctttaagatgtattattctcatatcaaattttcaggtatagcaatactcattttaatcgaaattatgatagatgaatttaaatgtgcaccttgtttgcaaaaatataaatattattgtgctaagtacttaagtagcactccctctagccacaaatacttggacgttttagatacgatccagtcaaaattttaaaactttgatgtttaaaagttttattttaaaaacattaaaatgacatgtgtagatttgtctggttgtccagaaaggtacttccataatctcataaacttgtattttactacctccattcctaaaaaaattcctttttagctatgaacctagactgtgttgtccatgtttatagctaaaaaggcactcttcagaaagggaggtagcataaaattattgttaagagatgcactttaaagacattaaaaaaggtcaattttcaaatgtcaagtatcttttactggatggagtacaactaacaaaatacgaattttgtaagcagcaattaacttaatctattggattttattcttttggtttctccaatacagctagtggtgacaacaaaccaaaccaacatgtagcccctccccttaccaagaagtttgtcaaaactccaccaactattgtatcgatcattcccctgaacatattggagaagataactagcaacttcagtaatgatgccctaataggagagggcccagacgccagagttttctttggagagcttagtgatgggcagaaatctgcaataaagaagcttgatcctaatgaaaaaattgtagtgcaggtcatggatgcatgtcttgcctttcaccttttgagttgatgctctttattcatgagtacttgaagcaagggaatgccttctcaattccatgtgtcttgcaggttttgaccatttcaagaatgttgaagcatgacaacattgtccaaattcttggatattttattgaaggggaaaatcgtgttcttgcttatgagtatgcaccaaagggttccttgcacgatattcttcatggtaaggaataacaaaagatttttactttgacatattcctatcttgcttgcttactgtattatgatcaatagctgaaataatatgatttttttactacattactttatgtgttgaattgcttgttgcattactcaagagggtgtcagaggagcccagccaggaacacctctatcatgggagcagcgagtgaagattgctctaagtgctgcaaaagggcttgagttcctccacgagaaggctgtgcctcctgtcatccacaccaacatcaggtccaacaacatatttatctttggcaatgatgttgcaaaaataggtgacctcggcgtctccaagcagctttatcctgaaagtgataatgactactacaatacccgactatatcctctgcgcagttttggctatgatgcaattgcaccagagtatgcaatgaaagatttccatgcttgagtttcttacagtactagtgcctaagcttggatatgatatgcattatcctactgatatgttctttccttcgttggttcttgttaggtgtaggaggacaggacagtaaagtgtaaagagcgatatctacgctttggggctgtactgttggagcttttaactggtcgcaaagtagttgattattcacttccgcgtttccagcagagcctcataacatgggtacacatgcaacaagttcactcgctgatctaatttctttataggatgaagaagctaaactgttgacaatgagatgcaggctacaccaaggcttagtgaagacaaggtgaagcaatgcgtagatccaaagcttggaggagcattcccactcaaggctgttgccaaggtaataatattcctattcgaagctttgatgttactgtctgtgtttcgcaaacaatttgagattttgtggtgtatagtttacattttgaattgtgctttattttctaaagtaatgaattgtgcattttagtattgccgttttttcttacattatagatgcataataattttaagggaagtttcatgtgagatcatgttttgtctccatggaatctgaacttcgtcaggaaaactaatctgtagggtcaaacaatctgtttctgttctccactttaaaaaaaataacatgtggtttcttttgcacatatacctcgaggttggctcccatgcaaagttagagatgaggataggaagaccaacaaagtagggggccagggccttgtgaatctctacatataaaaccctcactggtcacacgcatagtggaaaaaaccggaccggggacggacccggtgagctcgtcggttcaccggtcggaccgccggttcatggctaattattttttaagtcataattgactttaaactgctaaatagaatatgtattgcattctaaccaacaaatttctatacttcacttcagaaaaaaaataacatagttatatacttcttttggaactttcaagattttgagtgtcatacatttttaaataattatgtattagatacatgaaaatcaattgtctaaaaaaactttatttatttaattttgtaattttattggattctataaacataccacaataaatcttttaaggaccatgacattatcccaattcccaaacaagttaccgtgaccagaggtagattaccaaccgtccttttaaaaaaaaaacaatttgtttaattatactcaagaaaattaaagttcaagtacaatgcacttatggagcatgtacttttgaatctattaataaagtaccataagcaagtcatattgtatactaggaaatactaccatgcaagggccattagagaccagacctgtctggtcaatcatctctgccaagtgccaacgtgtctattgatagtaggcggtccattaaggttattcaatcgtgcaaaaacatttaagagagatggttttctataataccttgttttggggagttcagagagttttttagacaaacaagatatttgaggggtaaaaatggacttatccttcttttttaaaactatttgatctgcatttgttcgccctcatttgttctcacatctcgaatatcaatcaaatcaaatagttataaaagatctgaagaaaatgctgatgttggtacagtagtcactatcataaaaaaaaaaattccaaactcaacctatagatcaagagagagagaacaaactaaactctatactaggtagtgtgagcactatttatagtcagatttttgttctacttttcaatttgtacaaaacggagtatattaagggggcgcaagcggcgagcgagattgctattgggcgatcagtcgcgcgcctccctccccgcgcgactggacacgtgtcgcgcgcggagagggggcggcgacgcgccgtgagggagcgagcttttcgtttttttttcccttttttcgtttatgttcgttttttttcattcggttttttgtttggtttttttctctggtttttttctgttcggtttgtttttttccggtttatcttctttcggtttttttccttttttttaaagatgtataaatacaaagtttgtattcgtatatataccaagtttgtattcgtatatacaccaagtttgtattcgtacgaatagaactttctatacgcgcatacaaactttctatatgtgcatacaaactttctatacatgtatacaaactttctatggacgtatacaaactttctatacatgtatacaaactttctatacgcgtatacaaagtttgtaaacacatatacaaaatttatatacgcttatacaaactttgtgtatgtgtgtatatattttttatgcattaaaatatattcgtatatatatatatacacgtgtatatatatagtatataatatatacgtatatacataagatgtatatagtacctatgagagagactagagggggggttagaggggggggtgactgaccgcgcgcctccgcgcgcgcgcggctgatcgcgtatcagcaccccccagcggcgagtgctcgcgcgtgccacgtcggattttctctacagcgaacggtggaaatttgcgaaaaaccctccggtttgttcgtaatcccaaataggttcctgccgaacagtgcccctgagatgatattctacgtaagggcccttctaaaatctggatattacatgcgggggaggggaaacacgcgaaataggactgcgctgtaaaaatcgaaggtcgaggggctttttcgtaaagttccgcgcaataacccgcgccccaaccctagccgcctccgccccgcctctcctcgactcctcctccctctcgtcatgcgccgtccctctccctctcacgccgccgcccgcctctcctcctccctctcgtccccccgccgcctctccctcgcgccgccgccgtcgcgtcctcgtcgcctccgcctccgcccacaaaccacattttttcttgggggttctgcggttcttgggcgaggagaggagatgaaggagatggtggttgggtcggtggcttcggcgccggtggggaggtggggggcggcgtcgcccaggtgctcctggagaggatgaaggattacgggcaggagggcgttcacgctttgggacaacctctcgcctgaggacctggaactgctcgtcagggatatcgaggtgagtaagcccaatgcgctgcaggttgggagaattttgcgtcaaatgttgcttcttgcgttggtaacttttttccaatcgggagcttctgtccgtttctatttgccagggacgaactctgtataaaagtttgatatttttgccggaattctgcctgaaagctctggtcctgaatgtggttttggtctaagtatgaattctgtaggagtagcagttgatttatcaattgaaagttttactacggttcgtgggaagaggagtttggattccagtgataatttacttcacactttcacagttttgttgtcactatcaacaattatttatctgctctccatgggtcttaatcttcattgtttacactgcaaaatagcacaagagaaacccgcagcatgtttttgttgtcatttgagctagccatttcaacagtgactaatggacctacatataatgcatttttttcagagcctagatctttcaaggattgatcggatcatccagcgctcccttggatcacctcatgcgaaaaaaaaaatgtctttccaatgtagaacattagagttatttataattttgtcatcacacttgccttaggttttttggataatgaaagctttacagaactcagtcaattacatcaagatgataaaaccgtactgtgaaactttcttagtacttgccttaatcttatggtgtgattaatgttctttccaagtgcaggcttcctttgcccaccgtcaagctggtgtcggagtccagcgtgttgaaggtagaggagaggtcggtggtggaacaaggggctgaaggccatttcggaggggaagctagccgttatccttttagccggtggtgagatgctctaatagaaagattacctgaatttgctatttctgtactgtgtgcattgggaagcagcctccttatggtttgattcctcttcatgtgtgtgcaggagacttggcctggcagctctgatcctaaagggtgtttcggtaggttgattccactgcaatcttattaataattgactttatatgaacaaatgtatggatattttttcagttgaaaaaagtgaggtgctctgaattgtttttgttttacacaatgtttttttggttcagaaaccctttcaatattctaatgtgatgaacaaggttatgtcctttgagctcactgaatctgaaattttcaccttttatcttatttcacagttcaacatctggtgggataatcgatagagctatatatgcagaggataggacatggtgactttatgaaattggtaattgccatttgatgtactacaataaaaagttactttaactggcggagtacagtattaacaatctgctttttagtctgtaacagtgaaatatcttggaatatatgtcgattacttaagatcttgttgaaggatatctggaattggctgcagagacaatcatttttgtggcagtcatgcccgggtagggtgtagagtactgcattacagtggatgttgatctacatgtaagtataggtgtttgaactactgccctctaatttagcatcatcttgagtcttttttctccatgcttaaatttaatttgttcatagttcagacatttcatctttattaaattaaatttatgctaagtatttggcatacaaactgtacactctaagttgacaaatctcatatatgctattatctccaaagatgttgcttccaaagataaaaactcaaaatctttagattttaaaattctatctcaaatctagtgggactgcactcaacttagttgatttgtgattgtttggtgaaacaatgtagtttttcaaataattatacttaacttatcacctatgtatagcttactgcaaagcataactcatgtatttcagtattgcatttctccttgcttttcaccaaataatatatagtacttgaactctatagtttcccgtcctgaatttgacaagaataagctaaaattacgggtaaagtttgctttggagtgtaaatttgctattctgccatagatttatagttacagctgggagctatttctagacagtcaactctcctgaaaatcgattcatattccaaaggcaaggcatcaggtatacctaacctctctttctatctaaattgatttgctttcttcccaggatataatcaaatacaaacaattacaaataacaaaatacggagtaacacaaaggcagttactaaagactccctatagtgttgtcactcgcattttagcatagcgatctcccacggacaaagttgtgctgaaacacggtctacatctatcatatagtgctgcagcatatgacctcataaaattttcagccctaccacccaccaacaacagaagatattcactaagtcgcttcagtgctacacgttctagcaatgcctacgaacatctatagacattgttattcatttacatcatctgcatcttcccatccaatgaaaactcacatacaaatatattcgtgcaggtaaccgcgggcgtacatttagggagctgtgcttttgcgaaaaaaaatgtccagcccacaactgatctaaaaaagtacatcgaagctattaagcggttcctacaccattcaagcagcttctatgctgtaaccatcaacagcacattcatcaagcaagatagagttgtaagctcttgcaacaattatttatttttcccacccctatcattcatgataatattgcttttctaccactaataaagaactaacataccgtgcaattacagtactttacaaaggaattttcacagaactacataaaaccgctaatggaaggtaaaaaaccgtcgacactgaagtacaagtagcaggaggtatttcaaccagcatgatcctccacgtttcaacagatgaccgttgcaacttgaagaaagggtggacaaagttcgcagcacagatgacatagctctcggatcagtttgcatcttccatttctacaggacaacctgcctggaggttactattgatgtcctgtgaagaccatatgggcattcatagctatcttatgatcatgcttctgctgccagtaaacaagctgatcactatcaggatcggccgcttccctcccctggaattgttaccatgcttattagttctacaccttaggtgcttactatccatagtgcactagcttggacattttaagaaacgtctgtgtatatccatgttgctgctaaagactactagatatcggtatgcctataactgtttggcactgcagtttacttctatttcacttcctgctttcttgctctcttttttaacaccaaagaatacttacatttatatctcatcatctggcgtctttgctaattacccatttcttgcccaccgtaattccgctcaggtggcgcgccaacggcacgccccaggttctagttgattttaaacttgtatgtttatggagtgatataacataatgaattacgttagcaattttttttaaaaaaaatcattactaattaattggtatgcaagtaatggtggtatatcatgttaagggatgacatgactttccctaagtgctactctatacaaatgtagagtgtgtttccttcccaagttatatacacattaacgtttttggggtcactactggaaaaatcattgagtaaaatacaccagcggttcttaaacttgtcaggaggtttcacttagatccacgaacttgcaaagtgcacatcgagatccctaaacttggtttattatatcattccggttcaaagccgcatttgactgtggtatagcctacgtggcacatcacgtggataatgacatggaattttttttatttttttctcccttcttccttctttttttctctttcttcgggctgc

SEQ ID NO: 8353 - DNA, 3766 bp, Oryza sativa
  unsure (1)..(3766): unsure at all n locations
ccgcctggaaaaattgattttcgcaggcggacggtgagctccaccccggtttacattttcctatatggacatttagctccgatggtcatatccgtctggaaaaaaaaaatctcccatcgtatgtgaaaatgctttttctagtagtaggtgtgttattgctaggccctgtttagttcgcgaaaagaaaaattttaggtatcatatcggacgtttgaccggatgttggaaggggtttttggacacgaatgaaaaaactaagttcataactcggctgaaaaccgcgagacgaatttattgagcctaattaatccgatattagcatatgtgggttactgtagcacttatagctaatcatagactaattaggcttaaaaggttcgtctcgcaatttctatgcaaactgtgtaattagtttttctttttaatgctacatgcatatgtcaaaagattcaatgtgatgtttttgaagaaaaaaattgggaactaaacatggccgttcggtttggcaaacagatggctgctgtggctgagctgtgcatacagttcgaggcggaatttcggccctcgtcgtcagggctctgagcatgttagagagcagcacgtcaagcaagcaaccgagcatcggtgaagcagctggagcgtgaagctcgccgttccgttggatatagggtgattttgttgcatgatattgtgcgttcaaaggaaggaggtttcatgtgggtaactatttgattgttccatattcacctaactaaacttgaacttcactatatagtttgtttcagattgtacatatgatttaattattacgaattcgtgatgatcggtctcatttttggaacaaaagagtgaccatcgccgtgtttagttccaaaatatttcttcaaactttcatcttttccatcacatcaaaacttttctacacacataaacttctaatttttccgtcacatcattccaatttcagccaaactttcaattttaacgtgaactaaacacagcccatacatgaaaaacaaaaatcaatactgtacataattcctgacagcagactgccagacttacacccagcacaccattgtcatcttcgctagcctactgcagtcggcttcggttgatgcattaaggctatgtttagttcacactaaaattggaagtttggttgaaattggaacgatgtaacggaaaagtttgaagtttatgtgtgtaggaaagttttgatgtgatggaaaagttagaagtttgaagaaaaactttagatctaaacacggtgtaaggctgtgtttgatacttgggttaggaacccaactccaccgcacggaaaacggagcggtctattagcgcgtgattaattaagtattagctttttttaaaaaatatattaatttgattttttaaagcaactttcgtatagaaactttttacaaaaagaaaacataccgttgagcaatttgaaaagcgtacgcgtgaaaaatgaaagagagtagttgggaaccttgtggaaaaagaacgcagcctaatctggatacgggccagcaaatccttcatcactgtctgctggatcggccggatcaaattgtaagcagtactcgactgtaactgcgctggccgcctggcctcttcaagatcaccgctactatatgcaaaaagtgacactcgaagagtatccaacgtcaacgtacgtataagttccgcgcatatatagcggagcagaaatggtagcaaggctagctgatagacgggtcgcctggatattttctccgtcgattggtacagtacacaggtgtgatacgtccgcagctgtgcacacacatcctctgccgcgctcgcagtagaacaaggggacgacgatcgacagtctcgttatttcggcgaactttcctgctcctccgatacgccgagggagtacacgctagcgacactaccggtgaaacattctgtcaggttggccaaaaaccataatattctcgatttgaataggaaccgagaccgactcaaaaacctaacggcactttttttattttcaaccggaactaaagattatttttagtcccggttcaaaatatgatagacgatatcagacccctctactatctttaatctcggttgttaaacaaccggggaaaaaatcagcaagttgccttgagccgcgcgctaaaaaaaaagcaaactgtcccaatctattctctccttatctcctctcctcctctcaaccttatctccttctcctcctctcctccccctcattctctcacccccatctcctcctccggccccctcccctctcctctcctcccctctggctccccttcagcgggcggcggtgcccgacatgcgacgacaggggtgataggtggtcgggcggcgacggcctgtgcagtgggtggccacggtggtgggatgggaggcggtgcacggcgggcggcgaccgacgcggccccgaagacgacggtgaaccgccggccgatcccttccctgcggcgaaggaggcgacgagcatttggatatgtgaatttgctgattttattgatttatctatgaatttgttgatttgtgatgtgtttggatctgtaaatttgtgatgtggtgttgacgtgaaaaaacacctaattttatccttaacatgtggatatggataattttgtgatgtttatatgaatttgttgatttgtggatgattttgtgatgttttctgaatgtgaatgattttattgttgagtttggttagaaatcaatatgcaaaaaaaaatgaaaaaaattagtttcggtaggtgattttaaccgggactaaagatcgcttcgtagctccgatttgctacccaaaactattagggttgtaaacggggtgtgcagactgcagagggtttgtgcaggagtggacgacggacgtaagaaaccgccccatgtcccaaccccccccccccccctcccgcggtgaaattttcccgcgaaattacggcgagtcaagtcgccccagggccccggctcccaagtcaagtttggttagctcccagctcatccttaatgcagtcctccccactaagcagacttaatttatctaaaatatataacggtttgactatcctttatatgcgtagccaccatcattgtggcggtattccggttgtccgccattcccaaggcgcaagactttgcgtctaccgtcgtcgtctccatctccgtctccgatcaggctaggcggcggccgaaacaggagctaggcttaatgtacgagaagacagtaggtacatcatcgtggcagagcagtttactctgtcctccataccatatcttgttcaccgttcgttcattcatatttatgttttcttggtatgattatttcgtatcatcggtgatttgggtttggagatttggtctaaccgcatgtacatcttatgtggtatgggcatatatcacgagaaattggtttggtagccgatcgaataccgatcaggatttacgattcggagatggccttccgtttcgggctctggcggaacgacggttttcgtgaaatccgggctctggcggaatgacggttttcgtgaaatccggtggaaagccggtagtatgaacaattttcataaactaaaatttgaatacaaattccttaagtttaacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8354 - DNA, 1756 bp, Oryza sativa
tgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaaataatggcacatgcacttcataatctcttttagtggttctcattcaaaatttattccagtgttattagtactgtacatctattattgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttttttctaactttattcaaattaatccaaaaacttgtgctattgattggataaatgtcttaactccctcctttcacttgtctttagatgccgcgctacaagcctgagtacttgtttggtgttgagggatttgtccaggagttgcgtacgatgtccattgccataggatttgggactgcccctttttatgcccagattcctcatgatcgtcatgaagagaagtgccgggtcaaagtcaccttaaacagtaatagcgaagatatcccctcagtgatgttcgaagctggaggaaaaaactacatccatgcatgtcagaaggtggcaaggatcgccataggagagctgcgcgatcgctacagtgatcagttggccgacaccgagtatcgctaccatcctcgccaaccacagggaagtgaccgtggcagctaccttgagactgaaggaattgagaatgatgctaccacatagcatttggttgagatgctgtgggctatggatgaaacccgtgcagagactgtgttagcagctcaagatcgtgaagatcggaatcgtggtaagatttgcaagctagaggacaaagtggatcatttggagaaggaactagccgccttgaagggagaagcaccaccgcagaaggccaggattcgtcttaccgcaaggaagagagctctatttgtccctcgctatcaattggcgccaaaggttcgtgtggtggaaaaagaagttaccccagccctagcagatcctccggtcgtcaacgtaagtgatgatgaagtagaagaatccaagcgcacccattccaaaatcgagtggggagccactcaagatgatgaagatgagccgaacgagccttcaatcaactccgatgcccggaagacctagagtgccttgtcaaaccgttgtcttagatcgttgtgttagtttgcttgttttaagtttggttgtgtgtgtctcgcatgtgattacatcagtggtgggatgtaagtgcatgcgttggtttgctttcgagtgttaggtagttggtgagtttagtggtgtgagagtcttcagtttgtaataatgaaactcacttaagatcaataaaagttaaattaattctctgtcctaagtagttttccccggtttctcttcttgtgctcctgttcatgccagatggtgctcactcgcagcaacggga

SEQ ID NO: 8355 - DNA, 4152 bp, Oryza sativa
acgcatataccatcgggagtggtgtctctcaaaaagagggaattcaggtcgctcactcaggggtctcgctctgttacggagtatctgcacgagttcaatcgtctggctcattatgctccggaagaggtacgcactgatgaagagcgctaggagaagttcttggaaggacttaatgatgagctttcttatccacttatgactggagattgtcctgatttccagaagttagtggataaggctattcgccaggaggacaagtacaaccgcatggagcaaaagaaacgccggattgctcaattcaagacacaacaggggaataatcaaaagccgcgtcttactttaggaccccagtccatgccacagggaggttcttcgtctgttgttcgtccgcagcgtcagttcttcaacaacaatgccggcaacaacatccgtaatcaagctccatgccctgttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagggcaactctaccgcaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctaggaatggactggttagccagatataaaggtgtgatagactgtgctaacagaaaagtaactctcaccagcaatgatggtcgagttgtaactgtttatgcattgtcttctgagtctttaaggtcaagactaaaccaaataactttggaagagattcctatagtccgggagtatcctgatgtgttcccagatgatttacctggtatgcctcctaaaagggatatagagttcagaatagatttggtaccaggaacaactccaatccataagagaccttatagaatggcagccaatgagttggcagaagtcaagaggcaagtggacgatttgcttcggaaagggtacatcagaccgagttcatctccatggggagctccagttatctttgtggaaaagaaagatcatacccaaaggatgtgtgtggactatcgtgcactaaatgatgtgactatcaagaataagtacccgctacccagaattgatgatttgtttgatcagcttaaaggtgccactattttctccaagatagatcttcgatcagggtatcactagttgagaatcaaagaggaagatatacctaaaacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcctgaaccaaagaagagcatgaacaacatcttcgccttgcactggagaagctgcgagaacatcaactgtatgctaagtttagcaagtgtgaattttggttgtccgaagtgaagttccttggtcacgtcatctcagcaggaggagttgccgtcgatcctagtaatgtggaatccgtaaccaattggaaacaaccaaagacagtttcagagattcgcaattttctaggcctcgcaggatattatcggaggtttataaagaatttttccaagattgctaagcccatgacacgattacttcagaaagatgtaaagtacaagtggtcagaagaatgtgagcagagttttcaagagttgaagaatcgcttaatatcagctcctattttgattttacctgatccaaagaagggattccaagtgtattgcgatgcatccaaatttgggttaggttgtgttctgatgcaagatgagaaggtggttgcctatgcatctcgtcagttacgtccgcatgagaagaactaccctactcatgatcttgagttagctgcagtagttcatgcgttgaaaatttggcgtcattatcttttcggtactcgtacagaggtgtataccgatcacaagagtttaaaatatatctttactcagccggatctgaacatgagacaacggagatggttggaattaattaaggattatgacatgggaattcattatcacccgggaaaggctaatgttgtagcagatgctcttagcaggaaaggctattgcaatgctacggaaggacgacagttgccattggaattatgcaaggaatttgaaagattgaatttgggaattgtcagtagaggtttcgttgcagctttagaagcgaagcccactctaattgatcaagttagagaagcccaaattaatgatcctgatattcaagagatcaagaagaatatgaggagagggaaagctatcggtttcttgaaagatgagcaaggaactgtatggttgggcgagagaatctgtgtccccgacaacaaagatttaaaagatgcaattctaaaggaagcccatgataccttatactccattcaccctggtagtactaagatgtaccaggatctcaatgaaggattttggtgggcaagtatgaagcgtgaaatcgcagagtacgtagcagtatgtgatgtttgtcagcgagtcaaggcagaacatcagaaacccgccggtttgttgcagcctttgaagattcctgaatggaaatgggaggaaattggtatggatttcatcactggtctacccagaacgtcatcaggccatgactctatttgggtgatagtcgacagacttaccaaagtggctcatttcattccggtaaagacaacctattccggaagtcggttggcggaattgtatatggcaagaattgtgtgtttgcatggcgtccctaagaaaatagtgtctgattgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaacagttatcaagctagtcttcagatggctccgtacgaagcactgtatggtcggaagtgccgcactccgcttttgtgggatcaaacgggagaacgtcaggttttcgggacggatatcctgagggaagcagaagaaaaggtgaaaatcattcaagaaaggttgcgtgtggcccagtctcgtcataagagttatgccgacaatcgtcgtagagatctaagttttggcgaaggagattatgtgtatcttcgtatcacgccttttcgaggagttcatcgttttcacaccaaagaaaaattggcaccgcgttttgtgggaccttataagattgtcaatagaagaggagaggttgcttatcagttggagttacctcaatctttggcaggagtccataatgtgttccatgtttcgcaattgaaaaagtgtttaagggtacctaccgaggaaactaatcttgaacagatagaagtccaagaggatctgacctatattgagaaaccaatcggtattttggaaatagatgagagaagaaccagaaatcgagttatccgtttttgcaatgttcaatggagtaatcactcggaagaagaatcaacttgggaacgagaagatgaattgaagtcagctcatccgcatctgttcgccagttcttcagaatctcgaggacgagattctgttaaaggggggtaggtttgtcacaccctaaaaatcctaaatatataaattgttgtttaattggaattattagaatccattttaaaagtctagaagagaagatctaattttaattaataaatcccaatataaaatggggccagataaaatttcattaaa

SEQ ID NO: 8356 - DNA, 14338 bp, Oryza sativa
caggggggtaatttgaattatcaatatcagccaccatcacctcatattcagaaccagcaagcaggatcggtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaatttttaatcttacaaagagcatttcagtaattaaccacatattaaattaatcattaaatggtctaattgtaattttattaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatatccggcgaggtcgccatcttggtccggccattgatgatgtcatcatcgtttttctttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattggaataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaatagttatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactatttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaatcggctcaaccccaatttgttcctcaatacaaccaattcgagcctatgccacaacaacctcaaggggcacctcaacagcgaccatgggccgatttgattgcagatgtcatgaaggaacagtttgggcttaggccgaaagatgctggaaatctatatcgacagccatatcctgagtggttcgagagagttcctctacctaatcggttcaaagttccggatttttcaaagttttcagggcaagatagtacatcaacttatgagcacattagccgatttttagctcaatgcggtgaagcatcggccgtgaatgctttgagggttagattattccggttgtctttgtcttgattggcctttacttggttttcttctctaccatatggaacaatcaacagttggactgatttagaaaaacagtttcacagctacttttatagtggggttcacgagatgaaactgtccgatctgacatcgatcaagcaaaaacatgatgagccggtacatgagtacattcagagattcagagagatgaggaataagtgttacagcttaagtctgactgatgcccaattagccgatttggcttttcagggtatgattgctccaatcagggagaaattctcgtcggaagattttgaaagcttgtctcatctcacacagaaggtgatattgcatgagcaaaggtttgcagaggcaaggaggaattccaagaaaattaaccacgtctgcccttatatgtatgggtcagacaatgaagatgatgattctgaagtagctacagctgaatgggtgagaagtaaaaaggttataccatgctaatgggtaaagagctcaggaaaagaggagaggtatgactttaatatcactaaagatgacaagatttttgacttgttgctccgagagaagcaaattcaacttcctgctggtcacacaattccatcgactgaggaattaggcaagaaaaggtatttcaagtggcacaattctgggtctcatactactaatgattgcaaggtgttcaggcagcagatccaagctgctattgagggaggcaaaatcaagtttgatgactacaagaggccgatgaaaattgatggcaatccttttcctattaatatggtacatacagctggccgaacagccgataggggccgtgcaaggggttttcaggtaaattcggctaagattatcaacaaatatcagaagaagtacgacaagcagcaggagaagcattatgaagaagatgacggtggctttgatcctcattggggttgtgagttctttagattctgttggaataaaggtatgaggctaccatctattgaagactgtcctgggtgcagtggtattgccgagagctcaagccgatcatatagtagggggcaatcggttaaggcagacaagagttcctgttcaacaaagattgggtccagtgaatcaagatcatggccaagaggacaatgaaaataggaaaagtcaatggtgtccttctggtatctttacgaagaatcaaaagagaagggttcaaagattgaggaacagggagcgctttcaggaggtcgagtaggaaattaaccaacggctgaagaagacaaagtcgaggcaagagtggcgtgtcaagaatcaaattcctgtagctgatgaagccgcagccgatgaggcgaaaaggttggctaaagggaaaagtgttgtaactgctttggttaacatggttttcacattgtctgccgagtttggggtcaagcacgatgaagttgaagaagaatcggctaaattgattttgtcaccggagcaggcaatttttgagaagccagaggggacagagaatcggcatcttaaaccattgtatataaatggttatgtcaatgggaagccgatgtccaagatgatggtcgatggtggggctgcagtgaatttgatgccttatgctactttcagaaagttgggcaggaacgctgaggatctcatcaagacaaacatggtactcaaggacttcagtggcaatccatcaaagaccaagggagttttgaatgtggagctgacggtcggcaacaaaaccatccctacaacattctttgtcatcgatgggaagggttcttatagtttgttgctcggtattatcggatggcttgtcatggatcgatccaagtccccccttacaaacttgtttatggacatgaggctgttttgccatgggaagttagaatcggctcaaggagaactgagttgcaagatgatttaacagccgatgagtattataaccttatggctgatgaaagggaagacttggttcagtctaaattaagagcccttgcaaaggtactagggataaggagcgaattactcaacactataacaagaaagtggtacccaaggatttttcggaaggtgaacttgtatggaagttgattttgccgattgggacccgggatagcaaattcggcaagtggtcgccgaattgggaaggaccgttccagattcataaagtagtgtctaaaggggcttacatgctgcaaggactcaatggtgaagtttatggaagagcattgaatagcaaatacttgaagaaatattacccaagtatctgggttaatgcatgattggctgatgttgccgatacatgatagccgatgtattttcatcgtcttgagatggccgatattgttatatcgcccttagttgttttttcatattgtactcggatgtggtttgccgatatacaatggccgatattgttatattgcccttagttgtttttataattttatcaatgcttttgacattgtaaaattaggggagcatatatatatattcaaaaagacaataaagtatgagagtatcttagccgattacagcaatttctaaggcttattacacagaaagtcaaaatttctaaggcttattatacagaaagtcattgagataagtatcgctggatagccgaaatagccctttgcttatatttgttctacttcaatagcttgggcatcttgagcatcggttccagggatgactttcaaacatttggtcaaatctgtaacattcttgatagccaatttgagtttggctttttgttcttcgatagacattgggaaatcggctaactttttctgttccatatctagctcggtgttgcattcttcaagttgtgccaagagctcaatcttgcgagcttcgagccgatcaatattggatttgatcggacccttagatagttgatcaagtttggtcttctcttcatgcacaagctgccgattggcttggattgtggcctcgatatccttgcgctcccgacgttcggctagtcttagcttggccttctccagcttgaactgatgttgctcaaggtatactactggagtaaggatatcggctagctcatctgggattagagcttggatttcatgtagtcgagtcctaattggcccacagtttaccaccagactatctaatgatgatgcttccagccgatgagagatatcttcaagtgttttcttcacatcatcggataagggagctaaagctttgcttgaagtatcttcctctgcctcattaagataatctctgatgtcaaaagaaaagagatcggctaaaacctgcagacaatttcaggaagattgagagttaggtaggtacagccgatctaaattcttgcatcaaaggaaaacttactgggatagcaggagcagctggttgttattcttccacaatatgatgactccccacagccgatggagttcggtcactcgatgattgttgtacaggggaagaaggaggaggaggaggctgtaaaagagacaagtgttagacaaaatcggctggaatcaactagtagaattgagagtgtcttactagtgaagctggtttgagaattggtgctgccgatttcttctttacagcagttttcttcttctgcagctacaaagtctatgagtaatcggctgaaaagtaataattataaaaggggatgcaaagaaagcggcttactcttaagatgtgagtgggggcagaaagagttggaggtgtctgcttaggcgaagccaatggcgtttttttagtatcgcttacttcggctgcagcctgatcaacatcatcctcaatatcttcttcatccagagcttgttcaatggatggatccaaggcaggcaggtcgtcggttggcttgattttcctagacttggcctttttctttggagctagaatcaaagtgctcacagccgatgatctagtttttcttttcttggttgcatcagttggttccctgattgcgccttgaaggagggttgagaccttgggggcatgatagccaatgacagtgggagacagtccgcctccattaggaatcagacctggagcatattcaatatctctgccgctgttgctgtgatgtggagaagaagagtcgattgtctgtaaaacagaagagaaattgatcaagtaatgaatcggctgacaatcatccaaaatttaaatgacaaagtttaccttgggtacgacatcagggaatagatctgtcatgtacattgaggccgattgatgaaacaagtgcaacttccattcgccccaccatctgtcaaagtttctgcttttaaatccggccaactcaatattgttaatactacctagaggaggtccttggaggttaagcagccgatccatcattagagttgaagaaatttctcctcggcaatggatcttgtcagcaaagaataagccgattggaagttggcctaatccaagttgtcgagctgaactcatagggtgatagaattcgtaggagacttggatatttcttccttagtggatgccaacaggtaagatgcatgggctaattgcagctgtaaagacttccctggatatttgatatctttcatggttgatatcttcaaatctaaagtctgatgggagctcaaggtttgctgagtcttcataaggaaaccaaactcgggcatctttctggaagccttcataaaagctgcagaaccagtctttgagcagctcggccgatagttttgccccagattagggttgaaagatatccaagagatggccaagacttgaaagtattcttctagtgacccagattagggttggctaatctaaaggggattctgttggtttcaccgatgatgaaatcagtggggtcaagattgccgattggaccaagaaagtagtggttttcgtgtgacaggctgggaattgcgattaggttggaaaagtgctgcacatccaagggaattgggaagaagaaaacacggtgaaaagggggaaatcgatttcatacgaagaaaggggatctagccgatgagaacttacctcggcatactcggcgatggcgcgacagatgagctggcggaagatgacattgctgcgggcggagatttgatcgagaatgaaatcgcctgggagtcgcctcgagcatcgaaggagtcgccgaagaaagagaaggcaaggttggtttcagcggtgaaaacggaagtaacggggtgaagatttttcagggcggcggttagtatttaaagcgttggggataacggtcagaaaacggcagattgcgaaactcgttcggggtcgatttatagcaaatccgaaacattaccaaatgttccggacttggggggcatgtgttaacaaccaaatttggtaacgttggcatcggaaaagaagattagatcgaagtggagttgaaggcggagatcgattcgggaacagagcaggaatcggctagagtccagatcggctacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgagcaaaagtctgccgcaaagacttatggtatattagagtttgttagagataatagtcgtgtccggtttggacatatcttgtaattctcgggtataaataagaccccgagccctatgtaatttctaacacacacgttcaatacaatttcagcgcatcgccacctttttgcttttgttttatttcgacgagttattgctttcgggttgagctgcatcggtttcgatcttcaacaagaggtaaaacttgttatgacaatttgcgttctcgggattagaggttccatctttatgacactctaatcttgtttatgtaattcgtcgagttatcatatatcttacataatctctagcaatattgccatctaacccacaatcggctaacatctgttaaaagagggcaaccagttaggttaaatatcgacattggtttagattatataagatatctaccactctatgaaacttccagcggcttgattgtctagatattgttcttcttttcatacttaatgctgcatcagttgagtctgatctattaagtcgtgcttagaatatcaatctctagcctgccttctggttgccgattagggtagcatcggagtttcagccgatcttatctgatttaactatatttactctatatgcttcattgacatgttaaatctgccctttatatcaagatattgtcgcatctaagtatattaagcttttgtttgatatattatacctgttttaatatcctgatatagagtagtatcggagtattagccgatacatgctaaatccatctgatcggctatgctataaacatatatagtcctgttattaatatatattctgatctaagtgatttatactgtctcggcgtggcgaccgatctatctcaatcacttgatttaagtatatatcgatataagagttatatattggtaatatctacagcagatcgagtagatttagttctttattatctacttataatcgccaatcgattcacatatgacatcggctcaaagataaatgatatgccatcggcacatagccgatcggctatcgtttatagatttaaccgcggtgtctttgtctttatttcttgttgattgcaggatcaaatcaactggcacgctaacacacccgaaggcgagctttggacctgcactggagttaagcagatctcccaggcctcgtgtttttcatcaacacgcttttggcacgcccggtgggaccgataagaagtgaacaagccattctttctcatggccgagaaaccacctctatgaccatcctcggctagcccgggtactgtcacaccctaaaaatcctaaatatataaattgttgtttaattggaattattagaatttattttaaaagtctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctccctcggcccaagtcggcccagtccgcctctagcgcgcgcgccctcgctcgctgacaggtggggtccgcctgacagtcttcgtctacctccggccgccgccgcccgaaaccctagcgccgcgccgccgccgtctccttccaaatttggccgcccctttccttctccggtgaaatcaattgaggggaattgtttcccgagatctcctctaccttttctcttttggaatcatcgtctaaatcgctttggaaattcatggattcgagtttgattcggattcatttttcccgaagtttccttcgcgtcgccggccgccgtgggccttcaccgccgccctccaacccctatataaggacccccggtgtctcctctacccgccgccaccctcgccttcgtctctcgccgtcggaagagctctagcgccgtgtgacctagcgtcgccgtcgtcgccgtcgctccagccgtgcttcgccgtcgctccagccgtcgccgtcgctcggggaggtcgccatcgtggtcgccaagtcgtcgccgtccttgtccgccccttcgtcgtcgccgaagaccgccggagcaccatcgccgccgtcgacccgatcttctccgccgcttcgacctcgtcgccgtcgccgtccgttgatcttccgccgccgttttggtcaccggtgagttcgccacgtcgcgctctacgtcctggtgcctttcgttcgtgccgaagcatcatcgttcgccggcgagcgtgcgccgtctgagccgccgagccgtcgccggaggtgacgtcgccgctgacgtcatcggggccgttggccgtgagccgccgtagacccgatcgatctcggccgtccgttttggatggatcgatctcggccgttcgttcccgtgaaccgctgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgctcttttctgcttagattccgatgtttccggagagtctgttttcgcaggagaagaatttgaagagttccaaggccagcaaggcaagtcacacagatcccaaacaaccctttgagcatgttgatcccgattaaagctattgtttctattcaactattgcatttattttcgaatgtcatttggtggaattaacctattgtttgttatagcccttttgttcttgattactttattccttgataccttgggttattataacttgactagttgggctttatatattggttcagctagatattagatatgaatgcttagccatgcttagaaacattagcacactattgggataacttatgattcactattaattatttaatgaggacttaatgatagttcacgatggtcaatcgtgattggttaattaattacttgccaattaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtgtagcatggtttattgcggggcaccagactgagaagtggcggagataagcccacaggggtcactggggagtccatgccttgtttatagggggtgattatgatccaggaatggtgcgctgcggtggattgtgttatgcaaggggtattgtcacagctcctttccgaggtaccgtggtggtattaaggcacatggtgacatgatgtggggctatgtcttgtgggtacagtggtacacctctgatcagagtaaaactattcgaatagccgtacccgcggttatgggcgggtctaacaatgtctttcgtgatgagtctcacatctctcatcataataaaagatgcaataactggtaataatttgtttagctcctggtttggaatggtatattcctggtttggagatagatctgtacagccgggtatggttgttcagaatggttaggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatagaaattccgggcgtgacaggtactgtcaaggaaacaatccagaagttaggttttactgacgtcaatgaaggaaacgtcatgcctatcgatccagaaaagttcacacctgatcaaaagaaagattttgatgcggtgatgcagcaagcacgggatcagttcttgaactcgttcatgcagacccgaaagggaacacttgttcagaagtataaactaaaagtgtttcctgatgaccccaggactagttcttccaatgatggagaagggaaacaagctccagatggcttggctcaaccgagtgacaagaatgccacagagggttttttagcaaatcaaggtgacaacttgccaggagtgcacggggttcaaggtgatgggtctcagggtgttcaaggtggaggtgttaatcaagacagtaatacagcacagttgcagtttaacaactttcaagatcaggttgactatgatgtacaccatgctttgatcaaccaatctgggatattaactaacattttggcaaatatggtgaagtcaatggttgatggttcaatggccgagtatcaagctacaggaccagtatacctaccaggaggagtgttccccaattatcagccattaatcactaataatcaaccagttgtccagtcaattcctctcaatgcaccatcggctcagccgacggcaccagcatcgactccagcacctgctgcgccaccttcggctccaggacaattagttaatccccagttgttggtaagagaacaaccacaacacgctggacagaatgtgaatcggctaacgcaagaccaggttgcatctatgttcttgcaccctcaacacactattgatccaacccagcagcagccgattcaacacaccccgtcaaggcaacaagttgtgcaaccaattcaacaaacgcccccggtccaacaggttgtgcaaccagttcaacagacaccaccaagacagcagatcttgcagccgattcagcagacgccactaaggcaacaggtcgttcagccgattcagcagcaaggtccgatgaatgcatcggctgggtctgcaatacctggtggtcagcccgtgcagcatgttgcaaatcaggttgttctagaacacttggttcatcacgtacaaccagatggcacagtaattcctcaagttattcctgagcatttggtgcgcaatattcaacca

SEQ ID NO: 8357 - DNA, 8600 bp, Oryza sativa
  unsure (1)..(8600): unsure at all n locations
tcgccattgttgccgccgccttccgagctctgtctcgcctccgccgttcatcgccaagcgccgggagagcctgtgcgtttgtggaccccgaaggggactccgggcgctcgtctttctcctcttccccggcccgaggccggagagattactcccgcgccgtcggcctcttgtcacagcgcccctcctcatctcggtagtgcctcccttcgtttttcctcctcgctccatctctcccccttagttttcagtagtagctcgagtagcctccccgtaactagccggcgccgtcccgaccgttgccgtcgctcgccgtgtgctcgccgccatcgccgcccgagctccgtagcacccgctcgtcgccggcctcgctcggcgtagctccgcccaatccgatgctaacaacggattcccgtggccgcatagatgctctcaccgccgggaattggcccctcgtgacctcgtcgccgtttccccctttgccttccgccggttgccgctgccaaaatccgccaccgacggactccctccggcgaatccgagccgttggctcgctccctctccttcttcctcgtcatcccggtgtacgccccgtcgcccctcatcgtcgcaaggcgccccggagaaaccgccaccgcccgccgtccattcgcggccggcgccttcgtcttcctcccgccagcccgcgtggcagccacgtaggcgccaagtaggcgccatgtcggcgccagctcggccgagatcgggtcgggccgaccccggtcagcccctcccgtgcgcgcgttccaccgcgagccatgaggctgcgcgtgggcccgccgcatccgttcctccgcgaaccacgcgcgtgcaccgcgtccctcccccgcccgcgcgcgtgcaccgcgtgctcgctccgcacggtgaaccgtgtcaccgacaagcgggtcccacccgggaccactcgtggtgagcccggtccaccggcgctctctctctcctcccctcccgcgcgcgcgcgtcttgggccgccttgggccggccagcccatttagctcggccggaccgctccatttctcttgggccacgccctagccgcccgagaaaagtctatattccctccctcttttcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaaaccacctttgaacatcttgagcctatatttgaatttaattatgttgcttgaaaaatattatgcattgataggatcgcacttaatctgtttgtcccgtctgcaaggcagattggcggacctacctagcttgttgcatttgatccttcctctgttaattgtcataccatgttcccttgtaaccacccagttgcgcctcggaaatcgtgcactctgcacgagtatcgacggtcgccttcaaacttaaaatctgaaaaacatcttgggtaaaacttgggttttacaaaagacttggaaaacccgacacctgggacggtgcttgcgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggatccctctcgtcggcatatggtaaacctgtgtcggctttggaaataccttgtcatgaaagcttggaggtctcccgacgtggctgatccccacgggctgggtgatccgggttagtaatgtcgtgtgggtaaagtgtaccccctctgcagaggttaacaaactgttcgaatagccgtgcccacggtcatgggcggatgtgaggtgattcctagcgtagttttgttcgactactgcttgtgaaattgctgttgtggaaaggggttcgatgtttgaaaaaccagcagctgacgggatcagctaggcccgggtggccgtttgaaagttgttggcccgggtggccgtttgaaagttgttggcccgggtggccgtttgaaagttgttggccgggtgccaatctggatcaattctaaagactgatacattgcacatactccgaccggacgagacgcactgtctcatccacgtcgtttgagaagcactcacttagttgtttttagaaaagggttcaaataaaatcaattgcaaaaacaacagcctttccttgaagcctgcattaaacacttatttcccatggcttgctgagtactcccgtactcacccttgctctatataaataattccccccccagttgctgaagaagatgaagcggaacctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgttgtgatattctgtctccctgtgataccagcactgtttcctgggactggtatcgattaacaggttaatttggagcgtcacgggctagttccagtcgggactagttcggggcgtgacacaatctctagcctgccttctggttgccaattagggtagcatcggagtttcagccgatcttatctgatttaactatatttgctctatatgcttcattgacatgttaaatctgccctttatatcaagatattgtcgcatctaagtatattaagcttttgtttgatatattatacatgttttaatatcctgatatagagtagtatcggagtattagccgatacatgctaaatctatctgatcggctatgctataaacatatatagtcctgttattaatatatattctgatctaagtgatttatactgtctcggcatggcgaccgatctatcccaatcacttgatttaagtatatatcgatataagagttatatattggtaatatctacagccgatcgagtagatttagttctttattatctacttataactgccgatcgattcacatatgacatcggctcaaagataaatgatatgccatcggcacatagccgatcggctatcgtttatagatttaaccgcggtttctttgtctttatttcttgttgattgcaggatcaaatcaactggcacgctaacacacacgaaggcaagctttggacctgcactggagttaagcagatctcccaggcctcgtgtttttcatcaacacacttttgtttcccaactctagagagatcagctaaaggactcccatgtaggaatagagcttttctcttgagtaaacacagtgctaaatggagaaagatcttggggttcgtatagtgggtccatgtgatatgaatgaaccaaagagaccacaccatcctgatgcggaggaggtagattttcactcttgcttttcacatttgcatgtgttattaatcttctttttttatatatttatttggaagcatcggaatgatcgcattttcaacaacgccatgcctaatgtaaatgttgttttggcggggctagagtgttttctggtgcatggctagagctagggttctccatgaactcctttgtcggtctctccatgaacaccgctatcattgggcgtcccagagaagcacggggcagtcaagcgctacaccttcccacgctgcatggcatcatcatatgggtgaggttttcaccgctaatctatcctcctgcccttctcatcatatgcggcacgatacacatcaatgcttggaacatggaggccatggcggtgtccatgtacattgctatcattatgaacattcaggagaagcacgggagggcagtcaagcactgcaccttcctcacgcttaatggcatcatcatatgggtaaggtcattcactgtcgatcggtcctcctggccttccctcattaggaatcccatgccgtagagcccgatattgtcactggatgtcaaggtgctcctgctccgatcgccgatacacatgcgggcacgcgaccacatacactccaacacacacacacacaatcatagttttttatgcggtgagcaaaatcgataaaaatcaattccaaaaatcatttgattttgttttagcaaaatcttgaatctaaaaccacttcttattcccctcaaatatttagtacaagcaaatgtgtctacatgttctcatagtacaagccaagcactagtaggcatgtggccacccaaatatcttctagccagaagctctcacaaaaaccaatccccttctagctagtgaggcacatcaacatcgtgttgtgagagtttgtcgggtgctcgtcatcactaagcgctcacgatacacatcaatgcttagaacgtagaggctatggtggtggccatgtgcactgctatcactatggacgtctaggagaagcacgcgaggcacgtcaagcgctacaccttcctcacgctacatggcatcatcatatgggcaaggtagtttgccgttgatctatcctcctaccattccctcgtcaggaattccatgtcgtggagcccgacattgtcactggatgtcaaggtgcttttgtttcggctgccaacacacatgctagcacgtgaccacacacgcacgcgcgcgcgcgcacacacacacaaaatcatagggtttattatgccgtgagcaaaattgataaaaaaaataagtccaaaaaatcatttgacttttgtttagcaaaatctttagtctaaaatcacttctggtttccctcatatggcataattcaatcctccaattatttaccaccagcagatgtgtctgcatcttctcacagtagcactagtagtcatgtagccttccaaaaatcttgtacctagctagaagctttcaaaaaacctgatccccttctaactagtgcagcacaactccatcatgttgtccgaattcgtcaggtgcttatcatcgctaagcagctcgatacacgtcaatgctcggaacgtggaggccatgtacaccgctatcactatggtcgtccaggagatgcacgcgaggcacgtcaagcattacaacttcctcatgttgcatggcctaatcatatgggcaagggcgttcttacctcctggccttccctcatcggggattgcacaccacggagcccggcacagtagctttaggtcaagatgctcctgctccaatcaccgacacgcatgtgggcgttcgaccatacacacacagagagaaacacacaatcatagagttgattgcaataatacttatttcgttttgtgtgccggggaggagggttccaacccctcctcccgaacgccagccttagttctatttagcacaactctcgcggttctaggtttatgctgaatttaaagtatggcacaacacaatcgtagagtattttgtagtaatacatttttgtttttaaaaaatagattaatatgattttttttaaaaaaaacaactttaacggaccgtttagtagttcgatcggatggccccgcacatgtgtcgctcgatcggacgatccgcacatgcgtcgcgggcttgagtgggatacggccgttggatcaaatgtggacggccagatctgtgacaactgcagactgtgccgtagccacacccaaacccgcgccaccgccgccgccgtgggagcagctcgaccgttcgaggaggcggcgatggagcacgggacagtggaggactcgagcgcgtcgacgttctccatcgcggaggaggaacacaccctcgccaaccccgccagattcgtcctcaaccaggagtgagagttcttgtgtaccctttgtttcttgtcccctttgttttttccttttatttttcctgtgtcccctttgttggtttccgtgaaattcgatcgtatttccggccaacattttgaatttgtgcggtagatgaatctgtggttagagccctaggagaggaggcaaaaacttggttctagcttctatcaatcttggggtttacagtggaagagaggagagatgtggatttgttaggcaattagatcgattttattttagtgagtaaaccgattggctgtagcagttgaatctccagttatcgataggaattctgatgaaattaagtgggcaagattttgttttgggtttttggagaatgagggcattgtgagtgttgaaaatggtgaagcctactttttttttgttaactaagtaaaattacaaagatagggagaaatatttgtggggtaatgttgcaaacaaccatcttgacctgttgatattagtgtcagttgatagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgtggttgcagcagcgacggtgtcgacgacaaggcgtggcgcggcggtggacttcccgtcactggctgcgccccctcgatcggttagggtttatggggtggagtggcggcaggcgacgaaccacattccttgtgtcgttatgccgtcccgtcctccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcatcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcattataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctactgccagggtaaacatgtatcccgatgttaactttgtattatcttttgcaaagtcagaattcgaataccccactatgtggagcgattctgattttctgtaagacagcatgaggcttttgttctttgcaaataatctttactaattccagtgctctaggcctggattactttgcaatctgccaaataacccggtaacaaatgccaagtcaggtcgtgtgcacacttgagcgtactgtaggcttcctacagttgacgcatatggctttattttcatttcattgagctcatactgatttctaggacattgtgatgccccatacttttcgcctttgactataggagcaggtgtagcactgcatatgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagctgtcctctacattctcttgaaaacccaaatttctttattgttccatcaaacttcaagtagcattgtctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8358 - DNA, 2335 bp, Oryza sativa
tatcactcttcagttccttatcgagcatgggcagtggctggttgttttgttgagcggccaaatttgtgcttccacttttgtttcctaatatatagagatcagccaaagtacctgaccaagtaggatcaacgcttttctcttgagtaaacacagtgctaaatgaagtcggatcttggggtttgtatagcggatccatgtgatttgaaggaatcaaagagactgcaccatcctaacgcggaggaggaaacttttcactcttgcttttcgcagttgcatgtgttattaatcttcttttaacgatatttacttggaagcattggaacggctgtattttaaacaatgtcatgcctagtgtcaatgttgttttggaagcagtggtaggggagagtgttttgtggtccgtggctagagctagggctctccatgaactcctgtgtctgtctatcctgttgactggttatttgttgcctgaaagtgtgttttgtgttttggtgacgcatcgcctgttgtgatgttttctttctcaagagggttccttcgtgaaattctcttttcaacatattttgagtattcttaatgaaatgaagcacatggcttttgcgttttcatgaaaaaagaagtccaaaaatcaatttgactttttagtgaatcctgtaatccaaaaccacttctaattttccttgtatggcatataacttacccctcccattgtttagtaccatcagaacgtctacatcttctcacaatacaagccaagccctagtaggcagtcaaccaccgaaaaatcttctagctagaagctctcacaaaaaccaatccccttttatgtagtgcggcacagctccatccgtcgtccaagtttgttgggtgcttgtcatagccaagcgccatggtacacatcaatccttgtatcgtggaggacatggcagaggccatgtacaccgctatcaatatggatgtccaagagacacacgaatggaaagtcaagcactacgcatttgccacgttgcatggcatcatcatatgggcgatgtcattcaccgctgatctatcctcctagccttctcttgttagggattacatgttgcgaagactaacattctcactggatgtcaaggtgctcctgtttcagtcaacgacacacatgcgtgcacgtgaccataaacactccaaaacacacacacacacacacacacaaactccgcgtggaccccatggcctcacctgatttccctacctccctaccatcactgctgcatctccaagcccaaatcccaaaaccatagcccatggtcgcatctcccactggctcctcctcctcggccactgccgtggcgacgatggcagcggcagccgagcccactgacgggccaacccttagcgtcgtctcgaagtggctccacgcgctgcggaagaagcacaacaagattatccaaatggaggagccgctcgctgacgggcggaagctgaacaaggagcagggggaggtgccctaatccaagcccgtcatcgtcgtgctcatcgacgagctcgagcggatgcgtgccccgctcgccaccgcactcgctgaggagctctcctcccgtcccgcccgttccccatccgtcgtcgtgtcctcctcctccagtgtcgatttgtctatcaaggatctcctcgcgctcatctactttggctccctcttcgacgtcaagccacagaccgagttcatcgccaccatgctcgtgcgtcccaaggagtgggactgctgcatcacctttgactatgtccgcccttgtcgcctcacgcgctgtcgctcactggtcccaccgccactcgcagctcgtcagtgcgggaagaagacaggagaaagaaggaaaaaagggggaaaaagaagagatggatggaaaacatgacggcggtggcacggttcgaattttgtaaaattttagtagcatggctacgaatagacgaattgtagtggcatttttttgaaccgacatatttgtaattgtatggatccaattaaccctagtatttattgtgtggtgagcaaaatcgataaaaatcaagtccaaaaggcattgtctgtaaatatcactcttcagttccttaccaagcacgagcaatgcctggttgttttgatgagtggaaaaatttgtgctcccacttttgtttcccacctatagagaggtcagccaaaggatccgttggctccgaccaagtaggaacatagcttttctcttgagtaaacacagtgctaaatgaagtcgaatcttgggattcatatagtgggtccatgtgatttgaggagccaagagacgacaccatcctgatgtggaggacgaagaagcacaac

SEQ ID NO: 8359 - DNA, 4457 bp, Oryza sativa
ggaggaagctgaacaaggagcaggaagaggtgccctgatccaagctcgtcgtcgtcatgctcatcaatgagctcaagcggatgtgtgccccgctcgccaccgcacttgctgaggagctctcctcccgtcccgctcgttccccatccaccgtcgcgtcctcctcgtcctctagtgtcgatttgtctatcgaggatctcctcgcgctcatctacttcggctccctcttcgacgtcaagccacagaccgagttcgtcgccacaatgctcgtgcgtgccaaggagcgggactgctgcagcaccttcgactatgtctgcccttgtcgcctcacgccctgtcactcaccggtctcgccgccactcgccgctcgtcagtgcgggaagaagacaggagaaagaagaaaaaaagggaaaaaagaagagatggatggaaaacatgacggcgatggcacagttccaattttgtaaaattttagtggcacggctatgaatagacgaattatagtggcatttttctgaactgacatatttgtaattgtatggatccaattaaccctagtatttattgtgtggtgagcaaaatcgataaaaatcaagtccaaaagtcattgtctgtaaatatcactcttcagttccttaccgagcacgggcaatgcctggttgctttgatgagcggcaaaatttgtgcttccacttttgtttcccacctatagagagatcagccaaaggacctgaccaagtaggaacagagcttttctcttgagtaaacatagtgctaaatgaagtcggatcttggggttcgcatagtgggtccatgtgatttgaaggaaccaagagaccacaccatcctgatgtggaggaggaaacttttcactcttgctttttgcagttgcatgtgttattaatcttcttttatcgatatttatttgaaagcatcagaacaattgcatttcaacaatgccattcctagtgtcaatgttattttgaaacagtggcaggggagtgttttgtagtccatgtctagagctagggctatccatgaactcctttgtcggtctctcctgttggacggttgttgtctgagagtgtgttttgtgttttggtgacacatcgcttgttgtgatgtttttttttcaagatggttcctctgtgaacttctcttttgagcttattttccctcttcttaatgaaatgaaacacaaggctcttgtgtttcatgaaaaaaggtccaaaaatcaattaacttttagcgaattctgaaatccaaaacaacttctaatattccttgtatggcatatgactcacccctccaattgtttagtaccagcagaatgtctaaatcttctcacaatacaagccaagcacttgtaggtagttagccacagaaaaatcttctagctagaagctctcacaaaaaccaatccccttctacgtagtgcggcacagctccatccgtcatccgagtttgtcgggtggttatcatcgccaagcatcacgatagacatcaatccttggatcgtggaggccatggtggaggccatgtacaccgctatcaatatggacgtccaagagtcacacacgtcaagcactgcacctttcccacgatgcatggcatcttcatatgggcgacgtcgttcaccgctaatatatcctcctgcccttctcttgttaggaattccatgctgcgaagcctgacattctcattttatatcagcgtgctcctgttcgtgtgaccacacacacacacacacacacacacacacaattatagaatttactgtacagtgagcaaaatcgataaacataaaggccaaaaatcattgtttgtaaacatcactcttttgttccttatcgagcacgggcagtggctggttgttttgatgagcggccaaatttgtgcttctacttttgtttcccaactctagagagatcagccaaaggacccgaccatgtagggacagagcttttctcttgagtaaacacggtgctaaatgaagaaagatcttggggttcgaatagtgggtccatgtgatatgaaggaaccaaagagaccgcaccatcctggtgcgaaggagaaagcttttcactcttgcttttcgcatttgcatgtgttattaatcttcttttttcatatttatttggaagcgtcagaacgattgtattaccaacaatgccatgcataatgtcaatgttgttttgaaaccattggcggaggagagtgttttgtggtgcatggctagagctagggctctccatgaactcctttgtcggtctctccatgaacaccactatcactggacgtccaggagaagcacggggcagtcaagcgctacaccttcccatgctgcatggcatcatcatatgggcaaggttttcaccgctaatctatcctcctgcccttctcttgttaggaattacatgccgcgaagcctgacattctcactggatgtcaacgttctcctgttctgattatgaatagacacgcgggcgcgtgaccacaaacactccacacacacacacacacacacaatcatagaatttactgtgaggtgagcaaaatcgataaaaatcaagggaaaaaataattgtttgtaaatatcactcttccgttccttatcaagcacgggcagcggttggttgtttttatgaggcggccaaatttgtgcttccacttttgtttcccaactctagagagatcagctaaaggacccccatgtaggaactaatattttctcttgattaaacaacttttatcttgagtaaacacggtgctaaatgaagaaagatcttggggttcgtatagtgggtccttgtgatatgaaggaaccgaagagacagcaccatcctgatgcggaggaggaaacctttcactcttgctttccgcatttgcatgtgttattagtcttcttttttttatatttatttggaagcatcggaacggtcgcattttcaacaacgccatgcataatgtcaattttgttttgaaagcattggcgagggagagtgttttgtggtgcttggctagagctagggctctccatgaactcctttgtcggtctctcgatgaacatcgctatcactggacgtctaggagaagcacgggacagtcaagcgctacacctttcccacgccgcatggcatcatcatatgggcgaggttgttcaccactaatctaccctcccacccttctcttgttaggaattccatcccgcgaagccagacattctcactggatgtcagcgtgcttctgttccgattatcaatagacacacgggcatgtgaccacaaacactccacacacacacacacacacacacacacaaaatcatagaatttactgtgcagtgagcaaaatcgataaaaaccaaggcaaaaaatcattgttcgtaaacatcactcttctgttccttatcaagcatgggcagtggttggttgttttgatgagcggccaaatttgtgcttccactttactaacaaccaaatttggtaacattggcatcggaaaagaagattagatcgaagtggagttgaaggcggagatcgattcaggaacaaagcaagaatcggctagagtccagatcgactacgattaggatcggctgagtctgagtcggactaggtgggctgatgcagccgattccgacaatacaacttggtgtatgacatcgggttgaattgaggtgcttcgagatgatcaccgcacatggatagagtcctgagaaggcaattgtatctattaattaggatattttatgtaatttccttaaagatatgcttgggcaaaagtctgccgcaaagacttatggtattttagagtttgttagagataatagtcgtgtccggtttggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacggtttgcattctcgggattagtgcttccatctttatgacactctaatcttgtttacgtaattcgtcgagttatcatatatcttacataatctctagcaatattgccatctaacccacaatcggctaacatctgttaaaagagggcagccggttaggttaaatatcgatattggtttagattatataagatatataccactctatgaaatgtccagcggcttgattgtctagatattgttcttcttttcatacttaatgctgcatcagttgagtttgatctattaagtcgtgcttagaatatcaatctgtagcgcccgttccgtcgtggcgcctagcgggaaaattatctcttaaaaaccctaattgcgaaatttgtttctttgcttgttgtgtagtgcccgtgccatctcaagatctcaaatccccgatc

SEQ ID NO: 8360 - DNA, 8255 bp, Oryza sativa
agagagatatgtaaactttgtgaacaatattactatcactttattagataaagaaatgaccaaaataaaagttgtatgtgttgatgagctctacaacttttatgttcatgactttttcagctgaaaataattacagcttcaaaatattatttgaagttttgaaattcaaatttttaattgataaaacaaagtcacaagaaaaaaatggccaaaataatagcggtaagaacacaataacatgataaagcatgattttagaaacatttaggaaaaagaatcatctaatttagagttcatatgagtgagataaattagtttcaaatttccaaattttatttttgcatacggcttcttaagtcccttaaatggtccacatacaaacaaatgaaaaaaattcaattctgaaaaataaccactcaaatttttaaaaactttcaattgaaatgttcaacccaaaatttaaaatattcaaccaattttcaaaaatttcaatgtgcctacgaaaatttcggtgatacacattaatttatttgtttcatgataacataaatttatatggaaagtaaacataacattttctatctcccccttgcccttataaatagagataaaatttgaaaataatgatgttttgatggctacatctctttctcgttttaagaagcttattttgaggggtcttcatattttgataattattcgttatcgtattcgtttcgattcgtattcgctccgtatctgtattcgataatattcgattccgttttcgtatccgggtttccgattctgatttcgattccgagaaaaaatatgaaaacgaatatgatagagctagtttccgaccgtattcgattcgttttcatccctacatgcactggatatagtttgatcaatagcctaacatgcattcagccacatcatttagaaataagagctagccattggatcatttccatgttttaatcacaaccattcattttgtacctattattcctcattaattagtatataagtcagaataaaatgttattgccataaataagttacactatcaccatctttggcaccattgcataacactttttcatctcagcctatatatactcataactatattttgaaaatttataactgtattgcagctgcacctcgcggggtgtcatctactatcagaaaataagaaaagaagagagaggaggagttaggcgtgagttgggcatccgatttaagaaaaagtgcattttgactcccttaacgtaggacaaatctaattcgtactctttgaccagaaaattggataggacgactccttcaattattaaaactggtgtaatttgactctcttagtggttacggaaaacagttttgctgacgtggccctgtgacccggtccaatcggcggactcaacatgtgggacccatatgtcagtgtcatattttcttctcccctctttcttttctcattttctcccctttttcttcagggcggtggtcggtggtctgcgaggagaggagcgaagtggcgagagggtctcgacatgatgtgctcgagcagcacgtcggcatcggcgggcagtgggtgtagtacacagcgaccgacggcggcgacccgctcggcgtggccggcgtgcatagcatgtacatgtcggaaggaggtggggacgggattcgcgacgggttcctcgggcggttcctacttggggagggtggccaaatttacatattaagaaaaatatcattacaatttgtctatttgtagccatgtcactaaaattttacaaaattagaaccgtgccactgccgttacttttcccatccttctccatctttctccggcttcttccttctcgctttcggcttctctctccatctctctgctgtcatgcctctgtcgcgcctcatcgtggaggacgagaaccgcacagccatcggcgtgctcggcgccatcccgccacgctgacggagtagcggacgtgtggagcggtggcagtagcaagagagacggcgctgacggcgcgtgaagcgagccatctcccgcagtgaggcgagatcggaggagagagagcttgccggcgacccaaccatggcaggcggcggcggcgcatggcagctccgctttctcctctccctcctcttccggatttggcggcaaaacccaagcgggtgaaatccccaaatcccctgtctcctccttctccgccaccacatggatccagctgttggcttgccgatctggtggtgggggcaacctcctccacagcaacgaccattctccttcgccacctcgacaccgccaccgtgctttggcctgcttccgcacccccggctttctcgacggtgatggtttcgtcctcttcttcatgggcggcaccatagccgccgctgtcctccaccgcatcgacgctgccaccgcactctgcgctctggcctgcctcccgcgctcccggccttttcggaggtgatggcttggtcctcttctccatgggcggcgccatcgctgccgccgtcttccgccacctggactccgccaccacgctcttgcctgcctcctacgccggtgaggattgaaggcgacggcaccacgtgcggcggtgaggacggaacgaaggaagaagacaaaaaaaaatgtaggggatggataaaaaacatcacggcagtggcacggttttaattttataaaatttcaatatcacgattatgaatagacaaattataatgatatttttctaaatatataggaaaaaattacaattgcaggaatccaattaacgaattaaatttgaaaatatactgttgattagttttttttctcagaaatatttgggatgtaaatttttttttggcagaaatatactatcagtctcgcacaaccgttacgcgaaaatgacgtgagcatgatgatacagacgttctcacacgaggaaaacgcgagactttgcagtatcgcgtaacgacgtcacgagaccgtgcggtgtcgcgcaacggaaaacgaaaccacgcgtcctcgggcgcacggagaagccacatcacaagcgcgtgagcgaacggcttgcttagaaagtagccgcattattagtgattaattaataataattagtaattaatgaggttgattagcgattaattaatcgataattaagccattcggtctcgctccttctcgctatttcctcgcggtctcgcgttttcttcgtgcgagatcgtccatatcatcatgcccacgtcattctcacgtgactgttgtgcgagaccgatagtatatttctaccaaaaatttacggcccgaatatttacgagaaaaaaacaaattaaaagtatatttgcaaatttaattctccaattaataacccagataataatacagttccattcctattgggctcatgaggcctgttatgtcggtggcccacgtgaggaacgccggcctgcacgccgcacctctccctcttcaggcgtttccatccatacaccatacccacccacactactgcccctcattccctctatagatggccatatggcccgaggcccacggcccggcacgaagcccgcaattttggcccggcccaagcacagcccggcccgactagggtcgtgcccgtgccggcccggcccgacagccgggccgtgcctgggctgcaccctcggcacggtgggccggcccggtacggcccaatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccactgagttgacggaccaaatatagactttttctgtgaggcagcacaatagcccatcataccttcgggccgggccggcaaaccccgagtagtattgggccgtgcctgggccgtgtatgccacccgtgggctggcacggcacggcccggtgcgtcggtcgagccgtgccggcccgacaagcctcggcccaggcacggccgggcttgggccgtgccgtgccaggcggcccagatggccatctataattccctccctctcttgtcctcatgcacgaccacgaggaggcgaccgccgccgcacctctcctctttttccacgacgaggcgccggtctcgccggcggagcccagcatcgccggcagatccacgtcgagcatcgcggcaggagcaggacagggagaggccgaggacacagcgaaaggggatcgatcgatcgatcgatctagggttttttgagctccgccacccgccccctccttcccgatggagaccccctccgctcccgctcccggggatggaaactcggctcccgcatcatctcgggtgacgtttgaggatatgcttcgcagctgcgatcagagttattatcaaatgctcgggttccctgacgctgcttcctacttcgaggcaaaggagcgggtaggtacccagattatcccttctccgtatggatcgatcgatcgatcgaccgaattgcaatatcttcccttcagacattcatttggctcactggttatgcaatcattttgcgactaactataaatatggcgacatgttttttggggaaaaaatactagtctgttgctgataacaggtcggcaacacagcaaagagacatatttggttggcaaaacagttagattaaatttcctgcaacatataatatttagcaagaatataacctagactagatcggtggtaagaattcatatgaacaagctccaatcaaatttcaaatttttattatctatctatataaaagttacatcagagttacagtgcaattacaatgtaactttgttgtaattatatataattatggtgtcattgtgctgtaattttaaccaaacaaaaagcaagctagtgctagctgtctgttcccggtgtaaaatgttgatttagctacctgtttcacactgctacatgcagggcccttatggagtgtagaaaactagtgttgtcttctttagttggatagaagcatgaatcataacacagatcaaacggtcaaacaacttactgtgattaagcaaaaaatctgttgacacaactatagcaactccaatgatttttggcttcctttgtagaatttgttgggtcagtatattgattacgcaatgtttctttttgggcttcctttgtagaatttttgggtctgtactgattatgcactgttttcttggcttcctttgtagaatttgttggctcagtactcgcgtcaggtattccctctgctatggcctatactggagaaggatagcctcacgcgcttcaatcgactttgccaagggtggtcgcgcttgatgggccttcgtggtttcatttacccggagattctcagctccattgtcgccaacaacgctttgcgctgtgccagagtggccctgcaaggcagctctccgttgcgcggacgtcgtgccgatcccaacggcctccatccttatggctacacggctctccacctggccgctgagacgttcagcgtcgaaatggtcaagctcctcctccgccacggtgcgtcagcaaaccaccgcactgagggcgactacgtcattgagggcctcctgcctcttcacgtcgctgttgagaatgccagcatgcacaaatacctggaggacaattgggctgatggccactctcctaacaacctcatatctctcctctgtctgccagagatggttagtgtgcatctactataataatttatcgcgaacatccatcaagctaccactattttgtttcttttagtctgcttacatttacttcatatgccattactctcgccgttttgttcagttaactatgtccatgaatgcttacatgtaaggcaaaaattatttactagtggtagggtagctaccgccatgcctcatttgttaagtgaactttatctgatttcaagatttttttaaaatcttgtgcataactaagcccaatcatttctccttatttgttgcatgcatccatcgaaacttgtttacagatttttcatgttgcctcccatttgcagaagatgtatttggacacaactagattaattgcccaacatacgcataacattgtcgatgagttgtgggattacatcgataagaagaagtttgtccagttagcaattttgctgctggcttctcagaagcagctccatggccccataaataggagccgtggcaaggctaatctgaatgggtttgaatctattagacggcgcacttatgaagctatcagtggcctacatctccagatgatagctatggtgaatgaggggaaaaatggcagtgcgcttaagaagctgaaagagaagaaggaagcccttcttacagcagacgcactagttggtattatagacaaagctggtcaagatcttgaggattatattcagactaactcagaggtagttcttaaatgatacccccctttgtgatactaatgagttttcattttctatttttatgtatgcttcaaatttctgtgatgttgtgcatgcatgacttcgttctgctagggatgctccaattagtaaaatgctttcttttgtgacttgtcaacagtaggagagattcctatgcagtttaccatctagtcatcatcccataaaaaagaactaaacatatctttacataaacccaagagattgtcagtgctgctttaaaagtttatgtattcctgtttgacagtagaatatttttttttaaaaaaaatgtgttcaatttgtaacttagtaactatttttattgatataggataattctttttgtcacaatgtagttcttttgtcagtcatctaaaaattaactaatacaatttaggggtaatttcgttcatacccttgttttgatgttcaatatcgattttatcctcattttttagggttttcatttttacccctgtttttttgaaacgaagttttattttacccctactctggatggtcaagttaacaaaatgacatttataccctcagttgtggttgcacatttgccccaatatttattcattaattctgtttttaccctggtttggaacatgattttggttcggaacataatttcgaaactcaaatgattttgacaaacttttactaatacatatgaatgaatgaacaatttgtagcccaccgtatgcaccaatatgtacaggcagaaatcacaatggatcctagacagaagtgattctgttctgcaaaataggggcaagaacgaaattatccctacaatttaagatcactttcatgggctgtgtttgaaatgtgtactgcaggaaatgtaaaaaggggtaaatgcctaggaataggcctaacatttgaagatctatttggatcacatgttttattttgggcgagtgaaacacctgatagttgttcatatggccaatactaaacaaaaagaagtttcattaaaaaaatggagaattttgggatccatttggaagggaagatacataaagagtggtagataggaatctcatactatctttcctgtaaaattcctttggaatgcaagaacaacaaagaaaaccaagatagtaagagcgccaagaacatgcgatgattctagagcttcctcacacataggatcactactgcctatcacatcatgaagtgcctgtgaccacttaatcattaatcattctatcactgtcatggttggcactgctgttgccattcatggtggtggttgtgatggaagtaatgggatgacggagagtagtagcctggttggtttaggcagccccaactttccatcaccttttttttataaaaaaatgttttctaatttattgtctctcagtctcagttgtgtacaatgtggcctttgtagtggtaactaggtatgaatatcttctttgccgtcttgttgtgtaaaatcggttgtgattcgtgttttgtgatgtttttgttttttgttttttggtgtttccaagggtcctcctgtgttttcgaaaaaaaagatatatcttctttggctatttccacgaatatttacagcaaatacagccagtaggctactagcagtggtgcagccaggaaccagtcctagaactgcccttgcctactagcgcgaagtagtagtgtataccatgttgagaaatctaaagtagtgaaaatactaaagtttttcaccaccacaaagcgccaggtcatcggatatttaggaccgtcggatgcagccacgaattcaaccgctgccatcagatctgaa

SEQ ID NO: 8361 - DNA, 20326 bp, Oryza sativa
  unsure (1)..(20326): unsure at all n locations
aaaaggtacaaaaagaaaaaaagaacgcaaaacccatctccctaaacgcatccattccaccactgcctgcccacctcctcgcctcctcctcacctcttcccccattgctgttgcctcgtccgccgtgcgcactcgccctctccatatccccgtcgccgcagcaagcccaccacctcagatcctccccatcccctccggtaaagttcctcatcctcctagtgcccgtgacagcctcctagtccccagccccatgccgtcgccttctcctctctacccccggcgtcttttcccctctctgcacccggcatctcttcctcgcacagtccaccgcctcctcccccattgacgctaaagccttgagctacgcgctttctcatccccatcccaatcacagctccagaaaatatcgaggttcacaacggtagatcaaggcgggcaacgataaatcggatcgcagcttccagtcacccctcgtcaacgggatcaacacgtcaataacccttggtatttggtgagtcacaaacttagtaaatcccatcgcctcctatctttgccttcccaagctgtagccaggaaccagttggggtcaataaagaacagtgatgggatggattgatgaagagcaatgttataataatatattagaaagcacatgtccaactgtgtttcgtaaaaaaaaaaggattgttcctgtgttttgttcagcaagggaatattaatgtgataagctgatagccaactcaaatgatttttttttcatggacaatagggtctttttaattttttttgccttctgagttctgaagctgaaagccaagcgcaacagttcatggtcaccatgtgacaataggccctctggtgtgtccttgaagcctgagggcacgttaaccttaacctgtttaagtacaaaaaaatttaggttctacttgatatatctttaaagccaacatcgatagcacctgtttaattgtacaccaatcacctgaatactggagtttctgactctgcatttagcctatgtaaatgtcaatcatatattgcaaactgtttatgcacatgtcaatataggattttagcgtgaatttgagaaacaaaatgtaaatgactgcatctgtaattactacatactaggtacttctgcatttttggcttgcaatatgctgaccacaaatggttgtcaagcctgaaatttatgatgactttcttcactcattctgatagagcttctttgatagaagaagttatatcttcttactctttaagattctagatattcctaccctcaacagcatatttcttcttactctttacgattatagatatccgtaccctgtttaacctttacgatattatatacactttgcaccagcgtatacatatatcttaaatagaccatcacatactaattttacaggtcatcatggtcgtgccacgcgcgacctacgtggctagtgttatttgaagttatgaactcagtaccatggcaaacaatgttcttaaggtggcggcgcctaggcaacaatgcactcccagcgcgatgtagagctgcaggagattcagaaaggtcaatcttgtgttatcaatctatataaaactgatggtcaaatgttaaaagagttggacttaggacaaacctagatggacttatatttgtggtaagaatttagtacttagaagacgatctttgtgtttttactgtgctgtactgtttgtcttgagagatgttctgttcaagggttattatgtgccatgcagccaccaccacccttgaaatgtatctgtataattgttggaataatgtcttgaacatttttttagtgacttacaaatattttgatgaaacgtaggtaaaccatgaggaggtccttgaacacgtttcatcaattctaaacagcaagggcattgttccttctgggaaagggatagacactgcagaccttaaatggtatgtcatctattagcttcaccttcacttatattcattccgtatcttctaaagcacatccgacatatagttgatgaggcgttcttttcctaaaatattccttcttgttttgaagctaccgatatcctgggcaaacatcaattaatatgtcacattcacgaggtttgttacttcttggttgattttatttcttaatactagaaaagagaaaaatttatacttccacctgttgtttgtggtgatgcactactttccaatattgcagtataaaaaacctgatcttatccagtaaaaaaagggggtgcaacgtaatgtaaagtgaatcaaaactgactggaccaccactctgctgctgaccgacaagtatcagctgtggtgctcgtaatattgtctgcagattcttttttttattcatgtatgtattgctgctgccaagatgcaaggacaacgattttcctccatatcgctaacacccataacaatcttagccattgcctattgattagatttctggctatgattaactttctgttcctttacactgtgcctttattgaatatagttgacccctaaccaattcctttattgaatataatggacactgggggaactaatgaagctgacaagtcatatacccttaatgctgaaggttgtaaaagggtaaggtgatactttactaaattggaattgtggattatctttcttttcccatgtcaaaaatatgtttacttcaacaaacatataattgctatgccgtttttttgcaagtacttgacagcaaaagcctttcagttttgttgaaaaaaaaagttttagtctgatcactgtaacttcttgtgatcctccaaatggcaccgtcaattcttatcttagttgttcaagtacagtagtgttgtagtctactcccttcgtttcacaatgcaagtcattctagcatttcccacattcatattgatgttaatgaatttattaacatcaatatgacttgcatttgtaatctgttgagtctaatttgtacttatagatatttatagtggcattattcttctgaagtaacatatcctatcaacttggtcgattaaatatttaaggtggtatttgatataaattaaataaacataacacgtaacctctagttgccgccatgctgtttaacaagttaccatgtatactcattgcttcccaggtgtttgttgtttatacattcagatgctacgtctcatgtaaacagatcccttcaaagcgaccatctaaactactggtcctaaaagaagcgagagataagttctttccatactggaaatcggtgctgtctgcccgtttgccgtgaagatagttccaccctgtgaaccaagcagcaatgacatacaaaggactgaaccaaggaaggacatcctaagtactgaagcaagcaggaaggacttgcaacccccaaacaaatcaatcgcgaatcttgtttcgacgtcaaagccccgattggcaagcaattatgaatgcaggaggcagctttgtgctcttgctgcgatgtctcttaaggtgttgaggcgcacgtgagtgaatctatatggtaatatacctgttaaaatactcctttttaggctactgcatgatcgtttcttttgttatagaatcttttatgctcaatgttgctataatctttgtgcaggcttggtaaagacgaaagtatcggcggcatgagagtagctgtgctagaatctgtgttcgtgttcttttgaccttcgtggccgtgttatattaacatgtatgtacttgtcatgaaaataagatatatatataccagatgtaatgtatttcaggcttgatgcaacctggtaacttggtaagatttctagctgaacacattgtgctatctttgggagtgccttaattttatgattaaatgctgtggtgccttgtgcaatgtgaagatcgatttaggttttactgaagtatttatatagtggcgctgcgaattgttgtatttagtgtagtcgctagtctcctgtaacatagctatagaatgggtatggctgcttggctatttggcctttgggaagaaagcacatactctcgtactggggacgtggagtatatgctatgtgacgtcagaaaatgtattattacagcatacgctactaagtacggtatttcgcagtctacttggcaggcagtattagcaggtctcgtggacgatccgcactagctcccatgtattgaaatgtggcacattagctttgatcccatctactaattggctctattgatttgcgtgcacacatgacgcacgtacacgtacccatgcatgcatgcatgcatcctaattaattagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattataggaaaagaagctggatccctaccacctcaaccgcaaccgcaccggtgtggtcgtcacgtctgtcggagtcggagcccaagttgcattggtgcgaccgcgagtccgaccgacgcactaatcttgcggcgaatgaccggggaaaaaaaataaaatcaaaaagaaaaaagaagcgcaaaaacctactactactactacttccctcactccagagtccagaggcaaaaaccctctccgccgtctcgagagcaccgctgcggaggagaaaagccggggagccggggaggtggggggacgcggcggcggcgctctctcccggcccccgctgcgcatcttcgcgcgcggcgtctctagctctccccccggcccgcccggcgcccatcttcgcctccgccggtacgcatcttctcgaccttgaggcctctccccctctcctctcccattctcgagggttttattttgccatgttgccttgcctgcgcggttactggccgagagtttcttggtgacgaaatcttttggctttttgatgggtacggttctgtctgtgcgcggggaacttcacaatttctgggccggtggggaataatatatgactagttataacacaggtcttatgtctcttttcttatgacacattgtggatctatgtatgacaccattatggatgcactaagtagtttattaaatgcattgcttatttgtcagtcttgctaatttatttctttattattattttttttttgaaaagagggctttgcctcgtatatatagatagagaatcgggctaatttaattgtaaatgctgttaatttgcagccatgttacttcgacaagtgaatcaaaaatcatggaatcttctgaagcaacatagccgtccagtgtgccttcacttctcttctgatagttcggccaattcaacggctaatattgatcttgatgctgaagctatctgtatgaatcctttgaagccttactctaagtgttggttttatgtgcccccgtggatcaacttgccgcccataaataaggataatgatattaagaagttgattagttctaatccttcaacagtaatgaaagcttatgagactagcaagttagaaatgttgtttgagaagaaagttcgctcctttcttgtttcaaggtgtattctggcttgcgaatctataaatggtcctgacatcaagaaactgcattttatgaacaagagtatcattggccactttcctgtctatgtgacctctctctctttgatgaagtgtttgatcaaacatcgtgaagaatactggattgcaatccttcaatcacttgcagcagagaaggtgatggtattacctgactggaaacaagaattaactcctatcgaggtttcgttcttcgatcatggactacagttgccatccaagtctgaaacatcccttgacttaattacttgcgaactagaatctgatgcgtcatactacaaggtcccagacagtgaagcaacaaatccagacgtagcaggaggacaagaagcagccataacaactactgaaggatcagcatcagcagaagtgggaatggcaacaattgcctcgattatttggaacaatagagcgattttagaaggccgaattacatgtgggcttcgttgtgaggattctgagcacgcagaagcaattgggattttaagcggacttcaactagcaagaaaattgaagataaaaaagatagatgttgtaactgataatatggaaatctatgaggttctgattggcagaaaggatgtgtttcagcacaagcatcgtgatgttttgttgatggctattgaagtagctaaagaattcgatgtttgtaggtttaggtgggaacctcgagaattgctgtgccttgtgaatgaaatggcaaatgcaacaagagaagattaccgggcaaaaacattgagcttgagaagaatttgggagggcaaagtagcatattgtctgtggagtttaccggtcattcgtataaaccaatcaacaaagaagattgcactaaaactaggtatgtcaatgtactatatgcaatttatgttgtttgttgcagtttgcaatttatgtactgcaccatatgtactgtattttttcctgttgcactttgcaccagtggtggacccaggatttttatcctgggtgtgcccatgtcacgagcaaaatcaaagccttcacacataaataaggttttagtttatcaaaaagtttagcacaaatagttgttattttggtgttgaaccaacagtgcatccttagatggaactaaacaaaactggaacaacacaaattacaatttattcctattttcttccgatattattcttccctgttctgaatttcctcatcaccttcacagaagggaaaccctggacatagcattggtgatgtagaacgagtacagtatagaaagagttaatgcctatgctcctcttcatagttgactgattcaatttgacctaatcctacaaatcacggaacatgccttcactgatttggcatttcagttttcaattgaaaatatagccgtctagagaagcaggacgagaaattttgaaacttcagatatatatttttttcagtttttcaattaatctcttccactgccaaaggagaaagagcatacatgcacggctggaccttggtcgccacgggcagcctcctagtcctcgttgccttgctgattaccgtgcgatccaccagcgggaacgcatgcacacgccaccatacaatcttttggtgagctatgcgagaatcatggcattgggccttgatctgtctacttctcgatgaaacaagttacacatccattttttaggccaactaaagcatagttagatcctaaaattttttcgtaacttttgggtacccggcaccacctaggtctgcccctactttgcactaacactttgttttttttatatatgtagaaaaaggctgggctggggaggttaatatgaagttggttcaatcaaaagggtatcatgtgaacgttcgagaacaaatgcttaaaattgatgcattggagggattacttgacagtctggaccctccactgttaattgtattagtaggatcagaagaggctgcaagtaaagtctcacttgagctgaactggaggtttcgttccgttctgttgaggggatctggtcaagttagtggttccataagcaatgcaaatggtgactgcagtcctattccagagggtacagctcttgttctgaatagtgaaactaatatcccaccattttctgcacaaaaggtccttctagtagtttatgacacgccatcaagtgaactacagttcagtaaagatcaagataccacaggagttatcacagtcagaatcgtcgctcctcacgaggaagattctcttccagatacctcgactgaggtcaatcctttcgttttggggttctttaactcaggtacatattttcttcgcttgaatctgcattttggttctttactaaatgttatatttgtgtatcccacttgcaagttattcacttgaatctgcatttcggttgtctttactaaatgttatatttgtgtattccacttgcaagaaattaatacatgtaaaaccatgcagctaaaacaaaagcacacaggaaggaaaagacatcaaataaatcctttggagaaatttggtcaacgtgggaagatagaaaaggctgatgactctgttgtcttcaattcgatgccctttacatgctcttcaatatgcttgcttctttttggggggaattttaactatttgccacttttctgtttgctaattattcaaataccccttttaggtttgtactttaatctgtcattggagagagaagaattcttaattttatgctacttttgcttatgtggcgggacaaattagattggcagcttggatgtatggtgtgaaatgtctagacctcacccgtcatttatctatctctcttctctccggtccggtgtacggaccacgagcccacgaccgatccatggtggggcggtaggtcgttgtggcacatcctgacgcgatggccgctccatacttgtagcccaggattcaaacatacttgcagccaagaaatagtccgaatgaaatcaatcgcaaagagacaacaatagtacgtaatatcgaagggaacagccgatgaaaccatgatacaaacgagcatatcgttcagaaaagaagcgatatatgcaagaacatctcaaatcagagagcacgcacgcaatggatttgtacatggatagaagaagatcgatggatggatgtgttttaccggaggaaaggatattacggagcgatctgccagggatggagcggccgtccgtcgtgccgcatcggcgcatgcgctgctgcgccaggctgtgccatagcgccgcctgccccagcaggagtgcaggacgccaccgctcccccgcgcttggtccgccgcccgtacgctggagaaaataaggttggagggatggtgctgacactcacaggtgaggtctacgctggcaatctgatttgtctcgccacatatgcaaaagtggcatcgaattaataatccttctctctcctgtaacatattagtaagtgcaaacttaatatgggtatttggataattggcaaacgtaaaattgacaaatagttaaattctccacaaattttaggctgaaattctatttattatcctccatttattttcctcccaccttctcaaaaatatatttgttagaggcatatcacgagggccttcaatcggacctgacgaaaccaccgacaccataagacgtcggctgagtccaaggggtgcacctggggcgaagaccgaaggattcgccaccaaggtcaccatccggccaagtcgctacctcgactcagcaagcagcggcttcgaccacgctcaactctactcaagaaggcgttgacctcgaagcacaagccgaagcagaggtgggtgcgatgcgccaaaacatgaataagctgcaagacatgcttcgccaaatgcaagagcagcatcaagcgcacgaggcagctaggcaagtcaagtaagtttcggcagcccccccatccatcttcgatagcgatgatcgtcgcccaagctccagctacccaccaagctttcggccaagctgtccctcctcatgtggcgcaggcattgagcatgattaggcaggccaaccaagctccgacgtacgttgccaagaccgctccgaccgtcactgcacggccaacccctcacaccaccatggcgccagtacggccagcggcgatgcaagtacagccagcgaaactagtccaaatgccgcataccacgatggaaacaacttcggccctacaagcgcaacttcaagcttttcttcaacaactcaaccaaccccacaccattccaagaccagcccctttggcgcacgccatcgggagctcaagtctggcaaccatcaagtcagttcggcgccgtgcaccaggcgaaccaacaaggacaaggggcattgacctggcagcaggcgccgcacttcgaacagaatgccgcggtccaagcaccttcgactgaccttcaagggatgatcgccggtatcaacaccacgcaacaagcgaaccagccaaatcagggcgccatgacttgggcccacgtaccacagttcgacccaagcatggcggtccaagcggtttcatcagatctgcgtggaacgctgtccagaaccgggccccagccgaactcaatggcacatcatcacatgcaacagcgatggcttcgccattcgtggctccgtatcaaagcttgaactcacctttccagcaaggcatgatgacaagggctggggacgaaaagaagctgccactaagctgggggctcaagaatcatcccattcccccagttcaagtacccacccgttgcaagatactcaggcgaaacagatccaagcgagttcttgttgatctacaagtctgcaatcgaagcagctcatggcgacgaaaacaccaaggcgaaggtaatacatcttgcgcttgatggaatcgtccgctcttggtatttcaatttgacctctaatatcatttactcatggaagcaacttcgtgatattttcattcttaacttccgaggtatctatgaggagccgaagacccaacaagacctctttggcattcgccaaaagccaggcgaatcaacaagggagtacgtgcgacgtttttcgcaagcacgatgccaggtgcaagacatctcggaggcatccgtcatcaatgctgcttcggcaggcctcctcccaagcgaattgacaagaaaaatagcaagaaaggagccacaaactgtcgagcacctgtttcgcatcgttgatggctatgcgtggggcgaataagacacaaagcaaaggcttgaaattcaagctgactatgacaaggccgccactgccacggctgcgcaagcgacggcgcaagcagccagagccgtgcctatagcaaatcgctagttgcagctggtgaatcaagcgccgctcccaagacccagccaagatcccatgacttggaaaaagttcagaaccgaacgcggaaaggcagtgatggcggtcgaagaggttcaaactctccgaaaggagttcgacataaatacatgctgtcactatcaatggcccacctctactgtcccgtagcatatatgcccagataatgatacttaataatctagacaccacgtctacattattaaatattactctatatcctctggaatgacatggagcaaccgaataatcggacattaaacccataccattgcacctctctggtaagctagcttcacaactaatacgacacaaatataacataaagccgatacttagataaagtaaagtaccgagagtatataaagaagaatattctattaattccgaaaatcttacaaaagaggaaagtagaactactaaagccatacctgaactcctccgaagacttcgaggattccgagagctattctattctactccacttagcactagagcactaaactaaagtatggagagatcttgagcttgcttgagtgtgtgagggagtgaatgaggcctcctccttttataggcaggtaattacggttacttctatacaaattgtccaaactacctcgcaactgtcattgggaagcaatcaggatcgtccacgtgggacgccaagataagaggagctagtcagggttcgccgaacctaggctggcccaacaggcctccagcttcggtagggtcactgacaggtgggtccttatgacggttatggtagtttttgtggtttccaggacggttacacctgacatgtggacccatattatcctttagcttgattaggagtgagttttcctcattttttcgtttattttatttgctcaattctagcaacaaataatactacaagtacaagtggaaatatactattctaaaacaaatatgcattataagcataactagttcttctttattttagttatattgacgatcgaaattggtctataacgaccgtcaacaacctcctagcctctccttcggttgggaggctgcaccaacatcttgtacctttgttgggctcaatcctatgattttgattaacatctgggcccttcaatccatgtaaatgcgtcccaattttttgtaggtgtattttcgttgcatgacggatgcattgtctccttaattgacatgcatacatagatttactaaaactagtgaaaatggttagttgtaaatcccagtcactaagatttgatactatattttatatttcttatgtaggagttgatggttaaagtttgtacttaacgaccgtcaacaacacctccacacttatcttttactcgtccctgagtaaagctcatggatctactacagttatggctttctgtccaatgatatgatacacaaaatattccaagacatacctgtgtatttgaaccttgatgtgtctaccatgtcatcttgattgaagaatgaaacggtcatcgactcaagtcagctttactccttctgatgaattaccctggggttttctttggtgcttgtttaggatgaaaaataacgtccgagatctctctctatttagagagatatgtgtgtgtgggtgtgccaatgtacctaaatacaccataaacaacacatagggaacatgcactttattaatctcgaggatcataaatacaaaatctcatgtaatgatacacgctacatagtccgtcattggacatatccgaattgtgcgatgtggtcttcctggttcctagggcctcgataagctcccatttaattacctccgcaggcgaaggcctacagcaggacctcggattaagctgcttgtggtcatcttgtcgtcttcgtttcacaatctccatgcatgattttggtggtgtagatgtgggcgccggcaacgatccacaacctcgtcggtccgtgcaccggtgttggtgacatagccttcgcatcggcttcactcgccctcgtctagtctcgccggtcttgagcgatgtgttggtgtagattgcttgaataagacatacatggattcgcgtagcttggatggcttgacgtcatagaagttcactactacaaaacatcaaataggtgttggcactataggtgccggagtgctaaaaccggcaccaataggccttttcccacctctgtgggttgaaatcgcaaaaaagggcacctttaaccaattataggtgtcggttctaaataaaaacctacacctattctatatgagtcggttttttaaaaaaatcggaacctttactataaaaactggcaccaataataaattataggtgctgtttttttttctaaaaaaggcacctacgaattgagccgagccgattggccccaccacgacgcgtcgaggagataaggtctgctcgctcgttcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagtggcctggcggaggtggtggcggcccggtggtggcggcggcggccgttgacgtgccctcccctcctccagatccagtgggagggaaggcggcgacagctcagcgactcggcggatgcgcccttcctcggctagatctagagggaggcaacggccgtgaggcggcaacacatcctcgggcgacggcggcggtggtggttaaggcagcggggaagtgttctatgttgttaatgtgttcttagatgccttctgttttctgtgctgtgttcttgaaatggtcttgaagttcttgatgtggtcggttggattcgtgcttgggtcggcttaattcgagccgagccggaatttttttggggctcgttcatccttatagtgacnnnnnnnnnnnnnnnnnnnnatatttggtttagcatcagtgtcgcttcggtggtgccggttgggaaatccgacacctatgccaggttcccaaccggcaccaatatcctcttctgtagtagtggttgttggagatggtcagtgtagagatatcggacttcactcgcagttgaggacttagtacacatcctcatagccaagtgagtataggctgtatagcttaattagtactccctccgtcccataataaggaattttgagtttttgctttcactttttgactattcgtcttattcaaaaaattttggaattattatttaatttttttgtaacttctttattattcaaagtaatttaagcacaaccttttgttttttatatttgcacaaattttttaaataagatgagtggtcaaacagtacaagaaaaactcaaaattgacagagggagtaattaataagccatttggttggttttcttttcactgtagtactgtacagtagcatgcatgcacacgtaaaacactagcatatcaggtgacacacaatggcgtggcagcgacgacaatgatgaacacgtgaggaagggggcagcgctggcgaagagaccgcgacgagcgtgaaggcatcgcatgcattgcccggtggagtcttggtgagagcatcctcgcttagcaaggctgcacaacgacggcgccggcaacaggatccgaagatgtgtcatcatggcttgtgaacggtgcaacagcgatcatcatggcaacatccccgaagtttgcggtcagtgaagcgacggcttaattggaatggaagccatcttggatgggcacactactagaaaaatcctcacaaatcctacagggaccagctcataggtgccggttcatttaaaaccagcacctataaagctttccccacctccctatgatgaaaaattgtagaaccggcacctttaaacacgctagaaccggcacctataatatattataggtaccggttaattaaagaaccggcacctataatatattatatgtaccggttgtttttaaaaaccggcccctatagctttgagccgagccgtccagtcgagcctacccgcacacgcatctctccctcggtccttgtctacttcctcggtcccctcaatctctcgcatctctctccctcccctctctttctcacgtctctctccctccccagctcccctctctctctcggtggctgcccggcggaggcggcgggctcccgcagccggtggctgcctggcggaggcagcgagctcccctctctttctctgtctcagatctggccgggcgacagcggcagcggcggtggccgcgcccttccctccaccagatccggcaggaggggaggcggcgcacctcagtggagtggcggtggccatgccctcccctccgccagatctggcgggaggggaggcggcgcacctcggtgacggtagcggcggcggccgtcgacggcaggggtggagaaggacgccggtggtgcgggcgaggtggtgacccgcggcttgagttcttgagtgtatgagtttttctctttttgagttcttgagttctttctgtcttttctcctccttgatccatgccccaaatataatgtgaacttgttgattgatctattgaattcttttcggccggccataggtttgttgttgatttggccgagcagccgtggtgttctaggggatgatgtgatccaggaggcggtgatgaagggggagtagggctgggctcgaaggagacgacgggtgtgtggttggtgagttcggctcgatttgagtcggttctctttttttttttatgctcgagcaaagttaacggtgccggttgttagtattggtgtcgaccaataggtgccatttgggaaactggcacctatagccggttcccaaccgacacctatgataatttctgttctagtggcagcaccatgcatggtgacttaattggcagcgtccgcgtgtcattctccgacttctagatcagcatggcttggcggcgtccgcggtggctctggcgatcttcggcgcactccggcggagtggtgtcacgagggccttctccggtgggcagcagatggtgatttagtcaacgactcatcggagacaatgttagaaataatcttgtcattagtactatgcatgtttattttgttcattttcacgtatagaaagtggttttgcattgtagcagtgtttggcacactaaaaaagcattttcgtcgatgttgggtctttttttcacaggcgggtatgaccctcggaacccaatatccgcctacgaaaatatataccgaggtggattttcatcatccacctgcgaaaatcaatttttgcaggtggaccacttaagaggtccgcatgcgaaaataaattattttcacaggcggaccacttaagatccgcctgcaaaaatatgatttttacaggcagaaccttatgtggtacacctgcaaaaatcatgcctatataaaaaaaaaactagtcccctcttatcatcttctcttccatcttatcctctcccccaccactcattccttcctctctctgctccctcccctccccttccttccttcctaccagcggagggagtcggtgccgtcgcgggcggagggggctggcggaggcgccggcggagggcgtaggcagcggcgcgtgcggagggggccggcgaaggcgcgagcgcggagggtgtcggcgacggcgcctacgagcgacaacgacgactaccgcacaacgacgacgactaccgagcgacaacgacaactaccgccggccgcgtcgctacccctcccctcccagatccggcataggggatgggtgtcgagttgcatgcccaatagatggatactacatacccaatagtaatcgactaaattcggcgggacccaccacataccatgtcttatacggaaacaaacctcgtatataggagttccggataaggaaggatgagtagagttctatatgaaaacgacaaggactaatcggattgtatctatattggtctccctagttctacttggacaagggggcatctgtgggtataaatgcaagcccccctaggagagagggcacacgccacaaagtcacgagccaacacaaaccaatacaccgccagatatcaacatcagagattagcctagacaaacccaatccggtgcctatggtagccggtaagagggatctagcgctatctctgatctcgacgggttcatattcaaggaggaaaactaccccgtcatcgactacgagctggttatctagccgccaagtcaacgacagctagataggttatcccaaatattgtatgtgtgatctagataaataaagagaaacaccggtttaggccaacaagatgtagggttattatctgtcagataagaggcccgaacctgcataaaaatccttgtctccatctcttttacctcaatctcgcatataccctggtaccaatgatccccataccatccaaataccgtagtcgcgatctcaaacgtcgacagcagctgcacaaggtggatgggtcggtggcggcgcgggcggagggcgtcggccgtcggccgcgacgacgaagactaccgcaggacgacgacggccctaccgcgcgacgatgacgatgactagcgccagccacgtcgccagccctcctctcccagatccggccggaggggggagggaggcggcgacggccaccccatgcaacggaggagttcgctggcgacgacgacccggagacgacgacgtgtttttttaagtttacatgtacattgatgttaacttgatctgaatttgaatccaatgcttttgtgttgcaagtttacaatgtttgtgattggatttattttcttggatgagatttgtgaatatttatgatttgtgatttgaaaccctagggaggggtggggctggcgggaaattttcttggcgtcgagggtatttttccaagcgaggctactgtagcacttaaggcgcatgggaagattcgacatcgctcgggtgctttggtctgcctgtaaaaattgggaaattttaccgtcgtttggatacaggcggatggctttgccgcgtgcgaaaatgtgttctgacaacctggaaaaactttttttctagtagtggcaccagaagaagaagtacatagtggcaccagaagaagaagtacacagcaatatgtgtgatacgtacaagtacataggcttggccggagtgcagccggattgtacgaagcggccggagagtagcgacattatcttagacgtggaagttgcatgtaacaactagtgattagtgtggttgctttgagtagtggttagtcgtgtgtgatgcatggctagtagtagacctagtattaaggtgtgctcccgtgtatgcagagctagtggcattagagtaggaagagtttgttagcttgcttgcatgaaagtttatttagcattttacatggtcagctttgctagctcgtaggatcgtgtgcatgcatgatcagcttgggatcgtgtgagtgcgttgccgttgtatagtacgtacctacatcttggcttaagttaataagaaaagaggagaaaaaggacgtgagctagctgtgatagctgcgtagctaaaatctaaattcgtgtgttcttgctcattgtgtttgtgtgtgtgtgtccacaagagaaaaatcttgagtatttgtgataaacacctagagagtgagaggagagattcccaacagacaagcactggttggcagcgctttggcgactcaacgaaatggttgctggcacgtacggatggagtcgatgacgccgtacgtgcgggcgtgagtggtggtgctccgcccgatgttctcctcgagtggttcgacgatgagcgtgaagaaaatagcaaagccgatgagggcgagcggacgtcgatcggcggtgtcacgtagaggagggtactgcgaccggcaagagcgacatcacatcgccatgtagacgtcgtgaggtagaggttgcggccggcgaggcgagaacgtccagcacccgagccacgtcgcagcatacggcagatgccgtcaccaacgaccagcgtccccaaggacaattaaagcagtatcttgtgtcaactcggacgggcggcagatggttcggccgacgcaactgctacgtcgctactcgatcgctacgatatgatgacaacagcgcgcgcgtgcagacgttgcatgtatgtgctgcaaattaaatactctctccgttctagtttgactaagttaaattgttttaagtttaactaattttataaacaaatatagtaatattgtaatgttccagcaaatcaataattgaatatatttttataataaatttgtcttggattaaaaatgttactaattgtttctacaagtatggtcaaatttataaagtagtttgactttaaccagtattgtatcttacggagggagtagaagaagaaacgatctaattaattaccttgagcagccatcgtcctcctttctgtggtggctgatgatgatggtcgatcaggtgcgcgtcgtcctgccggacaccgcgacgccaatgcaaggcccggtgggcgtacgcgtgtgcactgtttcggcaaagtcgatggcgtcgtcggcgtgcgcagctcatgctccgacgctgctccgacgaagtcacgccggtggtgtgcgcatccggcgaggccgagtcagcgaggctcgtgtaaatgaattagaggtcgatgtgtgtaaagatgggataactgctggtggttttcgatctaatctgtatatatatgtgtgttaggaacgtgtgtgaagagaggagcagtgtatatatatgttgagatcagtgggatggcctcctttttataggtacaggagaagccctaacctacacagcgcattccccggcgccgcctgcacgcgtcacgcattggatcgctccgaagcctctgcgcgccatgttcagttttatctgaatcctccggatagactgaggctgtgtttagatcaagggtacgtgtttgtgtttagatcaagggtgttacatcgaatatacggatacacatttaatacggatacacatttaaagtattaaacatatagtaatctaataataagaacaaattatagaatccgcttgtaaaccgcaagacgaatttattaagcctaattaatccgtcatcagcaaacgtttactgcagcaccacattgtcaaatgagtaaagtccatcaccgggccctgaactagtaccgctgtgtcattcccgtccctaaactcgcaaatcaatcgt

SEQ ID NO: 8362 - DNA, 4237 bp, Oryza sativa
gacctaaacaagtgatctgcaagtttaggtactaggatgacatagtcgaacaagtttgaggatctgaacggtcgatttgcgagtttagggaccaggatgacacagcgatacaagtttagggaccggtgataaactttactcttgtcaaatcatgacgcaattaggcttaaaaggttcatctcgcaaattacccgcaaactgtgtaattagttttttttctatatttaatactccatatatgtgtccaaacatttaatgtaacagggtgtaaaattttgccagggatcaaatagcctttgtgtagtagtgtggttcgtgcatatatatatattgatcacacatatatagccgaatgcatatgagccacgtatggttaggccctatttagttcccacgcaaaaacttttcaccctgtcacatcgaatgtttggacacatgcatggaatattaaatatagaaaaaaaaactaattatacagattgcgtgtaaattgcgagacgaatcttttaagcctgattgctccatgatttggcaatgtggtgctacagtaaacatttgctaatgacggattaattaggcttaataaattcgtttcgcagtttacaggcgcgcggaatttataatttgttttgttttgagtctacgtttaatactttaaatgtgtgtccacatattcgatgtgacacgtcaaaaattttcatccctggaactaattaaacatggccttagccagatagatacatatacactagtacgtgcatattttgcatggcccatgcatcttatgcaaatcaacaaactagcttcttagctaagtagtaatcttgcttgcttggtgtaaaatgataaaataccatcaaattaaacaaatggcccacaccaaatgaagttccaagcacgaaatgatcaacgaaatcgacttggtcgcctcattaatattattagaagccttcgcactcgcgtcgtgctgggcgtggctgatgcgcgattagccgcgcggggctacgaccacgcggtcagttcacccaactgccaactctagtatctctcctctcctcttcatctgtatatagtatatatatctttatctattaaatgtttttatcgtacgtcgttcctgattgtgtctgtatccgtaatatggccaatgcacaaaaatatcatagatcgattcaaaatcctaatcgggcaaatatattcgtaaggcttccgtagaggattttcgtccgtcgcccagcgtgcacctcctctccaaatcccaaatcatcacaatccaacccaaaaacaaaattcaaattagaatcataacaaaatatcaactcaagggatgatgagaggagaggcaggagcgagcgggaggccattgctgctcctcgctggagctctacctcgccgcctcgctgtcattgaggtcccgacctcaggacagatcctgagccaccgcgctgccgctgcgtcagggagtagtgacccgccgcgtcgccagggagccgttgactcgccggatatggtgaggagcggggcggcggcggcaccttgacctgacgaggaggaatggggccgacggtgcgaggagggagagcgtcagtgagggagagggagcagcgagatgctggtgggggagcaactctccgtggccttggcgcaagcagcggcacctcgacgagctctgtgcgcgcacctggaactcatccgtgccgaagcaaccgtgccctcatccaccagctcacggcagctcccctgccacctcaagacccctctcccacactacctctagctgtggccgcagccgcctctgcaccccaccacggagaaagccctcctggttagcgctggcagcaaagtgaccgcggaggagtggccacggtggagcacatcctcgcctttcccggccatggtggctgctgtcattggcgagtctctcaagaggaggaggaggtgcgcactgtcgacaggtgatacccgtagactagatatagagggtattggggtacgttggtacaaggatctacgtagtacgacatcgagcaatcaaaagacaagaattatactggttcaggccccttgataggtaatagccctaatccagttgatatgggattatatggtggaaaacacaggttacaaaaggaatgatggaacttttcggatccagcgagatcgtagtcgagtggattcgactagctctcgatgacttggctcctcgcagactccggcttcgtaggctatgcgggttgtgttggctctgagattcgatgtcctatgccctccccggggggtcccttttatatcgcaagtctggagctctccgagcagaactcgaatatatcagacccaatacgatacgtagatgacccagttctgtcctagaaggactcttcctatctgtagatttcgtgaaaagtttccttagaacatgcaggaaatatccgcgtacgcgtgggtatgccatgtcgatacgtaacgtatatcgaagggtagagggtatgcctgactcgtaaccctgacagtagcccccgacttctgctcaaaatgaactcgtacgaccattcacgacttcgggtgtcaagaacgttgtcattccaggtgcgaggaccgtggagatgaagtatagtcgagcacaccgtttgaagcccaacggtcacgagtgaattttgaactgaagtccaaaaaactgccgcgcgtaacggacccagaaatttccggcggggatctctctctgttccttggaattcgcaccgtcggtagtgcgtctatttaaagggattttgggtgcgcattttgaagtccgcaaactccgtcaaacacacaccggctgttagcgctcctcgccttctccgctaccgcaaagaaccctagcttcgccaacttaggtccgttttccggcgatcttcaagcagcaatggatcttggcaagtcagcttccaccagcgcgaccttgaagaagcttcaggaggatggcgcccttcctggccgtgaaaacgcggagaggggagcaggaggtactaatcctcagcccatcttaggtcgcatggttacgattgaagattatgttctctgcggttttctccctccaccttccgaattccttctgctggttttgaattcctatggtctttctcttttgcatttgaaccccaattccatcactttccttagtgtctttgttcatctttgcgaggcctacattggggtagagccctttcttgatctcttccgtttctattatgagttgcgctggatggaacccaatagggtgtctggttgcgtcgggttccgacttcgtgatggcttgaagtcgcgttatgtccgcttctagtgtccctcttcccgcacaaatggcggaacatgtggttttatcttgaaatcaaggactcaaatccggtcctcgttgttcccgaggatcaaccggacaagattccggtctggaccgccaagccccccttgaccccctctcttcaatcgtttatcgacatcatcgatgatctccgagaacggagcttatcggggtatgaagtcgttgcagacttcgtcggtaggcgaatccagccgctccaggctcgggcccatctagcatataattattccgggcctaaagacgcgacccgagtttctcctcggggtatctttctcgcattcattttgacgtgcttgtactcatgttcctctcgacttacgaaaagttggttccctcttgacaggtctgagcagcgaagccgtggagcggcgcgtcgatcaagtgatgatcagcggtccgaccacggcgagcgacatccctgcgcccctttgtgaaaggggggcgacggaacgtgatgaagcgatcaatgtgagtttgctcgataagcgtcctgcattctctgttcgaaatcagcttatgacttgatttagcgtaggcccttcctttgactgatgtcgtcggaccgctcgcagatcatcaggtggcgacatctctaaaggagaaggtcgtcaaggaggcgtctgtcgctgcgaccaccactagtggtggcaaagttccgaccaaggcgaggaaattctcgtctgtgctcggacatcgtcgcaaggcattgactccctcggtaatttcatcttgtcgttagactatgtagcaaggaaggtttcttctcactccacattgattgtcttgcaggcttcagacgcgtctcctccacctccacgacgacagcgtattgtgacgaacagcgagaagtaagtaaataagttttcgggttctcgtgtt

SEQ ID NO: 8363 - DNA, 12997 bp, Oryza sativa
ggaacttccagcgtatctcctgccacggcatcgacagatgtcgtgcccatgggcgggagccgggaggcgatgcctagcggccccgtcagcgatcccgctgggggtcgtagtctgccagaggccgtcctcacctgggaggagctccaagtcgagatggggcgccttctcgaagctggtgctcgtggcatcggccgcgagatctcggaggcgaggtcggaaacggcggcggcgaacgcgcgtgccgagagattggttcgcgaactggctgaggcccgcgaggacctcacgaagatgagggagctggtggccggcaacgagcgtcaacgcaaggggctcgaggaccgaatgtcggaactcgggaacaatctcttcgagatccgtggctcgctgcgcgtcacctatactggcctccaccagctcgctgaggagtgcggcatcaagtccacaatctcggcgaaccccaacgagttctagttgacttcctctcttgcggaactggcgacggcgatgggggaaatcccctccaagcatgcggccaggatcgcggaggagacgtcgaacggcatctacaccggggcgtgtcacgtcctcgcgtgtgtaaggttgtcgcgtcctgaactcgatctgcacgagatcttggatcagggggcggcaagcgacacacgtaaggaggtgatggaagaagtcggtgacctgggggagtctgtcctccccctctttgaagagtaggatttcttgtatttgttgcatgatttgtaaatcttgaactctggctaccttcgtgtgtacaattaccatccttgttcaatgttgatctcgggagtttttttgtcgattgtagagatgctaatgacgaggatgtccagcagcgggggcagcctaagtcactggcgataattccagtactcgagtttgaaccacatgtctcacctgatgtcgaggatcaaactcttgatgcggagctcgagatggcaacgactacctcaagtgagtagcctttttacctctgtgttgtcttaggggtatccagcttgtcttagtggtcgtcacgtttagtagatctcgaggatgcccttgcaacccaagatcgtcgtatccaatactggaagacgaaatttgaagtggcggaactcgagagaaccatgctagtcgtgaagaaggagcaggccgtggaaacgctccgaggccgcgaggtgtggtttgcgtcgtacttaaaaagttgctgcacctcaatggccagagtatgcagggaacttcgagtagtccgcgccgatcctggggaatcggcggccgggtatatctggtggctcaacggggcttgtgcccaactcgatggcatcggcaagtgtatcgacgaggccttgaagcaagagtgtcatcgagtgagccgatacaccggaggacatgtgctggcttgcctacgagatcaccgcccgcgcctggacctcgaattcctccacgaaggttttgctcgttcccggaggactccggcggagatagaccatcttgcgaggtcgatgtcgccgttggctgagaaggtcttccagtctatggactggcattggccctcttggtagtactcgtgccctgtcataggtatcttaggaaaaatgtaatgtagtgggagatctatgtaaaaactgtaagaattattttgtgaataaagaaatattccttaaacaaatgtatcttactctggatgttgtgtgtaagagtgtgttctcagttaacgactttggccatttgagtcgtacactctccctagcctccagccttgtcatcggaggaattttctcgggtgataaggctcttggacccttgacctgccttggttgaataagctctgatcctagccaccagccgtgaggttggaaagttgatttccgatttcacggcttggttaatacgcacggcgagaactcttacacaaccagatcttacatggtcttttgtctctacaggatctgacaaggccttatcggctctgggcgtccccagccgaagatcccttaggttcctcggaggccttgttgagacggcgtaaagggacataaggacaggtttcaacgctaggtgtcatcagagtgagggatcatcgggcgaaaacaccttgattgtgatatggggcctagaaataggctttattgatactgtaagggtgcttacaggtacagcggtattgactcatacatagaatttacgtagttggtcaatgttccaagagtttgctagttcgcgaccgtcgccgtctgcgattttgaatgcgcttggccgcaagacttgtgtgatcgtgtaaggtccttcccattttggtgagagtttgtttcgccctgcttgggtttgaactcgtcggaggacatagtcgccgatcgaaagtatgcgtgcttggatgcgcgtctcatggtaacagcgaagggcttgttgatagctagctgcttgaacggcaactcgctcacgatgctcctcgagaaggtttacatcgatgtctcgctgttcctcctggttctcgtcggaatacttctgtactcgtgtactttgatgtcgtagctcgccggggagcatggccttagagccgtacaggaggaagaagggtgtttccttattggatgttgtcggtgtggtgcgtacggcccatagtactgatgggagttcttcaacccactttttgtcgtgtgacatgagtctgtcgtagacgcgggttttcatcccttgtagtactatgccgtttgccctttcgacttgtccgttgctttgagggtgagagaccgaggcgaaacatattttgactcccaaaccgatgcagtaatcttggaagtcagcgctgatgaattgagagccgttgtcggttatgatgcggtgcggtagtccgtatctgcagaatatccctctgatgaatttgatggcgttgttggccttgatttccccagtgggtactgcttcgatccatttggtgaatttgtcgatcgccacaagtaggaatctgtagccgccctgtcctcgtgggaatggcccaagtatatctagcccccagcacgagaacggccaagtcagagggatagtctagagcgcttgcgcgggtagctttgtgtgtttactgtggaattgacaggcttcacatcgctggaccatgtcgcatgcatcattaaggccggttggccagaaaaagccttgtcgaaaagctttgccgaccaatgtccgaccggcggcgtgtgacccacatatgccttcatgtatgtcgaggaggagttgtctgccgtcgtcggtagagacgcatttgagaagtaccccgtttggcgcttttttgtataaatcgttaccgaccatacagtagatctttgctttacaggttattttctcggcctctgtatcgtcctcgggcaactcctcgctgctgatgaatttgataaatgggatgcgccagtcgtttgtggtttcgatgtcagcaatagcgcgttctgcctcggtgacctccgagctgatgtcgggggtgttcgggccaacttcgccgctaacttcttttaccgatggttttgtcaggatgtcgagaaaggtgccgggctcgagcggttctcgtctggacgcgcgtcgtgctaggtcgtctggctcgacgttgtccttgcgatagacgtgtcggacctcgatcccatcgaacctcttctctagcttcctgacttctgcgagatatttggataactcggggttagagcatttgtagtctttgtgcacctggtttgcgactagctcggagtcccctttgacgattagtcgcttggccccaagtgcggctgtagctcgtatcccggcgagtagtccttcgtattctgcagtgttattggttgccctgaagttgaggtggattgcgtgcttgaattgatcgccgaagggagatgtcaagataaatcctgcccctgctccttggctgttgagtgcgccatcgaacgccattgtccatgtctcattgtcgccttggttgtctgatttgttatctggcatagtccaatcggcaacgaagtcggcgagtacctgggatttgatggctgttcgcggcacaaagtggacatcaaattggcttagctcgactacccatttcgcaatgcggccgacaacgtctttgtttctcacgacttcaccaagggggaaggaggagacaactgtgactctgtgggcttgaaagtagtggcgtagtttccttgatgtcatgatgactgtgtaaagcagtttttggatctgtgggtatcttgtctttgcgtcatggagagcttcgctgacgtaataaactggtcgctgtactttctctctcgacgacaatgacggtgctaacggaatatggcgtggcggcaatatagaggaataattcttcattaggttggggagcaacaagtacaggagggtttgataggtagcgcttgagtgcaataaatgcctcttcggcttcctgtgtccatacaaatttgtcttgtttcttcaacaaagcgaagaaaggttgtcctcgttctcccatcctagtgacgaatctgcttaatgctgccatgcatccggttagcttttgtacctccttgagtcttgtgggcgacttcatgttctcgattgctttgatcttctcgggatttgcctctattcctctgccagagacaaggaatccgagtagcttgcccgacggtacaccaaacgtgcacttctcaggattgagcatgaggcgatatcgtcggaggttgtcgaacgtttcccgcagatcgtcaatcaatgagtcgtttgtcttggttttgacaacgatgtcgtcaacgtaagcctcgacattgttgccaagctggttgctaagtgtgccctcgacattgttgaggtcggtgaagtcgacacacattctccattttccgttggccttccgcaccataactggattggctagccactctggatgaagtacttctctgatgaagccagctttgagaagtttgtcgagctcttctcgtatggcttgtttccggtctggtgcaaatctccgcggtctttgctttactggcttggcatcgggtcgcaccatgagtttgtgctcaatcacctccctagggacccccggcatgtcggacggctgccaagcgaacacgtcggcattatcgcggaggaaggtgatgagcgcgagttcctatttctcgtttagtgtcgccccgattttgacagtcttgttggggttagcactagagagtggaatgatcttgatggcgccgtccggctttggcgtcttatttggcttgctcactttcttgggtggctcagtcatggcgggtgggctgggcatttgctcgaccatgtcgaggctccgcttgtcgcactgcaccgccagctttgtattcccctgaatagtgattgttcccttcggtcccggcatcttgagcacttgatacgcgtagtgagatgcggccatgaacttcgcaagtgcagttctcccgatgatggcgttgtaagctgtatcgaattcagcaacatcgaaggtgatctgctctgttcggaagttgttggcttggccgaaagtcataggcaacgtaatcttgcccaaaggtctggacaatgattggggagtaattccatggacgggttgatcggttggtgtcaactcactttgcggaattcccattgcgtccagagtgctggcgaagagaagattgatcgagctgccaccgtcgatgagaactcgcgctaccttgatgttccgaatagtgggttcgaccacgatcggatatcgtcttgggataacggaggttttggggtggtcttcctctgagaactctattttctgctcagaccacttcatcttgggtgcagccccctgccacgttgaacagacttcacgttccactttcttgtattctcgcttggaggaatacgttgtggagccgccaaagatgtgtgagacgtggaggtcggagtctggatacgcagaatccgattcgtgaggaggcgtctcttcgttcttctcgacaacacgtactcgcttgcctttttcaaacgccatgtgcttctcgagtgactttttgaaaacaaggcaatcctccagagaatgtatgtccattttgtgtatggggcaccataatttctttgtgtcgctgccttgtgggtctgggcgcttgggagggttcgcgtattctactgcgaggacttccgcttgagctttccttttcccatttttgcgatttttcttcttgcttgactcagatgcatctgcggctggtttcttctctcccccggtcttcggcttgtcgttcttgcgtcttagcgcatcatccacatgggcgcatcgctcaacgatctcgaataacctccaagtagttgtgatgcgtcttgtcgccaactcctgggtagtgtagcgatctctgacaccggatttgaaggcgtgaattacagaagcgtcggtgatttcgggaattgtgtttctacactcgttgaagcgccgaacgtattccctcaatgattcccccgagttctgtgttaacgcgtgtaagtcatcttcgatcgcgtggcgcttgtatgttccttggaaattggtgacgaattgttgccacaggtctgcccccgaagagattgagtagggaggaagatgcatcagccatgaacgtgcagaaccctttaacgcggttggtaaatagttagctaacgcattgtcgtctgctccggcagcatagagcactgtcgagtagacttgaaggaattcttctgggtcggtgctcccatcatacttttcaatagctctgggtcggaatctctcaggccatcggacatcacgtagggaacgaccgaaagccctacacccagcgttggggacggtgggttgtcggcggtcgtgtgaccttcgtggatgtctgtctgacgatgaagaggatgcggatcatgacgatgacgatgggtcgcttggttccggcgtacgattacgaggatgacgacctggatctcgggaatcctgtcgttgtctcccgctgttgtctcggcgccgatctccgtcgtcgtcgttgttgcggcgacggccatgaccagtattgtctggcccccgtcgttcgcgatcgttgtagtctcggtcctcgtttgggcggtttcctcgatcatggcgccgtgaagagacatgacgccgagaacgatttgcgtcgtctcgtgtgcgtcgtgcttctcggcgaccgttgatttggtctcgaagatcgccagtgccacgaggtggaggggtagcctatcgaggtaattccctccgctccggatcttcaccattggcgtcgtcaattggtggctaatcttggtgtgctgcggtagcggcttcttcaaacgcgttgctgaggttggtcaccgattcccgtagtcgttctgtccaacgctcgaggtcgtcgttcagaacgggattgtaaggagtttcccttagtataacttgaacagccctgatgtgctgggctagagtagtcgattgattcgccgcttctgcgttggcttgcgctgacgtgccaacatcatcgatagccaatacctcccgtggcgcacttgttgtcgatgacccatagtcttcgaggagatgcaagaccgatggttcgtgaggatcgatatcgattaccccaacaaatcgatctgaggctggagccgctccttgttccttgccgttatccctgacaaggacgtatgacttaggagacgaagttttcatggcgccgaggaggactttgcaactcaagaggtcgtgattctttgtcttgtgaataggacaatagacatctcgagttagagaagtacgctgaattccacgttctttgcaggcgcgaatttcaacgtggacgttgagaaaaacccagcaatcttgaagggtgtgtttcttggttttgtggataggacaccaagacctggtggcttcggaagtcatctttgtcggcccgtgatttatgtcggaaggacaaggtttggccgtatcagaatccttcccgagcttggatgtagtcggtaatccgttctccgtttcgacgggtggatttttcgacatggagtcgccttggttcgtagccactgcgttctcgtttccagtcattggaggaccggttgagatcggcatcgtggtgtaaaccgggaagatgatttcgccgacttgagtccataccagcattgttgaagcagggagtgcttggctgaagctggtgttgacgttgttgtcgatgaagctggatgacatagtagtagaaccttgagtaccaagttcccctacctggcgcgccactgtcgacgggtgatacccatagaccggatatagagggtattggggtacgttggtacaaggatctacgtagtacgacatcgagcaatcaaaagacaagaattatactggtttaggccccttgataggtaatagccctaatccagttgatgtgggattatatggtgaaaaacacaggttacaaaaggaacgatggaacttgtcggatccggcgagatcgtagtcgagtggattcgactagctctcgatgacttggctcctcgcagactccggcttcataggctgtgcgggttgttttggctctgagattcgatgttctatgccctccccggggggtcccttttatatcgcaagtctggagctctccgagtagaactcgaatatatcagacccaatacaatacgtagatgacctagttctgtccgagaaggactcttcccatctgtagatttcgtgaaaagtttccttagaacatacaggaaatatccgcgtacgcgtgggtatgccatgtcgatacgtaacgtatatcgaagggtagagggtatgcctgacccgtaaccctgacatgcacggacagagaggtggaggaggatggacgtagcggggagggggagggatcgaccgtcgaatgtcgttgggagggaagagccggatcgagaagggggagggagatgtgagaaaaagagagaacgacggaggaaacaagaataggaaagaaagaaagaacgatctaatccatttggttgaccttatccggactgggttttttactatgaaaaaaccgacaggtcttttttaaagaaaaacatgaaaatcgaataagtcaaacaaccggtgaggccataaattttgcaaaagcaccagtcatctttaaaattttagagcacagtctaatttttgtgatttcttctcctctgtatagtatatccaaagaactgaagggaccaaaataaaaaaaaacaacaagcttgatctaaatgagcttaccttaccctgattattgtaaagtatcaatacttttttgctaaaatacggacaatccgtccgggcgacgtggatgcaccatgagcgaatacttatttaaatttagccgataggtacgtctatatttatatctttatatctatatctatacctatatacctaactaaaaaatacgtaaggatgccgggaatattttcatccgtcatcatcatcatccgcatgtataggtgatttttatttacaagaaacagactctaagactggaactctaaagcttgctatagggcttaattctgaggtcgatagaatgtggtttttctctaattcttgggaaaacggaaatagaaagagataaggataaaaacccctcaattaattttagattatctccatagatgcggacagattttatggaggaggcggtttcccatggtgttgggaagttgtgggactcgatggaggtagggaatgacagtgtaacacttggacccacgcgacagtgagatgaggagcagggggacactgattagactgtggttgcaccaaccggatgtgcgcttgcaggccaaggtggaagggaccttaatgggccagctcggctgtggtctaaagaaaaaaatgggcttaaaatggcccatggagaaagtagggttttatttagattttcatttaaataaatgttgaaatgatgtttgtattattaaaactaggaaggtggcgcgtcgcgcgggcatttattttgttgaaagataagattatagtttattttgttgaaattttataggatttggcaactttgagagagttttgaggaagtttaattggcatatgtcgtatgatttgtttgagacacttatataaggataatattaaccacgttttctccctaaattcttttcgtcagctttgcttttataactttgtaacctagtagttagctttatactatatcgtagctaagtaatacatagaagctattatttatacttgtattcatcaactataaagaatggtaggcttattttctttaataaaacatgtctactaaattaagtgttaaagtaaaattaggactttttaattggatataggttattgttttctattaatggatgaattgtgtaatccactaaatgcattggtttatataatcttatatgattggtgcagttcgagatgcggcacaggaatccaagaattgagaattttttacggtggattaattttttttggattgtaatatttgtacgttaaaattcagcagctatcagtgagatggagtaacctgtcagttttgtatttttttcagaactgatgaattaaacattggtgctaattacatctaaattgtaaaaagtacgtttagttataataagaatgattaaaagaagcaatattaaacacttacctgataattgctgatcttcgttctttctacctcataatgttttcctatctgtaaactcaaagtagtagtccgagaaacatttttttttgctttgacctatttcattattgtatcgtgataaaaaaaagattgagactatttttcagtacacagtacttatcatgttccataacttcgaaatttttaaaaatgtataatgagtttatgttaatttttggcctaaagtggtttgccaattgctttaggattaaggcatgtattgagttatcatgaagaaaatagtatttacatagtagaacaatatattaaatgatatgttcgcaacaatcatacctctgcattagtagaatcatacgcgtataccatagaactcatcagccgattaaccgcatcccattgcctaatcactcttactttaattgtccacctatcatttttcttgttaacgcagtaattaaattgcaaggcgccatgttatctgcaaatgcgtatatgcaatataatgtatacatttatgttatttaatagatgcaatatagtgtagccctaattaattaatgaaggatagcattattgtgttgttctgtaggtgcacgattaccttcttttgccaaagacgatgaccagcctgaattgactaatgtcacaaaggtgtcgcacacctcttatgccaagatgagtcgccgagccgtgcatcgtggagattaaaataccatctggtcatggtgttcctgaaggagataaataatctgagattctcttgtacttaggagtaactaatcttgcctgcctcatcgatttaaaatttgctaatctgctgaccggtgtatatatgtatatgtagagaaaatctgagattacgttgatgtagggtaactaatcttgcccgctttattgattcaaagtaggaaactaatcttgagacaaatacgctccatgttatgatcacggcaaatacatgtactacacgtgtgggtcctcgactcctatgcgtaggttctcattgtgccatgtggcatgttgagagcgttttgaggaaaccacgtggcagttcgagagcatttgtagaaagttttatgggcttttagtatataatagataatagattagcaatggagctctaataattccaaaacaatttcacatagtgtaattaatcatggagaatttaataaaaattaaatccagccatattttatttgggaaatttctcatgttttcttcccgttgcaacgcacgggcattttttttttctagtaagtatgtatatatgtatgtatgtatatgtgtgtgtatatatatatatatatatatatatatatatatatatatacacacatacaccaaatctattctacgtccctcccttagaataactattctatacccccctcccatgggccaatcccacctcccacactcttcctagggcccaaatcccccctcccacctcagtcaaaggctggtcaaagcccctcccgctggtcaaacccgcccattgactccctccctcgcccaccactttattgtcctcgtctcacaggaattccgcagtaacagaacagtcatcgtgcagtaacaggacaactttctcgcagtaacgacatcaaaaaatagtcatgatggatctagttttgttaagcactttttacgaatattatggtgtagatggattagaaaaataatatataacgtgagagatattgctctctaaagattgagatttactatgcattactactatagtaccactgttactatgcatgttctctgttactgcaaattccaccatgctctctaaaaaaacattactactgtagtaccactgttactatgcatgttctctgttactgcaaattccaccatgctctctaaagaaacattactactgtagtaccactgttactatgcatgttctctgttactgcaaattccgcaatgttgttactgccaaaagtgcagtaacaacctataaattttgcagtaatcatgttactccccttttatgataatgttactgccgaatcataataacgaggtatggttcttgtagtaacataactgatttgttctcacacaatttgaacatacaaagcatgcaaacaatattttctattcacataatgtcacatgatgaattggttaggagagcttgccatgaactatgagatcatgggttcaactcttgatttcaccaatttatttttaatttttataaaaaaataaaatgataggagagagagagatgagagggatagaacaaatgaagaaaaagaaaaaaaaatgtataggaggtgggcaccgggagtagagagatcgggaggggaaggcgtaaaaaaacaaaaaaaaacaagaagggagagagagattgg

SEQ ID NO: 8364 - DNA, 35067 bp, Oryza sativa
  unsure (1)..(35067): unsure at all n locations
cccccccccccgcgcgcacccccatatatatagagagagagagagagattactgtgctttaataaggcaaaacagagaacaaatttccaaaggggaggggagaaaaaaatacaacaaaggggaatttacaagggggttaaaataaactgtgtatccatgattgccaaattggtttatctgcttcttttactctatgcaaatgcaaagtaaattcatacttgaagtgtgatttccatttaccaaaatgcacttacacatcgttaaagatgagatcatttcttatgctctataaagaaagggtgggagaagctactttttgctgtagatatcatattcatgaagttcaaacttatgttccagtttatgacaacgaagtgccagcactgttgagcacaggggcaagtgaaaaagggatgcaaagaatcatctgtggttaatgtgttgcatgtaacacatctgattcccccttgggtgttgaagtgttctcttggtagcagatcctttgtgtttaacctatccattaataataaccaaacaaaactttcaatttgagtgtgcatctgcttttccagataagggtgatgggaacttctggttgaatatgagcgaagaacagatcataaactctttttgattgatattgatttgaattccaatgatatgtccactgatccaagagattaccgaaattcaattcatgtaaagtattgctcaggtgctgccattgttgaactgcttgagtagtttttttttttttttggggggggggggggttgaaaagcttactccagattaaccagttctttgaaaccctcgaaagaaatatcttcattctttgcaagtgagaacagaatgatcaattcttcttgcaagattctgccattccagttgtcttttcagaatagagctgtctccaatggccaatagcaacagatgtaatggctctgaaaattggtatattagcctaaacacatccttccaccagaaaaaaccctttcctatgtgtgcatggggtggcatgttggagtgtgaataatatttgttccagattaggtctaccctgggcaactccattttgttgaaatattttgtagttccagatttatgacttctagtccccttttttttctttggttgacaaactagatcccaagctgctaatgaatgcaccttagcattagggtcatttgatttcttccaaagataatgccttctagttcgatcaatatgctgaattaccttttttgataatttgagagtgcacatgtagtaagttggaagagaggagagagaactttgtatacgtatgaatacaaagtttgtatacatatgtatataaagtttatatatatatgtatacatagtttgtatacatgcctaatagaagaaccgaaaataaaaaccaggaaaaaaagaaaaaaaaagaaaaaacgaaaaaaccggaaaaaaacaaaaactgttcgcgtattagcttttccggtgccgccgtgcgccgcaattccgcaaacacttgcaccgtcgtttatccctctctctcaaacaccccttaagaaaacaaactcatcattagggtgtctatattctcgctctcacggatcattggactgtgggatatatatggtcctctcaccagctgccacatgcaagcaagttcttcaggtcgtactctctctcctcatcaatccaatctcattaactcatcacaagcatgcatatttgtttttagagtaaatatcagaaaactataactttagtgacaaaactatcagtttgctgcaacattagcggcatgtttcagtttactgcaacaaaagcgtgggaaattatcacaaaactataacgtttacgttatatactgctacaattgtcacctatatgtattgttgcagcatctctactctctactacttaaaaaattcatagtggtgatggtgaagccaacgtagacacgcgatccaatatacaaacgtacttcgacacgttcagagcaaaaaaaaaacggggcacgctccttctccgcaccaccgtggcgcaattcctacggatcgcattccgcaataagcgccaccccaatccaaaacctcgccccccttcaccccacacccgcgttgttccacgcctccaccaccggtgcccccatcgccggcatcacctcgcgccgcgccccatccttatcgtcatgacacgccttcaccgccggcgcttccatcgccgttgtctccttcccgtcacaccctcctcgccgcgacatgtctccaccaccggcgcccccatcgtcgtcgtctcctccccgactcccggtctccaactctccatcacgtcggcgcgccctcgactgatccccgccgccggaatccctgcctcggcacgcaatcgaccgatccccgcggcgccctcaaccgattcccgccgccggaagccctcccatcgcgcctcacggtctccatcacgccggctcgccctcgacagatcctagccgccgcccgctgcccctccccggaattgaatggcacagaacaaaaacacgagccctctgcggcgatggattgggagcaggtagtgccgtagtggcaaggctggcggcgttggtgcccggcgacagccacggtagacggaacgctacttgatctgacaagagtggcgtgaccaggccatcgccgccgcttatgcatgccaccccgcctcctgtcacccctactgtgaacctgcgatcaagcctccgccggcgggcacccaaggctgtcgcctacagtgcgacttcgccatccctgcctgcgcatgccctaagccgctgcttacagcgcgacttcactgccgccgcctgcacgagccccgccgacgcccgacctgcaatacaacctccgttcccaaggccaggagcagggggcagcaccgaaggtagacggcaccatcaggtacattgctttgtgcccatgctcctggacgatccttttctttaggcaataatttctgatcatcctgttgcagctaccctgttagaggctagagtattctgtgccaacgtcctgtcatccttcttgcgtgcccttgacaagcagggcagaagattcaacatctgaaccccaaaaggagtccacggtttgtgtgtcttatcacgaaattcttgatgcttatttctgagagattgaaggactagggtttaattcggttcattgatgtgttctctgtgcacaaattatctatgaccttcatgtgtttgatgaaatgcttgaccatatacagtttctgttcatgatgccaacgccgcctcccatccctgccatatgagatcaatctacctgcaagctatttctttccttttaggaagaagtaatgtggctactctctcggctctcggagatcttctgcctagcaacatatgcgttgaaaaaaggatggtgatcaggaaagaggcatttttttctaactgaaagcgcttcgcttcgaccaatattgttactaaacatggtaggatgattcttgtttttggttatgttagtttatataatatggttttcagtatatatgtctatattcccttttggatgaaaacgattttaatgaaatctatcatggaattatattctcatttgtgaattgtgatatgaaccaaatgtagctatggatcacattggcatcctaggtctcctgattatgggcaacaaggaaattgtgggcaataagtttactatcctgattacaacaggatttgcattgtgattgcactaaaaaacaataataaattatcgtgttgaaatgcacaggtaccctgaaataattttaggcaggcaaggtaccagggtaatgtctggccatgctacaaaagcaaacagtcaagtctgatatgtatggtctatcatgaaatggatgccactgtcttaactaagattttagtaatacttattgcatcaaagctcagttataggcatccaaactgtagcttttctcttgcagctgctatttaaaaattttcttttacatttagctacagctaattattttttttcctttcctggcaagcagctagagttcaagctccaggagaaggtcacatttaggcaagttctacagtctttcaggtaattgatcatttgatttccttgcatatgagactatacaaatttattgtgtgtttgactgtatgtggtgccactaccataggggacggtagtgacatggtgatatatttatcaattctataacagaactgttgcatggtgttatatttacaattgctataacttttgtccatctgtattttaagagctatttcaatcaagtacaatgtagttttgaccatttaactgatttatgaactgtgggaatcgaaggttcagagaatataatatttatttgcttgaggctttcatgtatgcatctccaactgacaacatgtgatgtgggatatgatattgtgccttactttcaatttacaatacaagtaaatactttatccattcaaatgcagcttgaatatatcaatagtttttttcagcatgcatatatatatatttccattgcatttttgtgtaattgaattgtatacaaagaaaatgtttgttgttcagtatgagttaacctttttaatatgataggttgtgtgcaatggtcaatgatgtgcaaattgcaatgctgcagaatgagagctgagccacacagtccatgtgccatgcttttcttatccactttgtaagcatgtgctcctttaaaaaaaattatatgattcagcttgattaacatttaatttgttatttacctaaaaattaattcattctaatatgatatttttgcagagtttcatgcaaccatgctgtttccaacccctgctgaaatgctgaacataaggatgaataatctaattttatgaggaaaaacatctctggaagtgcctgctttggttagtcatagttactcttactccatgggtattttcaattttttggagaaatgatatataggaaatgaaggaaaccagaaataatcttattattaaccttcattcgattgcagatacctgatacaagatgtactagggagttacagaacaggtaggaattgtaagaatgtcatgtgcatactagggagttactgttgcaaaattaattgaggttaactattgacttattatcaagcatacatgcattaaaaacataatcaagcatatatgcattaaaaacatattatctttctcttccatggaccatggtgtatggtactatggttccaaggtttaacaggttaccaatatgtgttctttgccactgctggatatcaggatcaaattaagtaggtatttattctactatatggtggtggagggtaattcttctaggtcaacgggtacttttctcattttctgaaaacaacacgatgatcatatttagtgataagagtattatgatttgacacattgatgctacattcttattctttctttgtgcaaacctggctcaaaagaacatattttagatgagtaggaagcttgtgttcttcgatggtctgaaaggttagcggctacaaatggcttgattaagttttttaatcccctcttgcttaattgtattctttacttagaaactttaactcaattgactcaagcaatggatgtacttttcttcagtttacctcaatcaatttatgttagcgtgccttgtacgtgcacgcttttaatcaataaattttcgctgacttgaagaactctgtagagcagcgagcagcagaggtaggatgttttgatagcaggtgctcaactaaaacccgaattgaatccatcttttggctttaaactgatgttcagatctggcattttggtgcacaacatgtagttggggattttttgacatttcttaagtgttttttcattgaacttgatcaaccaaagaaactgtattacatcaatattcatgacctgttagtctgaagctaaagcagaatcagattcagcaaatgcggatgtacaactatccaataagattgatcgagcataatcttgcaagattatgagataatgcatgtacaactaaataaagatacaggcttttctatactgaactggattttatggatcatcacccatggtcctctgtactcaaatcctttttttcttttttttaatggcatacaccccatggtaaatgaaaattgtattttctttctttctttttacctaaattcatacaatctggataatatattttatatgatcccttcttatacctgtggcttagctatttgtatttgtaaaccaacgatatacaatagaaataagccggtgcgatttgatgttaacgtattaattttttttccattttcaacgcacgggcacccaactagtataacgtaaaagttgcagttttgtgataatttttcacgctattgttgcagtaaactaaaacatatcgctaatgttgtagcaaactaatagttttgttactaaagttgcagttttctgaaatttactcttgtttttaagcactcaggcagtacagcataattgttgctatgctgtgcgtgcgccgatctggccacattcatcttgcttgaatcactaatctaatcatcgtagtttgtttttggtgttccagctttccagctttcttttctctctttttttactattaccaagaaagagggaagggctcaaggatgttctgagcgggctgctcagagcaacagcaggtggcaggcaaccagtgcatcgcaggagataggcgcacagtgttagaaagagtttgttacatgtgataatgcgcatgagataataagatagaattagagatagatttctgtttttgagtcttatctcctcctttgtatgcgccactttgggagcttttcccaaacatatattaacacgtacagcgacctctaacgaggtgagaacacttctgccaattcacatatatatggtatcacagccaaacacccacgcataagatcacatctaccacaatggcgagttcctccaattccaccaccaatccgctctctggccaagctgttctggagaagctcacaaggaataatttcatgctatggaaaacacagatccttcctatgatccgtggtgcccgcatgcatggaggggtacctcaccggtgcgaaacgcgcaccgtcaacggaagtcgacgtcaaggagggcgacaaagtcgtcacaaagatcaaccctgcctacgaggagtgggttgttgccaatcaacagatgcttgggttcctccttgcatctgtatcgaaggatatcctcactcaggtcgtcaatctggagacggtggcggagacatggagtgcaatcatgacaatgctctcctcacaatcccgtgcgcgtgcgttgaacacacgtcttgcgctgtccatgacccacaaggacaatctaagtgtaacggagtacattggcaagatgaagacgctggctgacaagatgtcatctgccgacaaacctctcgacgatgaggagatgatgtcttacatcctcactgggctggacaatgattacgagcccgtcgtctcttcccttgtcggcaaggcggaggcaattccagttgttgagatctatactcagcttcccagttttgagagccgagccaagctacgacaacaggcgaacggatcctccgtcaacagcgcaaggcatggaggtaagggagacggcttcaccgacaacagccccttcggcaacaccaactccttccgcgctcgtggcaacagcggaggctatggtgatcgcggtggccgggggagaggaaacggaggcgcgcacttctccaacaaaccatgcccgacttgttagctgcgcagcaagattggacacgttgtagcagactgttggtataggtatgatgaaaatttcattccaaattcaaaaacagcagctgcggcttcctatggtgtcgatgcaaattggtatatggacaccggagctaccgatcacatcacgggagagttggacaagctgacgacgcatgagaagtacaacggcaaagaacaaattcatacggcaagctatgcaggtatggacattaagcatgttggtcactctattattcatacccctatgtgtaatattcaattgagaaatatcctccatgttcctaaagctaaaatgaaccatgtctctgctcattgcttagccgttgataaccatgcctttgttgaagttcactctcattctattgctattaaggatcaggtcacgaagaatcttcttcttagagggccatgccgcaatggactgtacctgttgccaacatcttcattctctacatccaagcaagttcttggagccatcaagcccacaatttcaaggtggcataatcgcttgggtcacccatctttagctattgttcaaaaggttgttagtaataataatctcccatgtttaggagatgttaatgagtcaggagtatgtaatgtctgtcaacaggccaagagtcatccgaccctatccaaagtcatctatcctttagagctttgtgttttcagatgtgtggggacttgctcctaagtctgttgggggcagaaaatattatgtcagtttcatagatgatttcagcaaatttacttgggtttatttacttaagaataagtctgaagtctttcttaagttccaagagatgttccaacaatgggttgagtgcctttttaatcgtaagattatttctatgcaaactgacaagggaggagagtatgaaaaattgcattccttcttcacaaagattggcatctctcatcatgtttcatgttcctatgcacatcaacagaatggttttccagaacacaaacatagacacattatagaggttgggttaattagctctccttgctcatgcctctatgcctcttaaattttgggatgaggctttcttagctgccgcttatctcataaaccgcatacccaacaacgtcattcagtatactactcctctagaacgtctccttgatcaaaagcctaattattcagctttaagaacctttggttgtgcttgccggcccaatctccgtccctataataagcataagcttcaattttgctcaaagcaatgtgctttcctcgggtatagcaatattcacaaaggtttcaaatgtcttgatatatcaactggcaaggtctatatttctagagatgttgtctttgatgacctttgcaaagttgcatgaaaatgttggagcaaggttgagatctgaaatccttttgcttcctccttccttatatccaaatgttgcaattaatggggttgaatataacgatcactggcttaatgctcctgatcattctaatgggtcttctgagcatatgacagatcaacaggaacaatccaaagaaggtgctgaaaatactggatagaataaccaagttactgcagaaaatcttgaagaagatgcagcagatccagatttcacagaagatcccggagacaacatctctgatggctcaaatcccgagggtgatacccctgcctcacttgcgcactcgcctgcgctctcattcaacaatgacgaggatgtcaatggttcgcttactcaacagcagggggatcaatcgtcggctatcacgtccccaattcctagcaatcatggcgatggcagtgaaggatcctttgtgcctacttcggatccgactgtggctcagcctacatggccaactactcatctccattgaggtataagaaaacaaaaggtatactctgaggaaacttttaaggtatggtctgttgacaactacaggagaaccccaaaatctagatgaagctttgtctaacaaaagttggaaaaatgctatggatgctgagtttactgcattgttggaaaataaaacttggcatttagtcccacctagtcatggcaagaatgttatagattgcaagtgggtatacaaaattaaaagaaaatcaaatggtagtttggacagatataaagctcgtctagtagcaaaggggtttaaacagaggtatgtgattgactatgaggacacttttagcctagtagttaaagcaactactatcagatctgttttgtctattgttgttttctaggggatggtgtcttcgtcagcttgatgtgcaaaatgccttcttcatggatatcttgaagaggaggtgtatatgaaacaaccccctggttatgaaaataagagtaagcctcgttatatttgcaaactagacaaagctctttatgggttaaagcaagctcctcgagcttggtactcaagactgagtactaagttagttaatcttggttgtcaagcatctaaagctgatatgccactgttcttttataacaaaggaagtgttacaatatttgttcttatctatgttgatgatataattgtagcagtgactgcattgctggcagacttgaggcaagaatttgcactcaaggacttgggagatcttcattattttctgggtatagaggtcagtacaacaggtgatggtatggtgatgttgtaccaacataccccaaaatcatcaagatacggtctatgggtatcacctgccgacgaatttataaaaaacaatgtcatagcacttggccgactgcattgtaaaatttgcgctaaacaatgcttaacttaaaatcgcattgtaccaactctcgtaaataaaaggttgtgtaacaacagaaaaggaggattttaaaggtattgggccctgtccatgagcatattgtgaaagcaaatatgcttaagtccctaaagacacatggcatgtcgcacccgaatataggctgcgaacgctaatggacttcgggctgtgaacgctaatgagcatcggttcaaaactcactgataccttttaaaaaaataacgtgagatagtgtatcgtcttctccgccgcttcatcttcctcgaaaattccttttcgtgcacctgttcatcagtcgccgccaccgaagctagggttcgccctccacacttgttcagccaccaaatcgcttccaaatctcatcacacacaagtgccttccatccccttccattttccatcctcaataccccataagaaaacttaatcagagctttccccatctgtaactccccgattttcgttcgggaataaaaatcaatcaacaaatcatttctagaaattatattaaaatttaaagcaatttcaccaagtgaaattataaagggaattaaaaatttattttaaaaatcatggccaggatattttgtaatattctttgtgccctaatgacctctctgaatttttccgtgaattttcggagctcaagtaatatttttaaagtcacaaagttcattaactcaattaaaataaaaagaaaaccaaataaaaactctccctcccctccctttttgggctcggcccagttttccctcccatcgggccgggcctcccttctctctctcccttagcccgctagcgaagtctgctttgcccctcctctccccgagccgccgataggtgggccccacctgtcgggctctccttcaacctccagcccgagctagcaaccgccatggccgcccgagcagcccacgtcgccgccgcctccggcatcacgcgccctctcccgtgtggcccggacaatgccgcgccctcccctccacctcacagcccacgtcgcgtaccccgctccgtgaaaaccgccaccgccaacctccccacgatgccacccacgtcgctagccgttgtcgtccaaattcgccctggctcggctccctctcgccccctggagctataaaaacattccccacacctccctctctctttttccccaatttccccaagctgttgcgccctctagccgctcccttgccgcgagcctgagctccgccgcccgtcggcgtcctccaaccacgtgccgccgccgcccctgtcctcgccacactgcgtcgtcgccaccaccggcttggccgtgcctcgccgcaccccgggctccgctcctttcccccgtccattgtcggagcaccactaccaccaccacacctgagccgcctcaccttcaccgcctccagccgcacctcgtcaccgtcctagccgtcggcacgccacgcgacaacctccaccggcttccccgctgcaagggaaagccaggccgccgcctcatttctcccattcgtcaccggaaccacctccccaccgcaaacccgaggtcgccgccctttttgccgcctccggccgcggtttggcgctactcccgatcacctctcgccacacaaccgcctctcacagtgtcgccgcgtcctgttgtaccccggttgccgctccaagccattggaaacccgccggagctccattcccctcacgcgccggtgagttccatcgcctctcccctccccggctagcgattcccgccgcctcaagccatatctccccctcctaacccctcctccacttttggcaagtctcgagcgagcccggccacccctccgcgttcgccggtcatcgccggagctccgccgcgccgtcccgtggtcccgcggacgccgccgccccccgaccgctcgccgtcgtgccctcttggctgccgcccctcgttgaccaccccatcctctccctctatctccccttcgctggctgcccagtatcgcgccgccatcgctggtggttgtccggccgggccgtcgttatcgctcccgccgcgcatagctccctcgccgccaccggctggctgcttccccttggtctcggccatggccgatctgggccgtcggatcggcctcagcctccatccgggccatccgcgtggcatcccatcttggccttgcgtcggtgcccgcgcggcgccacgtgggcgccacctccgcccgttgtctgccgtggccgccacgtggctgccgcgtgctcgcgagcagcgtgcttgtggactcggtccaccatgcacccgtctcccttgagtcaccgacaggtggcgcccgcttgccgacgccacctatccctcggatgacatcacaattcatttaaaattgtgcaataattcgagtaataattatagaaattcatttaaatggctcaaaacttctaaaacataactaattcatacgaaatccaaattgggccattcaacttgcaaaattcatccaaaattgagatctacatgtttgtttacttttcatgtactgtttacttggtttttattagtgttttttctcgttttgcatgccagcgtgtagatctcactatttcggaagatcgcgttcgcgaggatcagtgttcggaagattattttgaagaagcaaggaaagtcacacattacccttgagaattttgagcctactttacaaatgttttaccatttacaaataaatatgcatgttttgctgattacatgggattagggtttacctatctgattgctagtgccatattatttgatatctgtcctttgtcaaccttgggtgataaatcgactagcttgtatttctatgatgacctagctggaactatatgcttagccatgcttaagcatctgatgatgggataattacattattacaccccttagtatcatgacgagctacgcgctcgagacatccggccatgtttcattggtcgtaactattcaactaaaatgcgacagaatggtaggctatgggtgcatggttttgctagtcgcacccatggcaattaaggactggttcgcgggatgcactggaagacttacagcgcttgccacaagcgggaatgggtaactacctgacttgaagtatagctttcctctggctgactcatctaggcaagggtgggcatgatggagcgggatgggccctgtgacagcctttgtcacttccggattcacctaggaacgagaggggactgcccgctgcctgttgaggagtgggggtgaaacctgaggtgttgtgtgcttggtcagagggggttatatgaagggtcttgtcacaatcactcgacatggtgacgtgtctggccaggcgcggtgacatgccggtggattgtgtcttgtctgtacagttgtgcacctctggccagagtaaaacttttcgaatagtcgtgcctgcgattatgggtgatcaaccagaatcaccgtgatttgtctcacacttaatgaatcgactcaatgcactgattagttcaggtgggaatggttgggcctgttcaacatggtgtagcgttgatcagtggagatttaatgttactttaattacgcaactgttttattgttttgctcaataaaatgatttgtaaccgtctttatgcaaatagccacaagccatccttgtatccccttgcacgtctgcatcattggtgtggcttgctgagtatggtggttgtactcagccttgctattgttccccccttttcagaagtgtagtgcttctgatctgaagacgaagatagaggaccaaggctcagacccctgttgagttttgcctatggagtggagctgaaaccccactaggatcgccttttccactgctatcattctctttcggtgtgatgactaagcgcctcttctgtaagtattttacgctttatttacgtttggaactgtttattacttgtcgttttgtgtaccctggctgattcctagacagggatttaatacacaaaatagtctggaaatttgggctaaatttctgggcgtgacaaagtggtatctgagctaactcgactgtggttcaccactcatggcaggtgagagagaaatcccctttgaccaatggacgagttgtaagggagagagttgtgtgatgcttcacttatatctatgccacaactggtaaacaaacatgttaattctgtaattgatcgactatgtattgagtttaaacatgttattcacattgctagcgagaatgaagagcttagattgctatcttctttaaatactagagggctatattcaatttgatgatctttgtccactcaattgtttagagaagaaattatttgcaagatttgaactgccatgtcctcctcaagtagtttttcatgttattggcactcatgataataaaggagagtataatgtgcatagggtatatatttgttcaaatttgaatataccacattttcatgatgcgatgtattgtctagaggaccgcatgcacataaataattctctgtctagtttctctagttgtttaaatgagttataggttggtttgtaagaagggtagtgttgtggtttttcgagtgtcaaaatttcagaattcaaccatatggtcatcaagtctaccacaacttgtgataaataaagataagtttaacatgctcaatgatatggtgaaaccgagcacggtttcgaatttagaaggggaggatgacgaggatatcactagctcagatatgatcatgcataccttatgtatttatcaactaaaggtgcatgctttctatgtgagatttatgtgctacatatttgaacaaacattactgcacgatgagtttgtatcttctcgtttgcaaaaatactagcatgggtgaaggaaaggatcgtgggctcacaaagtgtttgggtaatcaaagaaattgatcggggaccaaacaaagatcttacccaagtctactcttacctcaccatgtcacttttggttaatagaaggcaagaaataaagttctacatgttttggatacggattcgggcctcctgacagcataaacttcaaacggacctagcctctgattgagaaggaatctcaaggtccatgagtacttgttggaaagcttatggagtttacttccatatggttttggtcccacatcaaaatttctatcaatctatcatgaatctgcaaaacaagccatatacctcatccaatccaagtctgatttagacattggaccttttaattgtgtcgtggacatagggtggcacccttaggataaccctaagatgtccctaaacatatttattcagtagccatcataatttagagttggattttgcttagattatttctgctactacaggtttgccgctagtttggttggtggaaccccattcaagtgcttaaattttcatatgcaattgagttgcagtttaccttgttcttggcttcttgcttatgttcttcgattcgcatgcagaaattagccttctcagtgatgtcaaccggacagtgtactgttgattaccagaggagacgtggtattgcgattgcagggttcggatcgtgttgatcggaaaccggatcatgtgtgtcaagttttcgctaaatcaagagttatcgatatctatcggaagatcgggacctagttcctcatcaggacggagtggggtcgccggagaggggatcgatgggcgatggcgttcaaaaaatgatatagcggagaagcatggagcatgattggaggcatgattagggttagggttgggagtggcgtgagagagttagggagggttgggggaggtgcgcgggtgtgtgcttggagacaggagaggtgggagtgatatgggacgttgaatttgagagagacgattctaaccgttctataatgtactccctccgtttcagattataagacattttgactttagtcaaagtcaaactgttttaagtttgactaagtttatagaaaaaataataacatttttaactcaacacaaatttattatgaaaatatattcaattattgatttaatgaaactaatttggtattatgaatattattatatttgtatataaacttagttaaatttaaagtaatttaattttaaccaaagtcaaaacgtgttataacctgaaacggagggaacggagggagtatgaagtatgaaaaatgaagaagtaatactgtgttgatgtcctatagaacagatgattatatttgaaaaacagagggagtaattaattgctagttagctaattactctagctctgagctactccactatagagaaaatggtgatcagtacaggctcgcgatctgcgagctacagaagacgagcacctcgtcgagctccgccctgctctcgtcgccgaacaggctctccttcccgtccggccgcctcgcgtacgacagcccgagccgcgaccgcgcgccgcggaggtcgccggcgccggcgctggagtcgggccccgtgaacacccccatcacggcggtcagcggcggcccgatgagcagcccgtcggcgccgaacttgtggatattatgggtaccccatacccatacggcatggttatccgactagttataggggataacttatatctatgtaatatgtaacagatcatgacttgggtgttacgtttccttgtatattacggaacggcctaaagtcctgatttaggaaaccgataccgtattggttaaagtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttgcgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccgccggcctgcctccgtcgccgccgagtggtgcctccgcctacacggctggcctattcactccgtcgccgccgactggtgtcctcgcctatacggtcggttggtcacaccaccgttgatgggcatcgttatctacaccgccggcctgcctccgtcgccgccgactggtgtccccgcctatacggtcggttggtcacaccaccgttgatgggcatcgtcatctacaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacaacttcaccgccggcctgcctccgtcgccgccgagtggtccctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtaggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgtcgccgccgaccgatgtcctcgcctgcacggctggcctttatgccgccgttgttgggcgtctacgtcttcaccgaccggcttgccttcgtcgccgccgactggtgttcccgcctgcacggctggcctttatgccgccgtagttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactagtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcgacatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattgctgtcggttacgtttgtcgtcgccgactaatttcctcatcttcatgattggtggatttcgtcatcgcctttgatctgcctcgtctgtcaccgactgattattttgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttgatacaatgcatcttaaaaggtgtcaaacagtaaagctttatatagctgtcccgctgacttttttatatataattcaaggtgctgtttgagtttttaagcaattgattggatacaatatcattgcttttcgccacgtaagtgtgcatttttattgaccaatattatggcttaggctgattatatattgtggtctttttctaggcggttggtaaatcctttatgagtttatttactcggattttacaccacatatgccatatatttccaggtgtggtgaaaccatgtgtcttctagggacttaaacacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagttataggggataacttatatctatgtaatatgtaacagatcatgacttgggtgttacgtttccttgtatattacggaacggcctaaagtcctgatttaggaaaccgataccgtattggttaaagtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagaactgcggcccgccccgcgcgtagtcgaacagcgccgccccgctcccgcccaccttcggcagcaccaccaccgccgcctccttcgccgctgcgtccgtgtccgtctccggccaatagaagaggaaggcgtcgagcgtgtcgtagtagtcgtctgtgctccggtacccctccgggctgaacccgccgaacctgaccccgccgccggtgcggccgacgactacgcaggggcccttgaagtcgcaccggcgatggaagtccgtcgcgctgaagccgtccacggtggccttgtagcagcatttcagctcgcgacctgcactgcacacgggaattaattaaccaggaattagttactgatcagtaatcgagcaagaactaaatcatcatcaagaacaagatgatttgggttttgcctctgaggtgggtgttggcgacgagggacatggggaacggcggcgcgacgtcgtggtactggaactccggcggcggcgcgcttctgccgccccagctgaagaggctgcgcggggtgacgaatcccgccgccggccggcagctgcgggtggtcgaaggagccaccgtcgacctgccgctcgccatgaacgccgccatggtgatcgctctctgctcggtgtcatgggctcatggctacgctgtcgcgcgcacgcgaaccttatctgcttcggtggcggctgacatggagggggtttgatgacacgtgtcgcagcttgattcgctctgtttatcgcgggctctgctctctggggcccaattgcccaagagctgcaaaaaatgggtgttcatacgtgtaaatttttatgcatatatgtaatttttgcggtatcggagtgatgaggactggcaacaaaaatatgaattacacagcattttgtacaaggcaaaagtgtgttagccataacaattcttgcaaataatttttttttcggtgtcaactagtatatacatttgggtgattcatctaaaacgagtgtgttagccataacattctagaacgagtgaattcacataattttcccctaaaaaagaattcacattttttttctcaaaaaaatgattcatctaaaattggtacacatgaattatattttttttcaaggaagaccgaagacagagtagattgtacattgttttgctcaccttagtttagtaggagtacatactttcgctttaccccagggtatactataatttccactttgcactaggttgcatcacataattaaaaacaaaactcataaaatatgagcacaacttatgaaaccttttgaatttagatcatgttttacgaggttccattaatttattatgatttttttagagatatgattatataagtcactctttagccagtgtcaggtgcaatttattctctcctgaactttgttcagtgatgaaatactccttcacaggcctattgggccataattccatatcagacgccagcccagaacaccaaatgagcccaatgaacccattttcaggcccattttcatacttggcccaactgcaacatctagaaaaaaacattatttttttttaaaaaaaacttaaaccctaccaaagcaccaaacctcgtgacctcgccggaagccgcgccgccccagccgccgccatgccaccgaaggccaagaagaagcagtccgcggcgtcgccgcagccgtcccctcgcacccctgcatcccgcggccgcgaaggtggaagcgtcgccgcgggcggcggcgacggaggaggaactctcgacctcccgtccgtcgccgcggcggcggcggcgcggcacccggcgctcgtgccccgtggcggcgaggggtgcttctccgggaccgtcgcggaagtggcccccaggggcaggagccgcggcggggaggcgaggctctggctctccgagcccgccatggtcggcgccgcgctgcggcctgggtgcctcgtctccgtaagctcatgcttgatgctcctcctcctccttgagatttttggaatgcttcgtgtgcccaacttgctttttaagctaaggaagctatgattgttctgtaaatgtgatccttctgtagctaaagatgctgcgattttaggaatgtggctcgatttggcataggttagtcgatggtgagctgctgagcttacctttgatttgtgtgagtccatttcactgttgcttattgctgcaatgtttgctttgatgctgtatagcttgtcgcagttgagaagttgaatttatctcttggtgctgaaaatcatcgttttgtttactagcttcagcaaatctttttaatgaatcactagtgatcccagttcgtttcccatcagcttgagcattgtcactaaacagccatgtccagatatgtgttatcgtgtcgagttatgttactctcatcgtagaacaaaacttccgtgtttatacttcatgcaatgatgcaaaaaccgtttagtatgctagtctaaatgtcctttttggtacataagctgaaactgatctccttatttctaggtatctctcatttcttcaaataggggtcgatcagatggttcaccacttgatagtttatttgaggagtgcaacgagttctttgatcttgatgtggataatgatctcatgcctaatgaagctggtcgaaactttgtgattgccaaagttttcccctcacgtgaggtatgtgtgccttgtacttataaagcaatggttagaatgcttaataactgataaagtttttaatcttgtcccagcgaaaaagtttttaatcttgttgttttcttaggtccaaaagaatggtatcaagctgtcttgggaccttgcttgctccctgggaaatccttcagtaggttgttccttgttttttagccccctatatacatctcaggccccaaaggaaactgatagtgttgacattttacgggtgataaaatgcagcaatctttaccttagttttgtcccagctaaagttggatcttccagcgagattgaatctgagtctgtacaccatcctataagaaatggaatggttatagaatcacctaagagaaattcttcagttctgtcaggcaggaatgagtcctatgatattgcatcccacagtggcccttcattgtgtttggatccagctactgcaagatcatcattagcagatgagaaaattaatgagttgctgcagacttgtgcatcacgctggctcagtggtaggcacctactgaaagcaaactatgttcccctcctgatgtgtgggaaattgtctatgtttattgttatgggagcagaagtagatggttctgctcctgatgtggtgcatgataaagataagttaccgtctaatgaagagatttctggtaaatttggggaagcgcctgtttcattccttgttgacagaaccacgaaagtgcatctttctggtccagtctgctcagaggagattgcctttgttaagccaggcccatcagcacacaattcctttcgtactgatgcaagaaacggagatttcaatcacggtccaagacttggtgggctatccaaagaatcaaaagaaataaaagaaatcatttcattttcaatcaaagaccaaattggcttgcaaaggtatactgtgaaatattgattcatcgctcacgtctaaccataaaaaagaaagttatttccatcactaatatgttgactggtttcagggtcaaagataacctctggtacagaggtatccttctttctggtccacctggaacagggaaaacctctcttgctacttcttgtgcctatgatgaaggagtcaatctttttacaatcaacggaccagagatcattagtcagtattatggtgaaagtgagcaggcactttatgatgttttcagttcagctaagcaagctgcccctgctgtggttagactctctaatgctttcctacatttttttcatcatgtcaactatgctttaaaattaagaaaatttgcctctttcatagttttggtttttcacttatatgttgtgaaactgaaaaaatataataattctttgtggtaacttttggaatctatctttacaatggtatctcctatactcggatagttagcaaggtattgaatataaagcatctttactaccttctgataatttgctgaatacatttaaattttgaattctaggttcctgagttgtaagatgttctttgcagctcatatgttttaagttacattttgttctcttaaaaatttatgccgccaaactggccagtttacattgatatattgaaatctatgtttcatatttcctctgtttataatgtaaaaactccaagccaccacataaagccacattgtcaccattttttcacactgttcgatggctctttgatactttagatcatcacctattttttctaatacaaacaaataattttctttatgttggattcggcacttctcgatgagaatgatgacttccagtccaacatattttacagtgcacccatcaatgtccacatcaatgtgctaggtatcatctagatatgattatggcagtggtttactagacatatactatggataacaagtattgagtgccctgattagttttcttcaaactacatgttaccattgtaaaagaatcaaggattgattacctataatatttttttcttttagatatttattgatgaattggatgcaattgctccagaaaggaaggatgggagtgaggaattatccattagaattgttgtcactctgttaaaactgattgatgctatgagccctagagaccgtgttctcgtgattgctgcaacaaatcgacccgatagtattgatccggcattgaaacgcccggaaaggttggaccgaaaaattgagataggtacaaatatctgatgctattcttgtactcaagttaatgttatgggtgtaatctactttacttgcttgttgtctgttcagttattgacaccaagaactatttaaattctgagatttgttgagtacatggatggatcattatatgttgaataatcataacgtttaaaccaaaaaaaatttctaaacaatggattatctttgaagaaacatggtatcatccctaccctatagattattttatcattttctccacgtgcttataggtgatatcaaatgtgatatgagaacaatcaattctaatggtgcaatagcatggttgtccagttgataaattgcttaccttaagtcatctgttgattttttttcccctgaaatggcttgcttgcaggagtaccatctccagtacaaaggctggacatacttcaacaccttctagttggagttcagcattctctcagttgtgagcaacttgagtcccttgcttccgctactcatggttttgtgggtgctgatcttgctgccctctgcaatgaggctgcgttaagtgctcttcgccgttatatcagcctaaagaagagttctcaacaactagggtattatgacaataatgcagaaaagcctgatattagagagattaatgatcctttggggtatcaagtaaactcaatagcatcctctctctcaaagttaacaatgtcagtggatgatgtcctgtgcaccagtaggagcaatgacacagaaaacaatggatctagtggcaagaaagatgacttgctcttgttagtgaccactgaggactttgagaaggctaaaattaaagtgaggccgagtgcaatgcgtgaggtatcatattcaccctcccgatctacccaatttagtctgatgacaatctcttctataataatttgctatttttcctttctcataacagtttgctgcttaagcaatgttgttgttctctctcatcttttcttctctttttttttgtttgtgtcaatcttttcattcatgaactccaatttagtctagaagttgcatattcgttgaaaattgatacaaagctttgtcaaatagttcagttgattgtatgttccttttgtgtttcattactcaatgtgcttcataaatgcattattatcctatgggaaataaaaaactagtgtttttttttttaatctgtagctgatcgtcatattttgatatctatgatttcctttacaggtatcacttgaacttccaaagatacgatgggaagatgttggcggccaagtgagaatcaaggagcagttaatagaagccatcgagttgccacagaaaaacccgaaagcattcgaaaacatgggggtcagcccccctagaggattgctaatgattggaccacctggttgcagtaagacattgatggcccgggctgtagcttccgaggcaaaactaaacttccttgcagttaagggtcctgaacttttcagcaaatgggttggggactccgagaaggcagtgagatcactatttgcaaaagccagagataatgcaccagcaatattatttttcgatgaaatagatgggcttgcagtaactcgaggccgtgaaaatgatagcgtatcagttggtgatagggttctcagtcaattgctagtggaaatggatggtgagttttaatacctcattgtgttatccattattttagtcctgcaattagctcagcagttattttaattggattatttcgttgttaagagtacaatacaatttggtgttttaagcttgtgattgtggattatgaataattttaattggtaactgtattcatttgaagaatatcatggttgttccctgcaaaaaaaaaaaaaggactgcttctgaatatgaacattggctaacaattgcatgccaaaaatcctctctttggctattcctgtcaatgtcattagcttctcttcgtattcatgtttttgtcatgtacaacctctaaaagatcctattgatgttttggttagagcatgcataacttattatggttgctacaggtttggagcaaagaattggtgttactgttattgcagccacaaatcgccctgacaaaattgattgtgcacttctgagaccaggttatttgtccggttattcacattttgtctggcttacatacattggttgggttacttatatagtacttggtctgactttatgaacaatgtatgcgctaggtcgtttcgataggctgcttgatgtgcaaccaccagatgaggctgatcgtgtggatattttccggatccatacacgcaacatgccatgtagtcatgacgtcaatctaaatgagcttgctagacttacagaaggttacactggcgctgacataaagcttgtctgcagggaagctgctattgccgccttagatgtaagctatttgttctttcccccattgttgcacatgactattggattgtacttagatgtttgtgattcactgataaacaattattttctccaggagaacattgatattccagaagtagaaattagacatttcaagtctgcaattagcagaataaagccatctgatgttaaattttaccaagaactggcggcacagtacagcagattcgttgatcctatgtcgcagagtaaacaatgatacttggcagtggacggtaaggcacatatttgaacctgccactttgtagcccattagatatttgtgtgtaaatagagaagctaagcttttgttagttaccagttacgcagaaaaaagaattaggcaacatcacatttccccattgcttcagagcacctatactgtttgtagcatttttactcttgagaaacttggccagtgctagcaattgagttgttttcttttttttttctttttctttccctttcccaactgcattcttgtccagcattttgtgtagctggaaaattttctcagaggaggctacttctgtaagtccatgaaattcatgtccagttgtccaatgggactctgaaccggcagtgatgactcggtcactgccggtttcaattgaactgacagtgataatccaacaagtctagatttgtttttagagcagtaggaaagttgctagtgccagaactttcgatgaacggtattggaaattgctataggaatttcagaagttgcacgcttatcaagtacagtacagaatcatttacattttgtaccgaatttgttttctatgatgttgagctgcaatccgagtgatttgttgttgggtttacatttccgatagccctacaaaccgtagtacctggtggggggttgggggagggggggggttgcaaaaattgacaattcaatggaaaaccaaaatttcaagtacttgagtttagtagtggaaactgatcagctttttggatttttcgatcgaaatcaccagaatttcaacggggaaagacgtgcgaaatgaatgtttactgggaaactgacctatgtgagcgtgaaacccggtgatactttttgtttgctgaaaattacaaaatactagtagagaaaccttgaaaaaaaatagtgaggtgaggtgtagtctatgaaaaattgtaagtaacctaataaaaatttgcatgacctttcatatacactacatgcaacataatatatattcatatattcaggaaggcaatagccccaaaaagaatatatcactcacaattcaatgtgcatcaccaatcatacgaggaataagttcaccggaggtcactcaacttaacagcgagattttttgaggtcgcttaaccacaaaaccaaaaatatgtacccctaaactcacacaaactgtgcactcaaggtcctatggtaatatatatgggcggtttcactgacgtggcattctacttagcaaaaaaaagaattaaaagaagtacatgagatccacatgtcagctgcacatctttttttcttctcttttcttctcctccttttctcttttctctcttctctcctcttcttcagtcaggaaggccggcgggcggagcggaatgaaaattcatctaatccatgttaatgcatatgaatgtatttaagaaccaaaaacaagccacataaattcaaaagacagagggacacacatttcattgcccataattcaaactttgagttttacaaattttgggtctattaccaaagaagatcgatggtaagataaattaaaaattaataataaaagttaaaaataaacaatggtacatgcaaagttaaattattgataccagacgtgcaaatgtgcaggcactaaagaatacatagtagagcaaacaatttgatatcttgacacacacttcgggctccaacctgaaaaaaaaaactcaacttttatcaaatatcttaggcagaatttgacttcggctacatgttagtcccagcagctgaaccatcatcttgtggtgaagtttgttttttcttgcatatgaagaacaaacccccaacgaagagttgtatggggatgagcaggaggaagacattcttggatgtttcccaatcccgaacgctgcctgctgcgtaggctaccaggagggcaagcatgtccaacactatgaccgtgtgcatcggccaaaagaccttttcgccacccgttttgggcgacaacatcctttggagtagcagcacgatgacagtgatagaagccatgaaggaagtggagttgctgtagaagaaagtattgtatcgtcgcatgttaatgtcatagaggaccggattgcccgcagagtgtccatcgccttcgtccctccataggccgccgggtggttttaggcctgtcaggtaggtgatagacgcggctagtatccctaccagcatcaggtacttgatcacatcttcttcttgcatcgaaagctttggcgaggagaacccattggttcccgttggtggtggtggtggttgtcgttgttgttgttgttgtgtattcttctttaattctctgaaatggttgattgccagacagattacacctacaaaaaccccaagaaccaatcccagtacaatgatgaaggtccgtagatatatggagcttccagcagcgtaggcacccagaaccccaaacatgcctgctaccatgcagataatgagggcatagctccgaatgcctggccgatatagatttttgttcataagaagaacaattagagccacagacgccatgaagcttgccgcgttgcagtagaagaatgccttgtagcggcaagggtccttgtttaggagcacggggaagcccgcatggtagccaaacttctcatcgttctcccagaaaccacctggcggggttaggccagcttggtaggtgagtgtcgcagccaagaccgtaaaaagaagcagcacctcacgatgctcctccaactgatcatcaccgccatttttagtctccaatgtgaagaagacaatgtgaatcactacatagacaaggacagcaccagccatggcgatgatgtaaatggaggtgctcgtgtccctgcaacacccgacagcgtacgctcctatgaggccgaacaggtccagtatcatggtcgcctccagtacagcatggtatctcctcaccaatcttttattctgcgacagtgccatgatgaccagggacgccacaaaagctgcagagttaaaatagaagaagaccttgaaccgcctgggatgcgttgtgaggagtattggatctccaaccctatgacccttcccgctctctccccagacaccaccaggtggatctattcctgcttggtaagcaatggtcgctgctagagtagcaagcaactgaatgtactcacaaatcttatccacctctttgtcttgtttgctgtcactggtaattgcaccaatagataattatattgcagccaagggtaattgttttgaccataaaaaaaggcacttgcatatttgctcaaattaaactagggtcttaaattctcagttggcatgaaaatgtttttttcttacagcacaagaataatctactataagaaaacttaatgacggacacaataggtaggcaaagggggctcgcgtacccctactccctaggagagcatgccacgggaaccccaatgcgcctccatcgatcctaggggcttgcttcatgggcttccacgtaaatagcatattagaataagtttagtagtaagctacaaaccacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8365 - DNA, 541 bp, Oryza sativa
ctccgtcgccgccgactggtgtcctcgcctacacggctggcctattatgcccccgctgttgggcgtctacgacttcaccgccggcctgcctccgtcgccgccgactggtgtcctcgcctacacggctggcttattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacaacttcaccgccggcctgcctccgtcgccgccgagtggtccctccgccacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcacattcgctg

SEQ ID NO: 8366 - DNA, 288 bp, Oryza sativa
atcgatttgcgagtttagggaccggaatgacacagcggtactagttcagggaccggtgatggactttactcatttgacaatgtggtgctgcagtaaacgtttggctagcgattcccgcgcctcaagccatatctccccctcctaacccctcctccacttttggcaagtctcgagcgagcccggccacccctccgcgttcgccggtcatcgccggagctccgccgcgccgtcccgtggtcccgcggacgccgccgccccccgaccgctaaccgtcgtgccctcttggct

SEQ ID NO: 8367 - DNA, 1027 bp, Oryza sativa
gtagattttgttaacaatattactatcactttgttggatgaagaaatgaccaaaataaaagttatagatcttgatgagttatacaactttgttgtcgatgactttttcagttgaaatcatttagtatttcaaaatattatttgaagttgtcatattttgaaattcaaattcaaacggttcaaacaaagtcatatagatttgaaattcaaattcaaacggttcaaacaaagtcatatagaaaaatgaccaaaacaaaagttgtacatgttgatgcgttatagaactttgttgttgacaattttttcatttgaaatcatttactacccgaaaaattatttgaatttcttatatttttaaattcaaatttttatataatttaatcaaactcggacggagaaatgaccaaaataaaaatgatagatctcaataagttatacaactttgtttttaacaacttttttcaaatgagttgatttagtgcctttaaattcatttaaagagccacatataaaataaaaattgttttttacattgaaaaaaaaatccaccaatttttttctaccccaaccttattctttggacttttccttttctcttttcttacacacactttatactctctctttctctctaacttcctctcatccacacaccacagggcacaaggcgggcggcggccgaatgagccaacgcggggcgggccaggcggcgatcgcccgagacaggtgcgccgcgcggcagacgggctcaaacggcgcaccgcccgacggtggccggcagagcctgctggtgggctcacacgtcggcgggcgccgggcgtcgacagcggccagctggcccggccggctagccggctagggtttctgggtttctttttattttttttgctaaaaaatatctccgaatatccgataaaaaatcccgaatagtttccgaccgttttccgattccgttgaatatcacctaactgtattcgttttcgtatgcaaaaaaaaaatcagaatacgtttccgaatccgagaaattc

SEQ ID NO: 8368 - DNA, 19612 bp, Oryza sativa
  unsure (1)..(19612): unsure at all n locations
aacatttaaattaatccacgtgcaacatttaaaagaattaacaaagctaaatacctttttttcatcgaaacatgtggtcttgttgtaaaaaattatagcaacaaatttaatagtgtaattggatcatagtttggagaagtaatttaggagaaaaaatagtatgaagttgccaaaaaaattaaaccaaccatgtttagcatgcatgcatactttctaattgcatgcagagctctacaatgaagcacatctgcacatgctaaggccattcccaacccaagatactagacatagtttccataaactccacatcatcaagaaactagtactagacactactcttccaatgcaaacaccactattctatacttaaatttaatgctacttatctcacatgatgttttggatatcgtgtagaaaccaagtctcatgcaagacatggtttcattctctttcctcatttattcacttgccacatcatttttcattttaggtggcagcttatttaatgctatagactccatgactccatcctagtcattgggttgggaatggcctaacataggctgaggtggggcggagaggcatacgaaagaaaaggaaagtgatgcttaaatatactgtatataggctctctttgtttaggcttataagtcaatttataagatgaaaagtctaagcctaaataaacaaacagctttctcgtttggcttttttgaagccataagccactctaacactattaagccaaaagttaggttggataagattttttggtttatgtgaggtagatgcatgactccaccattaaatttaggacattaaatacatcttataagccaataagctgacttaaaagtctaagccaataaatttaagcctaaacaaagagggccataatctggtcccaacggctaagataggcttaaataagtattttaattagaatatgaagtcactcatttctcacgactattttagaatgcgtacgtgctgttgactaattagcccgtgcacacaaaatgaagtgactcattagctgatgactaattaatgatgactaattaagtattagctaaaagattgaaaatggattagcaaagcaactttcctatcgatttttcttttgaaaaaaaaactcaccatttagcagaaaactttctgtgccgaacacaacttaagaccccttcaactcttctagccagtaccagttgattaatgtctttgctgggtagttgatgaaggcctctttggctcttcgcctaaataccagtccaatcatctacgaaggctatgtttagttcctaaaaaaaattagaagtttagggaaagttggaagtttgaaaaaaaagttgaaagtttatatgtgtaaaaaaattttagatatgatgtgatgtgatggaaagttagaagtttgggatagttggggtgaactagacagggctgaaataagaaaatgtcaggctattcatctgcttatctagcagtcccgtcatccataaaataagaaaaagccaggcccatatgtcatccaacatctcatcttcctccactcttctcggctgcggcttcactgttccgttgttgtgtttctatccgtgttccgtaccatgtggagggcatccgtttgtcgattctttttgtgtggccccaccataaacggagattacatgattattctctccgtcaattaccagattacgcagttagcgattaatcctaattagcgtggccctccagggaaacaaaggcgccaaataaaaattaaggcgccaaaccattagacagtttttcagaaaatagattaagctttacatatggcacattattatcggatcacaatcatcttcttcgcaacaacaatggcctctctatctaatcttccaaggtcaatcaaggtcaccgattcactgcatgaacaagtgacaaccatgccgacggaaccagctgcctctgctggaacgtttgtactgcatcatccagggacaagctttcatggtaacctggaaggggaattagagacagtaagacttcataatgttttcactttcttttattagtaatcattgagacttgatcactacaagcacatcatatctccgttcagtaaatctcatagaagttttgcttcttttctattagccctttttttctgtaagtttcatgaaagtttttcttcttttctaatttggctcaaataaaaaacgggtatattaatcaggatcctagtaaaattgaagctactccacaagcagatccctccaaagggaaggcaccaatcattggtatgaaattcaacagtgaacaagaggcatatgatttctataatgcctatgctcgagacatgggttttagcattcgaagaagcagttaccattatgtgaaagattccaccataataaagaatcggacattttgttgttctcgtgcaggtactagttccaacttatatttacaaagttcagtgttcatatagaattcatatactaagttagttttatttaacaataggtactcgtggtcatgataaaagagaagaccaaatttcaaattacggtcagtgttttagtaggccagaaacacgatgtatgtgccgagcatgcatgaagataagtcttagggatgatggattgtattgcatatatgaattcttgcacgagcataaccacattcttgctactggaagtcaggccctctacttaagatctcaaagaaaaataactgaagcacagatggcaagtgctgaaaatgcaaaatcagtaggcatttctaataaggctactattgatttaatggcaaaagaagcgggtggatatgagaatcttggatttactcgtgaagacatgaagaatatattatattcaaagaggtcattgaaggtaaacgaaggtgacacagggggagtcttggaatatatggagaaaaaatcatcggaagatgttaattttttctattccattcaggttgatgaggatgacttgataacaaatattttctggactgattctaaaatgattgctgattatgaagtttttggtgatgttctttgttttgacacaacatagagaaaactaaatgatggtcgtccatttggtttgcttgttggtgtggataatcataagaaaagcgttgtttttggtgctgcacttttgtatgatgaaactgctgatagttttgtttggcttttcaagacatttttaaaagccatgtctggaaagaagccacagactatattgactgatgaagacgcagcaatggccaaagcaatcaagttagtcatgccagaaagtcatcatagaatttgtgtttggcatatgaaccaaaatgcctgcaaacaccttgctggagttgtgaaggagtacaagaaattcaatgcagattttcagaattgtatttatgacaaagaggaggaagatgaatttataaatgcatggaatagaatgcttaaaaagtatgatctgcaggagaacaaatggcttgagaggctatttcagaaaaaagagcaatgggcattagtgtatgggagaaacacattttctgctgatatgagtggaacacagagaagtgagagcatgaacaatgaattgaagggctatatcagtgtgaaatatgacatacttaccttcttggaacactttgacaggttgttgtcagacaaaagatatgaggaagtcaaaaatgactttaagacaacacaaagtacaccatggccaaaagtagatttgacaatattaaggcaagcaacaagaatttatactccagcaatatttaaagtgtttcaggaacaagtgttgcaaacattgaactgtgacctatactactgtggtgatattgatgctgaaatgtacaaattaaaagttcacggtaagcaccatgagcatgttataaaattttctccaacagaaggtaaagtcaggtgcagctgcaagaagtttgaatttctcggaatcctatgttgccatgcattgaagatacttgatgttaacaatataaaagaaattcctaagcaatacatactacaaagatggaccattgatgcaaaatctctacatataaagagcaactgcagtactcatgaagatcctaaaataaagttatcaacgcgcaggagagacttgtgcagaatgtttgttaaaatagcatctcgagctgcagaatctgatgaaacatacttaatggctgccaacaatgcacaaaagttagcagaagatgtggagaaatacttgagtataaggcctgatccagatttggataaatcaggtttgtatcctactctgagttgaatagtacttatgctagtgactactatgttataatctaaatcagctatctcaaaaatattttatcataggcacagaggaaaatgttggcccgagtaaagcaagaggcataaaggttaaggagaaagccattcgtgggtcgaggagaccaattggtggttttgacaaggcaacacaatggagtaaaaagaaaaagagtgattcaagcacatcaaagtgttcagtacaagcagaggtggtaacaccatcactgccatacaccatgatgcaggttagtagattcaagatatatatatacacacacacacacacttggcagagactctcttatcagtgctactgattattatttgccttatacagattcagggtcgttcagagattcccactaactacaatcacatgcaaatgccagactactatcatgttgaaggtgcttcattacttcagtcatctggttatttcgaacttctaaacaaagtcaagggatgcagcatgaagagactgcacagacatttgatacatatccctatagcatgtttgcccatttaaattaaaatcccacctttttttcatattaattagcacctttaccaatttccaatcacattacaacttgtaagattggatcttaatctgaattcccatgtcgattcaagctgtcaaatcatactagtactttctcttgtattagcatcaaatatatggttcccaccaaacatgttgtttggctcatgtgaaaaaaatcataataatttagaagcatcaaaacacaagaggtgtttgcaaaaatgaacttatcaaataaaactaccttaatgcagctgtatggtgaaaaaagtttcgatcttcaattcttcacttcttcaccatagcaaatagtagttgccagcaacaagggagttccacatttggtactgaccattgaactacaccaagccgacgagtatgcggagtgcagaccacgccaagccggcgagcctggccgccgacaacgcgagagcaaccatggttgcgtgcggccaagaggaagatgaggagagcagcagatgagcagaacttcagatgaactctctgatttggggacaagagataaggatgcagtggttttccaagttgtgcagcgcggagtgaaaagtactagtacccggtttgttttgacggagtagtgacggcgtcatattctgcacggtagatagaagccgaccccaccaccaaaaagaatcgacaaaccgatgccctccacatggtacggaacacggatggaaacacaacaacggaacagtgaagccgcagccactcttctcccctaatctctgctttctcctatacatatgagggcagaaaaaaatgtgattgagccatagaccatagcacgtgaaaccccatcctagatgggtgcgggttctgttgaaattaatagataggccttaccccacttaaagattaattctttgaaaaatcacaaaagttcacctcatgggatagcatgcatagggagtttagtaccaccttgcttattctaggagagagggacttccttaaatgggaggatgccctcctagccacttaaagcatgtgaggtggagagaagagggggaacacatgcgctcgctcgcctcgcttggcgcgtgcacgatgttacgcgtcgaatggtctgcaaaattggttactcatgtgtgacaatggcatagagtccggataagttacgcgcgacttatccagttcagttacactacgcgcgcttcacacgaccgctccttgtttgtccatgacggctcgtcttcctgtttgctcacgcttcgtcaatgtccacaaccgcgagtaattcctgctgagcaaccgatctttcggcaacctcgatacgcgttcaacatgttgcgcatattcgatctgttcatgttttactgcttagtttacatgtgtagatccaatgatgcgattattctagtttacatctgtaatgtcataatttatttatggaataaattaaatcattatgtgcttattatttcaacaggttcttcctactcctatatcttttgctatatctcagttgaaagttcatgatttggagcgggacatttagagatttcagttgaacaaagttttttttatatataaaaaagaaatttttagatctttgattgaatgattatgattttgagtgaaaaacttttcaatttttgaattcgtttgagtatatttgaaactttctctttataaagtttacacattgaaactttatgcgtataaagtttatacaccgaaaattttatgttgcgattgaaagattatgtgcatgaggtttatgcactggtatttattgtcaaaccgagctcaaaatctccacgcatctggtctctacgtgtttggaacaaaagaaaatgggtagagcatgtgattacttttttattatctattatatattaaaaatccattaaactttctataaacactctaggacgtcacttggcgctctaataaattagagaaacccaagaaattctaaaaaaaagagaacaaaacatcttactcttattttcccttaatacagtgggcccattatattacaccattagatctattttaaatataaaaccaaaatcccatctcccaaaaatcatctccggctctccacctccctcacgtaaatcccttctttctataaagttaagatctaaagctgaaacctcagcattccacgttatcactaattctcagccgttcgatcgatggatgagattgcatatgaaccactggatcataaggtctacgtcgagcttatatgctaatcatccctgcagccaaagagttgtgttgcagtgttgccctttgacctccatccatccatggctcccgtcgtctcccgcggcggcggtgggcgcgcgatgtgggcgaaggagtggaaggaccgaaagatgcggcgcagtgcaagaaggaggccggtgacgaggactacataagttgatgtgatttaaattgaaatggtatatagaatgatgattcaaatgtaaaagtaagatggtgtgagaacaaaagaaggaagataatttagactatacatctgaaggcttaaaaaattgagataatatggtttaatgagaagaaaaggagaaagataattttaaccatagaataatcatataaggactaaaagcaattgatattatatggcttaatgagagaaaataaaataacattaactaagtgatgatgaacttataggatattataaaaaaatgatggagagatatatcaaaatattatatgaattatgtgggatgatgaaacatgcttgcattttgaatctctaactttttttaaaaaaaaattataaaactatagataatatagcatacttacgtgatccttaaatgttataactttttatatatatagtaagagaggatttgcacgatttctccaagacaaaacaagaaaagagcgaacgagccgttggctcggtggttgggctgctcggtggagcgcccaccacccgcgttcgagcgccgctcgacgcgggtttcgcattggggttttattccccttttccttctgttgcagcctcacacgtgaatgtgccacaatggtcaaggtgacatgcttgtcacgtgcgaagccagttcacttcgcatatctctcagccacgtgcagcctttgggtatttgcgtagatcttgttgtgtgagtgtgtagtgtgcggtgtggtggtgtgagtttgtgcgtgagttcagacactactacttgtacttgaagggttgaggcttaaaaagaaaacaagaaaataaaacaaaagaaaataaaagaaaagaagaggagaggaaacaggtgcgcattatctctctccacggctcccactcccacccatccatggccgcctcggctctgctccgcctcctctctccctcgtccccagcatccctccacgcgcgcgcgacgcgccgccgccatccccgcgccgtagtacgctgctcgtcgccgtcgccggcgtccctcgacctccccctcctcccgttccagcccgcagaggtacgacctcatgacctctgaacaacaagaaagctgccgcccctacctatggctatggtgatttgaaattggacgcacatgcataccgtcagtttgacacaacaataggtcaatagcagtgttcgaatcgagctggattaattatctgtagctaattcaagtgaaagaaagttattgctttcttgcaagaggctaagatgaggagccaccaaaaaaatttcgcagcttaggccgtccctgacatagtggcagtggctggcatgtatctacgattgtttctagcaaccagtgtctgtgcactgtatgccatgattagcactaacttgatcacgatgccaattgtttaccttcagctgcctttgtgtaacgtctgtataatttttctttcaccccacttgggaattacatgtgaagaaacatatctgaatctgcagtatctgtgatagtaacagttctctgaattgttactggttataatgaataagaagtaatttgatcagttactcgtcatatgctgcagcgactaagcaagctagccagtatcttaatttggtagcatgtaggtatctggctcattactcggcaaaggccgattgggtcaaatatctgcattctaacagaggtgtttggttttcagggttgccacaaatgcttactatctgcacgttttactgtcaactaaatcactagggtgctgctaagacagtaaaaatattgtaggtgttgattccatcggagtgcaagactttacacttgtatgaggctaggtatctggcgttgctagaagaggtaattaccatttgctgaatcccttaagtttgaattatattgctattgcgctatattttgatttcagctctaagctcttctaaggtgctctagttacccttaataggcaagggaagaatttctcggtggaaatgggattatgacataatatgacgtaacagaattacaaaaactgtatatctctatcactagattaatagttataacgagaccttcagtagttcagctgagtgacacaccacaccaatttccgttatgtaagactgtctctgtttttggctttctcccaaagccgggtaatttgcttgttatagaaaaaacacacacacacaccgcaccagtgttgttgtagttatgcgaaaatataattatttctcatctgtttctacctttttgctcaacaggccttgtataggacaaacaattcttttgtgcatttggtgctcgacccagttgtatcaggttcacctaaagcttcctttgctgtaagacatggttgtttggtccagatagaaagtgtaaagttcttgtggttcataccctttttttttacaatttttttatgacaggattctgcataggattatttacattttctactcaatgatctttctttagtataggttgaaaggcttgatattggagcactagtatcaattagaggagtttgccgtgtaaacattatcaaccttttgcaggtaacctcattgcaattttgtagattgaaatattttttcaatgtttatacttataacatgtcatacctaatcaatataaattccatgagttgtctgtataatccaccagacattgccgcattgatcctgtaagggcattgtgtcaccgataggaactcatgtgccattcaatgcttcatactccctccgtttctaaatatttgacaccgttgactttttagccatgtttgaccgttcgtcttattcaaaaacttttatgaaatatgtaaaactatatgtctacataaaaatatatttaacaatgaatcaaatgataggaaaagaattaataattacttaaattttttgaataagacgaacggtcaaacatgtttaaaaaagttcctttgtaattgtgatgaccatattttctcaagattgatttggggaagcattgtttatagtgtggtgatggaagtcatgggcgtctccatccatcaaggtttaaatcctggtgtccatacatgtgattgtatacatccctagttggtgcaagtcgaaagtactacttctactgtctaaaaaaaagctctggtttggtatattttgatggaacattatataatgttttttttttttgcattggtcttgaagtacgtatttatactaataagaagtggtacaaacaaatgacttttcaggcacatgctctttaaaactgtacgtttatttgagcagttgtgattcacagtccttctcctgttttacttcattgatctagatggaaccctacttgcgtggtgatgtttctcccattatggacatatcttccgagagtattgaattgggattaagaatttccaagctaagagagtctatgtgtaatttacacagtctacagatgaaactgaaggtttggccactaccactgtaatttcagcaatttgcgaatgctgaacaatggttttgtcgtaagtcgtgagacttcatttttgccacataggtacctgaggatgaaccattgcaaactaacatcaaggcctccctgttgtggtctgaaaaagaaatttttgaggagtataatgaaggttttatccctgcgctacccgaacgtctctcctttgctgcgtaccagactgtttcaggtgacaacagatcattatcgcctaaatatatagcttgcaatgttgaattttgctttttatttgaaatttcaatttcaatgaggtatgccnatctttcatggaatgaccaacaaaaacagatgttgcgcacagtgtgtgcagcagcttcatgtagtcctatgatcatactttctccgtttcatattataagactttttagcattgtctacattcatatatatgttaatgaatctagacatatatgtgtgcctaaattcattaacgtctatatgaatgtgggtaatgctagaaagtcttataacctgaaacggagatagtatctaacatcaaaatcatgcactacaggtatgtcagaagcagaacttctttccctgcaaaaatataagatacaagcaatggattcaacaaacactcttgaaagactaaacagtgggattgagtatgtagaacataatattggtatgatcgctgcaagactggcaattcagaatatatgatcctcactatgctgtcactcatgtaacattatcatcagggaagtgatatttacttatttgatataactgatcgtgcctatgatgtgaggtgtagttgaagcatttgcagagccagaattttaaggatgggtattgagtgtacagaactatgtgtaatgaaaaaaaaatcaatttgcccttggcaggaaaaaattttagaaaacagaagtacaacttctggctgttgcagcaactagagatacacacaaccattctaccaccatgctaaaatcttagtacaagtttagccagaaaagccaaaaaaaacattacaaactactccatttcaaaatgtttaataccgttgactttttagcacatgtttgtccgttcgtcttattcaaaaaaaattgtgaaatatgtaaaactatatgtgtacatgaaagtatatttaacaatgaatcaaatgatatgaaaagaataaataattacttaaattttttgaataagatgaatggtcaaacacgtactaaaaagtcaactgtgtcaaacattttgaaacggagggagtaaattttgaaacggagggagtaaatttcaagacaccaattagccaaaagggaaaaaaatcatctggcatcgaaactaaacaatatgccatccacaagagcatgacaattgtgtgacaaaaaaaatgatgtggctttaggctttgttcttagatgagggttgggaaccctcaccttcgtatcgacacgacttgcatcatcgatactagattcgacgagtgaaggtcaggtcaaaggtattcaccttggattataggtactggttctacaaggaacaccttcaagaaggacatatcactctcaacgtcatcgctcgatctaaccaataaaggccatatatggggttttcatctgggatggagtaccgaaactgccagaccttttcttctgtgttcatagcgttgctgttttttaatcgggaaccacacagattaatgtgattcaatgcagcacccgctcattaaggagatatatatgagacaaagaatagaggaatgtgaatagatcttcattcagtttttcccctaaatctttaggctgctgacaatttcaaaaggtaagaatagaatgttgaaaaattaacgtttccaagagatcttattaacaaatatttaataattttgggtcgatatttgattcatttgtaagtaatatcttattaatcaacagatttgtgaaatttctaccatacgactgtaaaattcttgtcaaattttatgtgtttatgcccgaaaatggaggaccaagatcatactctaccggttttcacctgaattgtgttgtctgttggcacatgtttactgactttatgtacgtgcatatgtatcaccctattcaaaagaagtatgtgtgaattcctggattcatggccctccttgctcacaagcattcataaaacaaatgaatggttgagatattattttgtgaatatgatattgtataaccaactattttgacaaactatctttctacctgttgctataattgttaagtatgttaattggttgtcctttctcatttttttctaatgtaatacagttctttttggtgaaaaaaaatctcaactaatatagttccacattgctataaaagaatatattatttatatggcacgctgaaagttatattgtttgaacacacgcctagttcattttcttaaatgttcaagaattaacatttttataaaaaatataactactagtttacatgcaagtactatgcacatttctagaaaataaaaaaaactatttatctcatatttctggtatatcttgttaaatactacctctgttttttaatagatgacgccgttgactttttctcacatgtttgaccattcgtcttattcaaaaattttatgcttcacatgtttgaccattcgtcttattcaaaaattttatgcaaatgtataagatataaatcacgcttaaagtactatgagtgataaaacaactcataacaaaataaattataattacgtaaattttttgaataagacgaatagtcaaacatgtaagaaaaagtcaatgaaatatattagttttgataggctgttgtatagttgtgttaccaatatatggcaacatagggtgtgtttgagcctttgaggagaaggaaattggggagattgggaagatacgcaaaacgaggtaagccattagcgcataattaattgagtattaactattttaaatttcaaaaatggattaatatgattttttaaagcaactttcctataaaatttttttacaaaaacgcaccatttaatagtttgggaaaagtgcgcgaggaaaacgagatgctttctcaccctatgtctcacaaacgaacgcagccatagaagacataagataatctttatataagaaatgtgatgacagatgtgcaaaatataatagcaaattgctagtattgtttggaagtaacttagttttactgttatcaattttgataatataagatatttccttataacaataatagattagatgaaaactgtgggaatgtatgtgatagaaaattgctagtcaaattaatcctacaatttacatgtttgtgagatactgtagacagtgtatctgtttattgtcatttatcaaatggcatattaggagtttttccctatactaaataacaagggaatcaattacaagctgtcatttcgtaatattgtagtaaagaacaatgaaaaataatatgagctatcacttctcgataataacaaataaaaatattacaagttagttcacttccatatcttaccttacctacctaaaaaatcaacttacctacctgaacaaatcaaagtgcttctgtttcgtcatctttttttaatcgtccgtcaattttaacatgcagtccactacccacatcctccctcgaatacacttatgattgatttggtggtccatagtatttaatcggatggttgacacctgcatttccaccaaccaaaactctttactaattatacccccctgccccacccctctccctctaatcaagagtagggtttccctacgccgcaatccgcttgccccaatcctcaccggggtgccggccccacatgtgtgcatctggtattcctattccatgcccgccgctaccctctcttatcctcccctgctgtaactcctcccccaccctcccttacgccgccatctcatctcatcccctccttacccagcacgctgcctcctcggctcctcccatcccctccttgtcaccgctccccccccttcccaacatatcatgcaccccatccccttgtgcatatgctcaacggtggcggcctttgaattggtgcttggatctgcccatccagatatggactggctcatcgatgcagagtggatctagcagccacggtagccaaggcggccacatcctcccctcctagctagatgatcgttgccggtgccacctttatatatataccacagccccacctactctaacattgggacccggtcatagttaccacgcgctgtcggaccactccgcctgatgttcctgtccccgcggccgcggctgtggctatggtgagcagctagtagctcgggatggatgagctgtttctggctgcagtggccgtgaaggaggtgaaagggaagcggccggaggtggacccgtggagggggagacagagtgtagtggaggggaggacgagtggagcacgcggatggccgaggccgaggtagtgtagggaggggggcttcctggagcacctcatcgtcatggtcaatggcctcgttgggaggtagatccgtgtaagccgttgtgtgttggtcgtcactgtgttagctcagtgcgattttctggcattggttgccattcttaaattttctaagttgttttacagtgtggatgactggaaatttgcagcggatcagctcgtgaggtggagtgatcgtgcacggtaagtaccccccccccccccattctacaggaaaatctaactgtacctctcgctgaatttatttgttctctcaaatttggattgcgttgcaaagtaagacctttccatttgcgtgatgttttgaggtgatatcatggaaaattagattagtgcttcttcatggaagaaatcgagtttaggatagacagaatatatcaagtatttattttggtaagtaaattgattctccaaaagatcatatccaagattaacgaattagtttcttccatttaaattttgatgtatttatctgatcaggatgacaggatttgagctcgccgagctgtttgactgatgattgatgcttttgctgtagggttttagctgatcgtgtgccatccaccgcaaagcagctaacgcgagaccacaccgtcttccatagagaaggtaatttcccttcttagcactactgctcggccatagagaatggattcacccagttttggattgatttctttgtttgttaattagtgatgaactatgacatgcatggaattaccacaaaacggcagcccacaacatattaattagctccccccctcccaaactctctttctttgtctggtacatacggataggaagccacccatccgcgcatgcaacatagtgagaagagaagtcgcggacgagcagccttcctccagcgagcttgctccacatccatccggtgagcttcctccgattgagaagacaagacgtagtcgagcagcttccctctggtgatgatgacggcaaaggcctcctctagtgagccccagctccctccctatggcgagctttctcttgacgagattgatctggcgactaggttagccctttcctcgactgccacccacctacaatgcagtcgcctggccttggcggcaccaaagggaatcaatgtgcaggcgcgcccctgcagtgctggcctcctcccctcccctttgcctcgctttgcctccgcaccaacaccagcccacagtcagttgccgacccgtggctccggaggcactaccaccgccttgttgttgatgttttgtatcggcaataatttaagaaggctacgcacgagatctcaaagcagatggatgtggaaaacaagggtttaataggttcatgccagaatggccgttgcgcgaacgttcgtggaggagttcgtacgaacgattggcccatcctaaaagagctcctttatataccttggtggacagggttacaaagggggaaaacttagccggacacggtttcagtttcctaatctgtacatagtattcttcggcctggattctatatcctatcttagggtacaaggctacatggcaatcgagttttactttatctcctattacatggatctggttcaccttctatcactagtctgataagaggccttgtgggtatctagtacccatactatccacactcgttgtatgcccttgtccatcgcctcctgcactatccctctaagcttgatcccccacttcccctccctagcaccacaccctccccaacccacccccaataccctaacactaacctggagattgttgttatgcgtccagaacgtgttcatgcattcaatgggcgtgtgtgttcgcgaattaggctttttgatgaagatggctaaccccacaccaccggtcgatgctacgccattgtgcagcacgtcacagtgagcgagatgtgacacccaggaaatgttagggctgagtgatcctcttccggaaatctcatgatgtgttgtcaggtttatgcgtgaagtgtagcctggttggctggttgactggttgactaacaggctgaagaccctctaggttggtcttgattttggaaaagtctattttgccttcctcagctatgggccgagcctcattcgcttccctcagacctctaaactagatatgaaggatccctcaactattgaaatggtttgttttgcctccgcaagctacgtggattgtggtttcatcctatgtagtgcctacgtgacacgtttacctggtcttcatatgatgtgatgccttacatgtcactcatgtggcattgcaattagggaaaaaaataaaaaatatatagtggtacccacatctcagtgagcccatcttcatcctctctagtctcttcccttgcctcctccgttaacctctctttgtcaccctttagggacatcgataccactctctcaatgccacacttggaagtacaagttggcatcatcgagttgctctatctagatgatggtgaccttgtgttcgtccattgttagtcaattagtacctctggctgctcccctcttcattcgccataggtgtacattctcttgcatcagcttcttccccccactggccgttcctcttcgtcgtggttttctgctccattcctatcaacgagggaacttccccggcctcacctaacctcccaccatggctgcatgggcaataactaccatggctagtaagttggtttattgtgctgttgtcgagtgttgcgtcatccacgccatctgcaacgggctcaactagataccctatttctacacggtatgccgggaagaggggctccatcatgctgggtgccaccaaccagccactacacatcaatatatatatcaacccatggaatgtcgagaccatcacaaaatccacgtacatcgccatggatgtctaagaggagcaggcgaggcatgtcaagcactacaccttccttaagctacatggcatcatcatctcgacaaggtcgttcatcactgacctgtcctcatggccatgcgtcatcaaggagtcatcatcacgtagcccaacaatgccattggacgtctactcacacctaccaatcatagagttgaccgtgttgtgtcaaaactgacaaaaatctagtccaaaatcatttgactatgttttagcgaaatcatttatttaataccactacttattacacttgtttggcatatcgctcacccctctaattatttaatatcagcaaatgcacatgtgtccactccaactacaagccaatcactagtaggcagttagccatcgaaaantactctactagaaatcaaaccatctaagttggtgtggcatagctccattgtgtcatatgagttcatcgggtgcttgtcattgctaagcaacgtgatacgctcaacctgtggaacatanaggccatgtacatcaccatcaccatggacatcaaggagaagcaagtgaggcacgtcaagcacaacatatttcctcatggtacacaacaacatcatctggcgaggccatgtaccactgacctgtcctccagaccttcttgtcattgctaagcggtgggatacatgtcaatgcttggaacgtggaggccatggcacatgccatgtatcactatgcacgtccaggagaagcacaaaaggcacgtcaagcactacatcttccacacgctgaatggaactatcacatgggcgaggtcgttcactgcttatctgtcctcgtggccttccctcatcagggattccatgctgctaggcccgacattgtcactagatgtcaaggtactcctgctctggtcgccgacacatgcgcgtgcacacacacacgcatgcacgcacacacgcaaactcagatacacaaaatcatataaattaagtttactgtacagtgagcaaaattgaaaaaaatgaagtccaaaaatcacttgactttgttttagcgaatgcttaatccaaaaccacttcaagtttccctcttatgacatataactcacccctctaattgtttaaatccaacggaacatcaaccaagcactactaggcatttagccaccgaaaattcttctatctaaaagctcttagaaaaaccaatccccttcaagatagtgcggaacatctccatttgttgtctgagtttgtcgggtgtttgtcatcgccaagcgtcaccatacacatcaatccttgaattgtggaggccatggcggaggccatgtacaccgccatcaacatggacatccaagagacgcaagagaggcatgtcaagcacaacaccttccttgtgtggcatggcatcatcatatgggctaggtcgttcaccgctaatctatcctcctgcccttttctcgtcatggactctatgttgcaaagcctgacattgtcactgcatgtcaaggtgctcctgtgccggttaccgacacacacttgggtgcgtgaaccccccccccaccacacacacacac

SEQ ID NO: 8369 - DNA, 526 bp, Oryza sativa
cagcggcggcataataggccagccgtgtaggcgaggacaccagtcggcggcgacggagtgaataggccagccgtgtaggcggaggcaccactcggcggcgacgaaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgtagatgacgatgcccatcaacggtggtgtgaccaaccgaccgtataggcggggacaccagtcggcggcgacggaggcaggccggcggtgtagataacgatgcccatcaacggtggtgtgaccaaccgaccgtataggcgaggacaccagtcggcggcgacggagtgaataggccagccgtgtaggcgaaggcaccacttcgcggcgacggaggcagccgcggtgaagt

SEQ ID NO: 8370 - DNA, 516 bp, Oryza sativa
tcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagtggcctggcggaggtggtggccgccccgtggtggcggcggcggccgttgacgtgccctcccctcctccagatccagtgggagggaagcggcgacagctcagcgactcggcggctgcgcccttcctcggctagatctaaagggaggcaacggccgtgaggcggcaacacatcctccggcgacggcggcggtggtggttaaagcagccgggaaatgttctatgctgctaatgggttcttagatgccttctggtttctgtgctgcggtcttgacattgtcttgaagttcttgatgtgctcggtttgattcgtgcttgggtcggcttgattcgaacccacccgcaatttttttggggcctcgttcatcct

SEQ ID NO: 8371 - DNA, 1851 bp, Oryza sativa
gtgtcgacactacgccatctgattgaaagagatccggtaaggcatgcaaacaggattctccttatacaatatttctgatcaagtgctggccatggttaacaccattttcatgatcgtgatattagttcttatttttctcgtgtgaattttcgttgcaacgtactcccgccgtccacaaatataacatatttaagtactgctgtagagattaaggataaggagaaaaggctatggtgcccttcattaagggcctatttgggggagcttctgacagctgtagattcttccagaatcagaagctcccccaaacagtctagattgtcctccagattttgaaaaactatagttgtagaatactaaaaatgaactagaagccagaagctgtgaaacccggcttctccagattctcagaagttgactaccaaccagctatttttcagaatcttaagctccctcaaactgcgttagaggagtagttggggtaagatgggaagaaatttgaatgagatgtgattgatggggcaagtagtacttaaaaatcacttgtatttgtggacaatggagagggttaaaataccttgtattcatggacagagggagtacataataagggaatgatgatttttctttttctgaatgccatatttcaaatgcatattgtttggtacatgcggaactttcaaggagtaacattttttctgttaacaactatgcatcctagaatgtaggctggttgggtagcaggtcagaggccagccattactttttgtcctttttccctttgtggaatgtttggttgatcttcagtttatgttgtggataatgcttagttgatttctgtatatgtttggcaaatgcacaccataatgtgttttgcttgttttatcttagttttttttctctctttaatgggtcattgacccagatccattggattacattctgcatattgaactagtgttctgaagaacctttatccagatttttgaggcatctgtgagtctcccgtggtcctattccatgacccagtgtcccagtcaacgtgggaacctggctagttatcattgtttttaaggcatcgctaaggcgtcgccatagcgtcgcgaaggcgtcatggcactctgctggctccagggcgtcctgacgccataccagccagtgtatggcaaccccaatctcatgccaggagagaatagggggattatggcgaccccaatcccatgccaggagagaagaggaggggggttatggtgacccaaaacatcaccaaaagaaagaaagagagagggagagaggattccatcttatctggaaccctaccagcagcgacgacgtctcagtatccacgactcccataaccatcagctctggttgcggcagatctctttccctcacctccctgctgccatcctcactgctccattcacctcttccttcctctgctcagcttggctcctgtttccttcctcttttcttcgcttggttttctcatgtggcggcggctgtggacatctgatgcacgatgcttttagggtatagatgtttgacctaataggttattgggctttgtgggccggtatgagggttggtttgatgggctgttttgccattttttatattttccataccagattattccctatttctcctctgatcgctagcagagttattcttagggcatcgccacgccataccgctataccgtaatagcgttgaggcgggtgtgcagcgccttagctcgccataccgccttaataaccatgctagttatataggccacattggccaagtctaagactgtcttggagccctacagttgggactgagtcccattttgtgcatgagggtgca

SEQ ID NO: 8372 - DNA, 14318 bp, Oryza sativa
taatagtggactgggagcacaagagcaccagtccttctgggagctttagagttgttctctagactcaggtgcagaacactattctttgccttgcagtagtgcagttccatctcgtgttctggtaatacgtatatcggcacattgctaatttacatgtagctcaggccctcctatttagttctctggctatagcggaactggctatgcacaaaagtgctgctaagcagtataatttttttggtactattatgaactcaggttcataacattgtctgctatccatatggtactatttagtatttctgcacacttcgttactctgtctgctgttagaattcaatctaatctttctccattagaaatttttgtgtatagtgtagtgctaattatttaattgcctaatgtgtagaatagcagcattggttcgttcgactattattcgcttattgtacacatcatgtccacttcgtccatctcgatggttggcagtgctgaggaatatggtatgaattaatacttccttcaaaattcaatacttcattttttttaaaaaaatttctgcatgccactgaagaattcacatctcatttatggcactaacttttgcctattctcacatatgctgctgttccattaatgcccgttttacatgacattatctcaaacttcaatccccctgctgttatgggggatgggaattacctttttcctcgggtatttgttgccagtgataaaagaagtatgcaactgggaggagtcgacaatagagttgggacaagcagagagagttgggttaatacatgtttcattgatcttgacaacactgatgcagttggtcaagctcattactttcttggttgtgacttgtttgcttttgctacgcttgcaacgttagatatgcatgatacccatatttgctcgacagccctttatgcaataaaatgtatttataccttgtccaacacatggtcaagaagcagcagaaggtgttggtggcctgtgaacgggaccctgagccagccggtggtggtgacatcaagtagaatggcagtgatagcagcctcttggacagcacggaaaactcatggctggagctgccagcaagcaggaggccgctaccatgtcaggggtggctgctgaggtgatggagatgggtgaagcagcaccagtgcaggacaatctggccattgcagggccactgccacggtggtggaaccttccatcctgcagctggggcagagttctcgtcgttattttcagtctcttacactttggccatggttatgggtgtcatggactgcttggctgaggtggccaggaacctatctcagccccagcacagcatgtccaccagagctttcaaatagtggaactcaaggccactcttcctccgggcttgtttccacataaaatgggcagtaatggaacagtggaatgtgcatgaacggaaaaattagtggcatatgtgaatggtctccacttagtggcatacacaaaagttcccccaacattagttctagggtttcttgtatttatgcaaaactcataatggttggcaagtttggcatcaattctttccactgcattacatgcataatatcctaaaagaggattgctattactttgttaagtttatgtgctactactctttagtttcttggaagggcatgtgtactgttagtgaatgttgttttagtatcagataccatatctcagttgccactgctctttctgtcaatcacctttctttaaattcatgtagattgtcgattgttgtagttggcatggcaaccatgtttcttatttctagtatcctatttttccttagtcttctccttcatgcacaaactaatgaggataaggcatcattttgccttatcctcaatgcgtataatgccttatcctcaatgcgtctattatgcatgaggaacacatgtattattagtatatttgttacatttatacagaaccttcatgatgaaaatcatgctttggatttggtagatttatattgtcatttttttataacattcaggttcttgctacctcaattgcaagaaacacaagcgaaggtctgtccagttctggacatgatcccgttgacagtaatgcagagaatgatatatactatggagcagatgaagacaacatgatatctagctcaaagcaggaaaaaacaaactggtctgccaataaatttagccagtttccacaaagaaataagcatctgagatatcgcaccagggtttttgcagcagagtatgtctgttagactgttacagatatatatttttatttgcttcccacttattattaaaatgtttatttgcatggaaacagatgtgttagccatgtacctgttgccgttggaacagaaccagctcattttgacctcctattggcaagaagtgcagtagctgaaggggttcatctgtcaaatgactggctaattcttaagctacaagagttggtttcactttcatatcaggtccaaacagaaaacaaatttaatattcagagcacaacacaatttgaagaacttttggagtgaattctccgattaaaagctgacaacaacatttgcatggcagataagtactggacaatttgaaggcatgcagccaataggagtgaagcttctctgtttgattatggacaaggtatattggctcttttggaaacaattttgcgttaacataactacgtaatcaattggtgcagtaatgccaatgatgcactaacttagttaattcaaggaacatatctgaaacttaaattagtcctcaccatctgccttgttgaatattgagagtgcatgttgttgccatcaagatgctgtgaaactagtaaatagttttgtgaggtataatcctactgtatgtatgttctaagatgactttggcacatgatcattttttcctagataagtaattgattatttaggtaaataggtttattatcaggaaaggtgaagatatcctaaacctgggtgagacaataacaagaacttattctacatttctttacagttgaccataacactgcctttaaatttccttattggctgagtgttgtatttttttatatatttctagtttggcatggctgtggatcctgaatttcctgggcatatattgttggagcaatttcaggtgattattacatctcagtttccagtgtttcttctttttttggggtaacatcatgatcctgtaccttagtcttttatatatagccctgtaaacttgatttaatcctgtagttgaatgattgctttactctgcttttttctgtgtttgaaatttaaaatgcaggctcagctcgtttctgctgttcgaacggccataagtactgcttctagtccacttctccttgaggctggccttgaacttgccacaaaggtttctagcaaaatatttcccgttcgttcctttttttcgccctgtacaccagacatattgataaatatctgtgtttggtggaaccaggttatgacaagtagcgtaattgggggcgacagggtagctcttaatcgcttgtttttgctaatatgccgtccgctaaatgacatagaggacctattttatccatcttttgccgattgggttgtatgtaaggtattatggttctccaaaattgccttaagtggtgatacactgtatccaaatttgtttttgcaatttgcctctacggagctcctgagctagcttttgtcatctgacagataaaagtacgtctgcttactgctcatgctgcagtaaaatgctatacttatcaattcttgaggatgaaggaaaatattcctgatgaacatcagcaattggcacctttgcttgcaaatagttcatctctcttaggaaagtattggattggagccctcaaggattatagctcgataagttttggtctgcattcaagaatcaatgtaagatcatctatcaagcctttttaattatgccctaaagaggttataatgttcttctgtgtcttcttaaaaacagcacaagccgttccttgatgggatccagtcattcttggtgtcatcaaaggcaaaggagtatcttgatgaagtttgggcactaattcttcaagcaacagctcttgatgcagctcctttggagttcgaaatggatgattctgaagatacgcttggacagacatttatatctggacatagtatggtcaaactgaatttaactgaattcaagtttctttggggactatcggtccttgtgctttgtcatacacaaccatcaatgtcgaatagtgctataaaaatcaatcttgaccgtaataatgagaaaaagattggaggccttgttgtctgcgctggactagataatccaagaccatgtgatcaaatgttgcttgtgttatcgtccctcacttcacaagtgttttttagcatgaattttcttacagtggatacttgtcaggaactcctacaggtcagtgcatacctgctgttgccacaatactttcaaaacagttaaacttgctggcccctatcttaagttatttacttctattaatgatgaaaacccaagcttatgtgtaaactaccctaattccctacacaatttcacaacaaaatactatacatgctttatttggaaatggagtagcattttctaagtgtctcatacttatgtgttgaaatagtaatggtacacctgggagattacattggataccccttggaaggacatgttcaggattgaagatttgattatcatatgtcaaatgctaggaacatgatgaatatattattgttgtagcttaatatgccaataggcggaagggcacttgattcccaggaaaactaatgtgggattaatattagagttaaatattcattaatattatttagctttaatagttaaatgcttcaattgtaataatttaatgtgcctcttgaagggtgcttttcatctggtagcttttaatgagagtggaagtaggacacttatttaggtgatacagtttgattaaatccatgcttgttaattgtgttgggctagatgactcggcgttcttctcatctcaatgacctctgccactaatactccttcccatgccaagccatacttctcattctttgcttgattaagttattccttgattgacaaggtatttgtacaatgcaggctcttacttatgctgattgttcaagtgctcctgttgtatgcctgttctcccaggtattgtcttgtctttgttaatttgcttcctggacatattgatctacgacgatctacgaccaaatcttaatgctgttgcagtgtctgcagtcctaaaacactatgcttgttagtgtgtcccaaaacactatggtgttagtgcagtaattttgaggatatatgaatattagtgtttggaggagttagaggagataaaaacacacaactaattgccaagaggaaaaaaaaactaacgagttattaaacagcataagaaacaatgcattacgttattcctgaattcggcgccatcttacctattaccttttttgagacggtaatcctcactgtccttgcctcaattgcctcggtggcttttttttttaatggagatagccatttttcccaatttaccttaacatttttttggatttcttgttgatgcttagtaattcagtcattgtggtttctaattataggaggtgcatcatttcacctttatgtcaacacaaattgctttgagtttaaaattaagtatttttttcaaatgcaactattatatgaaaactattgcttttctacagcttttagctttgcattttacctagctacaacaataagagcatgaaacttcattatcaggcaaacctttactcaaggaggtcctatatatatgtcattctctgttaatgtgggctgccccacctgacaacatgtgacgacaacagaattgcataggggaatgaatgacaattaggacccaattgaataattaatttgtagactggtatccaataacaaattgcttcttgcccttaatgtgcaaaattattccattgcacactaactattttgatgggacatctaattgctgacttactttggattcctcatgtagataatcagactgtgccctgacaacttctttgaggtggaggagtttgtttttgttgcattagagttctactcatggtatcttgctactatacttcaaaggtaattctcagattctcaccacactcaaaagtcaaaacctttttctatgcttctggtgattactttatttcctttgacaagatttggcaagcactccttttacccttgtatgttatttcttttaatctttgcagtaggtgcggaagttctcaggaatgcttaagcaatagtttgatttctgaattatctgttgctactgagacaatggcatgccgaatgaaaaatgaggtagtgatatgataaaacctgggtttccctgatcatatctagttggcaaaatttgctacagctacctcagctaattacgcgttttttgcgtgtcctgtagcaaattttgcctatctagttagcgccttttgaattacttttgagatgcattgaatctgataggttgttttttgtggcagcattggtggaaactgatgatgctactggtatccacgtcataccaatcatttcaacaagtcccctctaatctatgcttgtcaaatatcatctcctttctccaaaatactttgccaatcatgaagaaatatcttcaaggtaatattatcaagtcttatttacttgctgatcaacttttcgcaaaataccccttgcggttcagtaccgctaaaagctcaacaaactgctcttgcttcaataaacatcaattcttagccccgtaagggttgagtcctattcttgttttgataaccctggtaagaatactgttttatttttgctcaattatttttatggacattaaacacaaaactaaatctaatgaaataacatagtagcatattactatagcagatttgaatgagtcccccatgtaaccggtaacttaccactctgactccattgtctcccttatcacccacttttgtacaccaatacaaataaataatgtgatgacctcgattctcagtcttttatatgaaccagatgctttggatgtgcttctaagatttggcctttgagtttaagaacaaacattctgttagaaagtaatgttgaatttgccaactctgttgtactttgacctggggcaccttggttatttggtcccattatcatagtccaaatgccccaaatttatggagcaaatctgtgagctgatggctggaacaggactaaaaagagttgcttaacaagtaccttcctaaaaaaccgtgggatggaagagtgctattcccttataaacataaaacaatggttagacaggaagaccattgtactaatttaagaagtgattatttgttttgtagaaagagctgaaccaggtgatgagtgtgccaactgcgaagttgccttgggagctttggttagtctggtggcatacttatgtacacaatgcagcaacaggatatcaatgctggataacaagatttctgattcctacaaactgttggcaaagatactatatttctgtttgggagaagctattgctcttgcaaaacttgttgatgagattggatatcatggtgaaaattgtacaagcaatgaacttatgtcaggtagcttcaggcattgcacacaagttgttcaggcttcactttgcagtacaaccatacaggtaaaatagctggatttgcttactatgcatgccgaaaatgtcatgaagtgttagtatctaagaagatgattcctctaaacaggtacaaatgttgggggtacatgttcttaaagtctctgcacaaagagagctagctgaaggctcacaaacagcaacacattcttttatggtgctatttgtggaattactggcagatgtgttttctgtgattcaaactgcattaaaggtactatttggaagcttaattaatttgggattgtaaatttttggcaagatcagatggcattccctgacaactttattcctccagggatgttcgagcaaggactctgtcagtgtcattgatgaatgtctaaaattgcttttcctcttccattcgctagcacagtcaaagaaatgcccgcaagaggctacaatgcttctgctggatgccttactgatggttttctattcttctagtgccacgggttcacaggtagcacaaattagttagctagttctcatcatgaaatcaggtaaatgtacaattgaatccagtttgatggtctttggctgtgctgatctgatccaggaactcactgaagtaaacaacatatccaagaagttgttctctcattttattcagattccatctgctgccatacatatcaaagatataatgttgtcagcagcacctacaaaaagacaactacttcaggtatttgcattattatgtactgactgatttacatggagctgaacttaatttttttcttttagattctgactttcatgtccatttttgaaaatctgtcaccctactctttactctacagtatgtatatacaattatgttacctacactatgtttgtgctaactaactgattcccatgctactttattttgctgagatgtgacacagcgttgctgcatttttaatatattcaaatttaggtgttctctgaaaattgtatcttaaataacctgtgctgtttgtaggacatgatccgagcttcagtcactcagggtcagacaatagtgcctgggcatatcagcgcaaattcagagcagaatgctcagggtggctttagtcaagaacctgggctcaatgccacagatgcagatgaagagaagaatgaaaaacaagttagtgatgatgattgggatgatgactgggataattttcagtctcttcctgcacatggtaccaacaatggtgcagactctgctacagctgcctcacctttacctgaacagggttctgttgcaagtcctcatgacgaacagatccctcaggtaaatattaatcaagaagttagtgatgtagatgtttcagatggtacaacagaaggcctaagttcttttgataaatatcttaaagaaccctccacttcacatttctcagatactgcacaacaggtcgagagcaaatctcaagagttctcctgtaaggatcatgaggaatccccaaaacatccaaaagttcattgcacaggatcatcagctcatgttactaaagaagagacggatgatgaatcacagcagattcacggtgaccaatttgtgagtagggaaagcaagaattatgacttgtacttatcgaatgagatcgctggttcagcaggtgaagaggaaaatgatacctctggagaaattagaagggccacgggtgatgcgctggatgaaaatatttcttccgtagatgattccaacttgaataatatttcagatggtacagaggataaatcaaataaggcttgtgacaaggtgttggttgccaatgaaaaatctgaaacggttatcacagactctggggaaaaggtgtctgcttcatctgatgaagtaaaatcagatttgtatcctgaaaatgtggataccaaaccagaatcatctggtggtgaaatcgcggagtcagggtcatgattgtgaggagccttggtctagacaaaatctagatcatttgggaacacatccatacaggtgactgcatgccaggattctggaagtaaacagcaaaagctcctagtatgtgtttgtcaagtcccattcttgatactgagctcaagtaatatttgttagaatatgagttctcacaagtgctgtcagaaggaactattgctctgaaatgtttgtcagatttcaaggctggactttggagcaaacgaagagctggcagcggcatgtacttccaaagtcaccactatacggactgttgtacattttacccaactttttactcatgtttacatgctgtggaaatgtagatctatcagattattcttgattgtcaggacaagctggacggattgtatacattactgactaccctgtgcatgtgtttgacctcatgtcccatgttgtgaacatggtgacagagtgtggtttgtgattgtaaacatgctgatcaaagcattctggcgttccatatgttttaagattatcaggccagttgcatggcgaaatgatgtttgtttggtgctagctctggttgttcgtgcgaataaataagtggaagctacaatgccatgactggtacactccacatcttataatagagatgcacaaaacaaacaaccgaaaagaacagaaaactagcttcaagtttttttctcaacatttgaaacattggggaatgcggaggaatccatgctctcgttgatgctgtagcaacggtaaaagcttctccgctccaccgtgagctaagcggatagagctagtctgcccaactatcttgtcgtcaccaagcaccatcctcatgccagcagataatctgtcccctcagcattaacgtattcattgctggcatggcatcatcgtcatagggtaccatcttcaccgagttgctgtagcttatctcactaaaagccattgccctactccattgccatatcacacgaaaacgatcacgctaccccaccattgtcggtgtagaaccttgcctccaccgaactgtcgaaagctggagaatcgcgatcaccacgccatcttcgccgctgacctctgccactacccttggcgctgtcaactgtgttcggctttgctcctagcgcaactccaagcagaccaaccaccaccaccaccaccaacattgccattgtcacctaggcccctagcaccgtcattgtgcacgccgctagtgtgtcgccgttgccggcccttccacctctaagaacgaacctgtcatcatcatgagctgcccaccactaccgatcaacaagccggtattgactggcctctgacttctgccactgccaccatgcctccctaactccgagttcgacaccattatcgaccaccagttcaccttcgttgttgccatgaaccctcgctaggcgaggccgatggaaccgtccgcctccaacacgactccgctccacctcaaccagcgagaccgggaggagcgggagggaggaggtagaggaagccccaccacccctatcgccaagcagcctcccgcctccatctccatcaggctaggctgctccaccatcaggggtcatcagcaccatccgccccaactcagatggctaggtggggggaacgagagggaggggagaaggagaggaggaaggtctaccaccactcgcctccatttttgcagcgcctctccgcgttgccaaccgggtcaccaccgccacctgcctctaacgccgcactacccctactcgggtgatgagactcgggaacaggagcgagggaggagagggaggaaggaaagccccaccaccaccatccttgcagcagtcgagggtgcgcttttcaggcaacgacgaggcggagaagctggtggcggcggtgcttagggttaggaagaggaagaggaaaagttaaaagaacctcacaatgcgtacctataaatgtatcatgataaattaccatgccattttaggatgaaaaacacaaaagataaggtttgtaatgtcggttgtctttccaaactccccgcatttgcctttgtctgtgttttcctcggtgaattaccatgggagttctctaaacgatggctagccaaaaaagaaaaaaaatgattatttcagcggttgtaaattccaattcaattgtttagtgatttaaacaattcaattgtaactttaaaaaataatttttctgttttccgttaccatgttttataactgctaaacggtatatttttttaagtaaagttttctatataaaaatttctttaaaaataaatttatttttcaaatttataataattaatatccgattaatcatgagctaatgtcataccattgaaaattgatacttcctcatcccaaaatattacaatttactactccctccgtcccaagataaatgtagttttgtacggttcgtatccaactttatcggttcattttagaaatttttatatgattagtatttgtattgttagtagatgataaaacagaaatattacctgatgtgtgactattttttttaattttttaataatttttttaaataagacggacaattagacgttggacacagatactcacggttacacttatttttaggacggaggtaccccgtgacattttggaacggaagtagtactcgattagggtatgtctcgttccacgtgttacgcttacgtaccgaaaatcttaccccaactgtcctcatctgaattcatacgcgagctcatttgatcaccacagatgtccgctgcagtctgtctgcatcatacacacagggcgtccctcagtggatgcactcactagaattaatcctctcatcaatttaatggcctataaaattagtaatatatacatcctggaatcggcagctgcaactagctaggagaatactgaatacccgataagagggaatgtaattttcactctcatttctgtcaggaatatatatatccatttattttattcaccgaatgctccaagcacaaggttgctagtagtctcccatttcagcaacttgtagtgcagatccctcactgttcaccattggttgggatctggcaatctctgctgcatgcagatgcggtaaaacaggtgaaaacgtaccgtcgtcgtgtgggctcccggcaacactaggacccactataaaagcgacccataggcaattaattataaggtagcaattgctgtgtatggttcatatggctcaaattacgggcctgctcacttttgatgtcaaaaaaaccttactaaaatttggcattgctaaaattttggcaacttactaaaattttggcaggatttcttatatagttaccaaaatttagcagcaaactaaatgtagccacttttttaggtaactttaccaaaatttggtaagattaaaaatggtatcaaagtgaacaggccctacaatgcagttttgtgtgtgtgcgcgtgtgtgcgtgtgtgtctatatatataaccggttttgagcctgtatcttttttttgcggaacctataatataaagttattcccagtgaccccacgagcggtgggacccacatgtcagttaccacgttcctctgactttacatcagaggatctcaatcccttttacacatgttacccagatggtggctacataggtgaatctcacaaaatcttactaagagagatgtacaagcttgtagcgtaagtgtgtccaccatgataaaccacaccattaatattatttaatattattgtagattttacaaaactacacatctaaggttgggtatcttaattaataaaactacagattttaagaatatataatatcttaaaactaaagatttattagcatatgaatatctcaaactacagattttcgatcgaggtttcgtcctaacattatttttccgcatggagcctttaaaatctgtagattaatttgtgacaataccagtgctaaatatctatagtttgagacattgtggatggaatttataacactaaatctatagttttacgggagttatgttaccctagaagtgatatattataataggacataaaggaatatctatttttctccatacatgggcttgcaacctttgaaaaattagggagacgcaaaagctacgaatattttgtaaagctagttgagtatatagcatcctccggataatgattagtgacatcaagaatatacgtggcttgcagctacgaaaaggcctgggagtgttcccctcaaaataaagttagaagattttccaataaaagatcatatgcctgggatcccttttgttttctccctagaaatgattctgattccctacattgcatgtgctttgctgtatgtgcagattgagacaggtgcaaccgtgcaaggtgatctagtcactacaagaagctcaagtagctctgatagacaaaaaccactactgcaggaaagatcataggtgccagttcgaagaccctcataggtgctggtttcgagcccggtaccaattacccaagacattggtgccgattactgaaccgacacctatgggcattataggaacgaaccggcacctatagtgatctcggggatgacctggatgctttataggtgctggttattgataggaaccagcacctataataccatataggtgccaattctatggtttttttttgctggcacctacaatgccacatgggtgccggaat

SEQ ID NO: 8373 - DNA, 1393 bp, Oryza sativa
ctctatatgcgggttaaataaacctaacattttttttctaatatcgcctccttcaagcatccactctagtccggtctccaaaaaaggatcatattgcatgcctacaaaaggttgagtgggtcttgctccttgcaccaatgcatgtttgcttcgcccacttccagtagtgaatatagaaaatgtttagagcttagacaaataaattaaagttagtattgctatagggattctatcttctatcctcctaataacataaaattttaatggagcatccgctgacaagtccgaatggctgcctaggactgccaggtcttgaatccgcctatgctcactcatctttccccgttgccgtcatccacttgcagcaacccttgcctaggttgttagcatctcctctccataatttcgcaatggtagagcggctggtatcggatccgtttaaatatcgtcttgtgtatgattgactatatatttctggttcttgcttcttgttcctatgacaaaatcataatttctaaaatttccgatgatgttgcttaattagtttttgggttttgtttctggatattctgatgatgttttctatttttctccctttttttattgagatgagttatctaatccttccctttacaaacatcacagaggaacccaagatttgattatgatcttatatatatgccaccttcaaaatccagtcagaaattttacttctcaaggctttgctcaattgctccccttttctcaatattaggcctaaagatgatcaataaactctcaggtgtaacatatatttatgctctcacgcaccgtacgtgctgatatcagggatgacgtatgtatatattcatgtacatacacgtacggactgttatttttaattgtccactagctagtagtttagtactacactccagtaattttatatcccatcagcgcggtgatctgtaggaaacttaatcagggacggcatcgtgatcagtacggacacaaacgcgagacgataagctatcgccatcacattcaattcatgtaatgtcaactccttcagtacggaaactaataataacgacgattcttggatgttacatataggcttaaaataagctgatctactatcgggtcattggtaacagtataattaaacatttgtacatatattatagtactgacgacacagctcgagaaaatgtttgcaagaataataataattgatctgatcggtagtgcattggtgtgtacatgctgcccatcagctatcagacgggccacacatgttcaatgacagaaaccatgtggtggaacatggatcccaacaatgatcagtgcaatcagatcacaacttgtcctaaggttaattagttagatggtgtatatgtgtatatacatatag

SEQ ID NO: 8374 - DNA, 1144 bp, Oryza sativa
gttacaatgttagctaaaatgagtcgctacagaacaccgatgccaaaatatgtataaaaaaatcccacaccgttgtacaaattaccgtaaatttaccgtttacggcaattttcaattgtatcaagaaaattttctttggtagggacggaaacaaaagtagtgcacctattacactttaaaagttaaaaaaataaaggtaaaatcatgtaaaatatactaattaatccttatagttaggaagattgtgattctgccattgttctttttttttggatattgtgccccatttttctttaaaggtgaccatatttggactggttttattctctcttttttggactggttttattctcctttttttggaatggttttattctccttttttggacttttcatatgtcatacaatttaatgtctctagaaaatgtctctaccattttatagacattttataaaatatcttttcgtttatagaggcaattcaccataagacacttattagacatttttttaaaatgcctttatagtattgtaaaggtatttgaaaagcatatctatagttataaaaaagtctctataaagcatttttcttgtagtgttatatcaacacgtatatatacttgtatttgtgattaattatttttttaagtaatagatgatgtacctaaataacgatgtatctgtgatctgtgatgaagtttaatattaagatacaatctttccattgtgtttattggagttatgcatgtactgatgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaatgggggttgtgggaacaaatcctctcacacgtgtgcgagcacttttttccttccgcacttgcacaaatcttgaaacaaatctaacagttcaaaattacgtgaaagttacatacaagttaaatattgtagttacatgtaagttatagcgtaataatatgtaagtttcaatctaatta

SEQ ID NO: 8375 - DNA, 670 bp, Oryza sativa
gcttgctgtggaactattgtttgattctggcagcaaagatgaattcttttgaatatgagattgtataatttattaggttgaatctgagatgaactattgtttgaattttgttgtattctgattgtatctgttattatttggatctgagatggtatttgtcattaggtttgaatctaagatgttatgagaaatttgattgaatttggtgggctcaaatttaatgggcttgtttagtgggctttgatctgatagttgggttgacaaaatgggctagttttgaaatgggcctagttctgaaatggacctattttaaaatgggacagttaaaaaaaattgatgggccgtcaaaaaaataatgggccatataaaaaaattgctgatgtcagatgccacatcatcagtgacacatcattgcacacgtgtcaaaatgaccacgtcacttgccatgttggttgctaggtggcaaccatctgtgacgtttatttttgtcacaaaggttgggcctcggctagaactacactggcccataagcgttttatgacggttaaaaaacgtcatagattgtgctgatccgtgacaatttccgagaaaacgtcagacagatttaatctgtgaccctcaatagatgacgataagtataatcggcacagacatttcctgtgacgaattt

SEQ ID NO: 8376 - DNA, 2197 bp, Oryza sativa
tgtggccagatcaataacgatcaagacagacgaaaaaattgacggaagtgctaaaaatgggaacagggtgaactttggatgctattaaagtgaaccggtaactttcggtgctataaaaccaaaaacgtgaactttcgatgctatataaccaattttttcaaataaaaaaaacgaatgacataaaaacccatatgaaagatataatatatttgcaaatatgaaatattattaaaatattttcatgtaatgtataaaacattaagttattacatctgaaacattataaaatacaaattggaacattgaaaaaacaatatgtgcaacatttacagatgtattagtgaaacatagcgtactagtactagttgacacatttaaaagaataaaaaatattttttcatcagaatatagtcatgtgtgattttgttctaaagatttaattgcaacaagtttaatagtgtaatcggattgtaaattggagaagtgatttaagaaaaaagatcatttaaatataaaaatgtatacgtgcatcggtgatctggtaaagtgctctacatagagcaagggagtagtaaagtgctttgcatggaggcaaggcagtggatagaagcatacatgtgatgagataatgttatgtccgatatttcgctggagcgtcggacagccgacgcgaagcattttcccttttttatcttcggcttttttcggttttttccatctgctggttttttactctctttttccagtttttttatcctcttttttttcgttgccatccttttttttttcgcacgcagaagggtatgcgtggggtaaggatttgttttttttatatgccatgttttttcttgcgcggccaaagcctagcgtgtccccatgcgttccctccaattgattgtaaaaatcgattccccacagctcccttgccattttcccccataattttcccttctaattccactttaattcatcaaatttaatctccatttaaaagccatcgtttttatcctgagttttgcaaattcgctccgattttgataaaaacagaaaaaggagatcaagtgtataaaaggagatcaaccaattttaaaacatcgagaataattcgaccgaatttgatgagaatgattcattcaaccagatttgatgagtaggattcgaccggatttgattggaatgatcggttttggcatcatacggacactacaagaatctatttaatctgtgatgaaatttgacgaaatttccatgatgttttcataaatcgtcacggatatgcaactatggatacaaggcccataataccgtgatagtttatcgatttcgtcataaaccggcccacaacctgtgacgttatagcaatttcgtcacgatttaaatacttcaaaaccatataagagaaatgtaaattttgtgaacaatgttactatcactttatcggttgaagaaatgactaaaataaaagttcggttgaaaatgttgtttgcaggttgtcataatttgaaattcaaattcaaattattgaaacagagtaatataccaaaatgaccaaaacaaaagttgtagatactgatgatttatacaactttgttgttgatgacttttttagttgaaatcatttagtatttgaaaatattgtttgaaattgtcataatttgaaattcaaattcaaattattgaagcagagtcatatagcaaaatgaccaaaacaaaagttatagatcttgatgagttatacaactttgatattgatgaccttccagttgaaatcatttagtatttggaaatgttgtttgaagttgtcataattttaaattaaaattcaaattattgaaacagagtcatatagcaaaatgaccaaaataaaagttgtagatattgatgatttatataactttgttgttgatgactttttctgttgaaatcatttattatttgaaaatgttgtttgaatttgacataatttgaaattcaaattcaaattattgaaatagagtcatatagaaaaatgatcaacacaaaagttgtagatattgatgatttatacaattttgttcatgatgactttttcagttgaaatcgtttagtatttgaaaattttgtttgaagttgtcatattttgaaattcaaattttatataggtcaattaaactcggatggagaaataaccaaaataaaatttgtagacctaaataat

SEQ ID NO: 8377 - DNA, 4083 bp, Oryza sativa
ctaaacaaacttatgtggaagcgttgtcaaaaacaaagttgtataacttattgagatctacctattttattttggttatttctccatccgagtttgattgacctatataaaatttgacttttaaattatgacaaattcaaataacatttttaaatactaaatgatttcaactgagaaagtcatcaacaacaaatttatataactcatcaatatctacaacttttgttttggtcattttaccatatgactttgttttggtaatttgaatttgaatttcaaattatgtcaactttaaacaacattttgagatactaaatgatttcaactgaaaaagtcatcaacaacaaagttgtataactcatcaatatctataacttttagttttgtcattttttcatccgataaaataatgataatattgttcacaaaatttacatatctctgttatggtttataaattatataagaggtatatacattttgtaaacaatgttacaaatcactttgccggatgaagaaatgacccaaataaaagttatagatcttgatgtgttatacaacttttatattgatgactttttaaattgaaatcatttagtatttgaaaatattatttgaagttgtcataatttaaaattcaaattcaaatttttgaaacaaagtcatatgcaaaaatgaccaaaacaaaagttgtacatcttgataagttatacaactttattgttgatgactttttcagttgaaatcatttagtatttaatttttttttttaaatttatcataatttgaaattcaaatattatatagttcaatcaaacttggatggagaaatgaccaaaagaaaaatggtagatctaaatgagttctacgactttgtattttacaactttttcatacgagttgatttagtgccataaaaatcgattcaaaatttccaatgaaaattgaaaattttccctccgcaacccttcaaaatttttcatctttcctctcccctctctctctctctcccccctctgatatttcccccttctcactctttttcttactctctcaccctctcttctcttcctctctcggcgccgagcacgagtgggcggcgtgcgcgtgccggcggctggcggccgccgcgtcgtccccgtcgctcgggctgccccctccgcggcggcgccgaccccgacgatgagtgggcggcgacgacaacgagtgggcgacgacgacgacgacgacgcgggtggtggcggcggcgccgaccccgacgacgacgacgagtgggcggcgatgcgggcctcgtccctcccggatccgacggcgggagcggggccggccggcggcggaagcggggaatccggcggcggcgcggaaaatccagctcaggcgcggcgacgacgacctcggcgacgacaacggcggcgggcggtgagtgctcctctcctcttcccctctcgtctcttctatgcctgcaaggacggtgcctcatcgccgttgtcgccatagtaccgctgactggcacccccctttcccctctccccatggtgtcatcctctccgatacggccccttcctcttcttcatcggatggggtgaggtgctcagcggcggcaacgagctcgacctcggtaggctgggcaacgatgtagacctcggtagcagcgcggattgagctggaggaagggggcttgctcaattcgatttcccgggagggtgatggggtgcttgccagatgagtgggggtgtgtgagtggcactgcgacgaagctggtgcctagctatgatcgagtgaaaatttatattagttcaaaccagttttttgggttaatactttctctggtagtacaagcattaagattcgatggaaatatcaggtgttgattcagatttcacctttgcatgcaatctatttctaattttctacttctgtgttagtaaaacttatataagtgatattaccatttacttgcaacaatctatcagtgtcagacctgaaattgttcaaacttggctcttcagttccagctgcacaatttttttgtatgggctttactgatgatgtactcaggtgacacaatcgtacgatggttaaaaaaaggcctaggttatgatgttagacagttcataataagataagggaatttggtaggagtacaatttactctgcaagaaacagagaatttatgcttgttaatccctgtagatcattgagccatcactttgttttacagcagtagctttgctcaagaaaatgtttgccttttactgaaagtttttttgtcctcgcagtgcgaccatcatcactgtcaacatgcccttgtcgggtgcatggctgaggccatctgcatatgctccatgaactcaagctctgtctgtctctggtacgggatggatgttgctggtcaaggtagggctgatggtaagggaggttggagccagctgaggtaagtgcctgttctctgaagccctgacttcactttgttcactattcaagatggaacaactgggttaacatattacctctcttctgaaaatcttagcagaatactcaggtttctggtacatgtttcgtagagtaattttacttcattgcttatgctacccttcacttgttcataattttgcatctcaagcttgtacgaaagtctgaatgtcatttgtttgcatctcaagcttccccaaattacctacactgagatatcacaaatcagtttcagtatttttcagctagaagtaaaagatgcagatcgtctatgttttctttcatcatactagctgttgtacgatggtctgaatgtcatttgttcttctgtcggtgctactgttgaagtatggatgctaccgaatctatattatgttccatgattttttttcctaaattatgtgcatgttgtaaatgtttagtacaattcaggagcagagaaactggctgaacagttaaattaaaaaatatataaatttgctgttatttattattctacccaacagttagaattacgcaattataattacagtcactgcaaaaaactaaactggccaatctataattacgcacagcaaagccgtgcgaccttcctagttagtacgggttacttctgaatatttcagtgctgtttttatactctcagctgctatactactaggtgtccattgcagcattttgactgatctgtgtttcccttttttacctttctgttttccttttttacctttcagttgaaatatttctcaaggcagctgggtacttagagtgtgctatccagcacgctctcccgaagatatcgcctgaaaaaaggtggtgtgcttgccctctcattgttggatgaacagcgttccatttgtaattagtgctccataccacgctgaccaacacacggccgcgagagaagaggcaaaccacgcgatcagcaccacactttcttcattcaattgagctataaaatctttccataactcaaagaaaagacgcctaaaaatcattcgggtctcttggtatccttattgttactaactgccattttgtgtaggaaaggtcttcctgtggacctaactgaaggaatcctgaaagctatctgcatgcaagctcagggtcaagtaaagcctttctccctctgcctccttttttttctaggtgaatctttctttcaaacagctagaaatcacatgactcatgtaaatagcagttgaaatgtccatttctcataacatcatagtaatatgatataatccaaattcataactttgcgtacatgctagtttttgtggcttttatgtctgaagaacatctggaattgcaatagatggaatcattctttctgctttgaaagttgcagtccacatttagatcttttttagatcttacagcatgtatattagtgaaaaatgtgaaagaattgaaaaaaaactgcaatcttccattctttgagaatgaactctcattttgcactccatttgctaaaagaatcttttgtttactttgcagatatggaagatcaatttctcaaatagcttggttttgctacacaaatttttgttgcttgctgtggaactattgtttgattctggaagcagagatgaattcttttgaatatga

SEQ ID NO: 8378 - DNA, 10999 bp, Oryza sativa
  unsure (1)..(10999): unsure at all n locations
caaccatctgtgacgtttaatttcgtcacaaaggttgggcctcggctagactacactggcccataagcgttttatgacggttaaaaaacgtcatagattgtgctgatccgtgacaatttcggagaaaacgtcagacagatttaatctgtgacgctcaatagatgacgataagtataatcgtcacagacatttcctgtgacgaattttcagtgatccatgacgaattttttcgttatagattaaatagattcttgtagtgggacaaatgtcctccttgggttgatgacggcatcgtacggcagtcgcgtatgtaaagatggacttacagctccactcgtcagttgggtcaaagagagatggaccaaacaacgagctggacctacagctacactcgtcagttgggtcaaaaagagacggaccaaacagcgagttggacctacatctatatttgtgggttgggtcaaagagagacggaccaagcagagaaaggtagcgggctgggctgggacttaaaattagcttaatgtacaaaacaaaagagtaaaaatgtacagcgattcaaaaatgtttttacccgttgcgttgcaacggatattttttctagtataaataaaaaatggagagaaattgacagggtaattaccgatcgttgcctttctcctcacaggacctcacccagtatacataactatatatggcagtagaaatcatgataccggtaattacgcaagttacgcatcatgtttccttcaaaaaagaattcgcgaaggatgagctatatatgtgtcgcgtcttcctcccgccccatttttggaaacacttgcactaattattactcctcgatcgcgtcctccatcgtcattcgcattgcagtgcatctacggcgtcgaggttttgaggcgcaaagcgcgacgcggagagcagcacagagagaaggagaaggccgcgcaggagggcgatggtgaggtcgcgtgggaggccgagcctggggaggcagaggatcgagatccgccgcatcgacaacagcgggcggcggcaggtgaccttctccaagcgccgcaacgggctcttcaagaaggcgtccgagctgtccacgctctgcggcgcctccgtcgccgtcgtcgccttctcctccgccggcaacgtcttcgccttcggtcaacccaccgtcgacgccgtcgtccgccgcttcgacccgctccacgccgacggcgccgaccccgcccccgcggccgtcgaagacggcggcggcggcggcgacgacgtcgtcgtcgcagaccccgaggagctggatgcgttgaggcgcgcggaggagcagaccaaggcgcaggtggcggcggagcaggcgcggatgcgcgacgtcggggacaaggtcacgcaggccatggcggggagggccctctggtgggaggcggacgtcgaggcgctcggggaggcggagctgccggagttcgtcagggcgctcgagcggctcagggacagcgtccaccgccacgccagcacgctggcctccacagccacgccgctgccgccgccgccggagcaggaagaaaaagttcctgagctagacgtctcggattattccttttaggtgtgttactatcgcatgctgttaaaacctcattagcggcgccgctggttaattaattaattgcatgtgggtttagggtttcgatgctccgttttgttcatagaagcagctagtagtaaattttgcatgatcgaagactcaaagtgagctaaagcctaaagcttgtccttatttacccataaaatgtttttcttaattagcttgcttgatgccatgaatggtttgataaaaaaaaacattgttatgcatttgtgcttgctggtgcttgtatttataaatgaatgaattgttaacattagtagttataattatggtgcgggtgcagatgagtaactcaaaaaaatcattgatcactaatttgcaattaacttgtacttataattactttcttgcctgccagttgttactccctccaatttttttgtgacgtttttgtaaccaacatccacacatgaggaaacagaggtagtacttcgtgcaggtgcagttgaaaataattgtcgtttcgggcaataacattatctccaaaaattaactttggccactattttttattacaatataaagagaaatatcaacaaataattttattacatgtagtttccatttttctatgcaaatatattagaagttattcatagtcaaagtaattaaagtttgatatcaatcttgtctagaactatagttatttggaaaaagtacgaattaccccctgaacaatcacggtcgaccgaattacccctctaaacttgaaaaaccagactttcaataccggacaaaacaccaccctgagcactgttgcaagcggtttagggttcaaatagcacacgtggcagtccagtcatctgtttttttaaaaaagaatcgctagggcccactagtcagaatcctcacccatctctcttctccatcccttctaaggaagcgcgcggcggccggcctgagagcgcaacgcaacgggcgctcttctccctcctcttctgaagcgtgcggcggcggagggagacggggcaacacagcacggcggcctgaccgacggcggcatggaggcggaggcaagggcggcgcgtgccggcagcggcatgaaggcgaaggcgagggcggcgcggcgagcgcgcggaggacgcggcggcggtcggagtaaccgggcacgaggacaacaaggatgggcggcaaactcgtcgtcgtagcctgccgcctccaatgtcctcggcgccacccgcctgctgctcctcgccctcacctctgcacggagacggaacacgggagtactagtagtttttaatcaaacaaacccagtatgtatgcacgacacctgaagcaattaatctctctgccataaaatcaagaacagataggcgttcatccgtagttgagacttgagaggaagttgatttagccaattttatcacaccataaacatatcactgtccatgctagcttgtatccagtctcggtacggtctacgtacggtgtgaggtcgtcgtggtggcaaggaggtgatgagagcgaccgatctagcgccggggatgaatccacagtgtatggacctctatcaggtggtaccgatgactttcaacaaaacctatgcttaaattgcttatccatatattatgacattatgatccaagtataattagtatactatgacaccgctaaacatttgacaccaacgaactaattttctgaatcctccattctggcgcagaggcagttgaggagacaagcgatgagcagggtggatccgagccgagccgttcccatggatatggcgacggagtggatccccactgctcctactccttgctccaaggcggcattggccggtgagctctagggccggcgcacatcaaggcaccacacgggccggcaagctacgggattggcccagagctcacctctcctctacgagtgtcgtccccctccagtctcccgaattttttacattttggtcctttttaaaaatttattttacgaatagacctttggaaaaacatattgcaggaatggtcttttttggtgcgctagagaggctggcgtcgtcctccatcatggcggcgccagccaccctggtgccgtcaccatgccagtgcggcactagggcacgtggttgggctgacgtggcaaagaggggcgccaaccacactggcaccgttccacatatcacggcgccagccgtgctggcgcactcccccaaggtgggccaccccttaacctgcacgggccccacccactctctcctccccccactcatttttgccaagcccccagcccgagcacacagagaagcccttctccctatctctcccccctcacctctactcatcaaatacactcaatttgaagtcgtttttcgcaggatttttttgtggaaatcgaagagaaagagaaaggtatactcctcaattccaatctttttttaattttaatcggttgaatttgtagattggagggtaaccctagaactttttttttgcctaaatttatgattttcaacatccattcttgggatttgcttattatagtgatacatgtgtgcaatgtactcggtagtgccatgattttttgaactatatatgtggtaatgtggatttttaaatggttttgttggatggatggatggatagatggaggcattaaagaattattaatttgatggactagaggctttaggttaaatttttaggtatgaattatatgttcacttagatcttccgaaaaatgttcacttaagatcaagctcctcttgtacttatatgttcacttagatcattaccgcaacgtctctttgatggtcatgtctcccctcttctttccttacccatacaagtcttcccgctttccttacccatccaagccttctcatacttatatgttcacttagatcactaccgcaacatcttctttccttacccatacaagtcttctcgctttccttacccatccaagccttctcatacttatatgttcacttagatcactacnnnnnnnnnnnnnnnnnnnnnnngtctcccattttctttccttgcccatccaagtcttctcgctttccttgtccatccaagccttctcataccaactcttttaccaaatcaaagtaaatttaccattccaactgacctagcatatttaatatatacttatgcccttacaacatcgtacctcctataaaaacgaatctccacatttatcctcgatccattcaagaacttctttcactcgtgaccttaattagttatatagagttgggtgggtgggaaacgaaaacctcctataaaaacgaatctccacattatcgtcgatccattctagaacttctttcactcgtgaccttaattagttatatagagttgggtgggaaacgaaatggtcttcaatgacatatccttaaactcaacatgtgtaccaacgtaaggtttcatcactctaccaccatagtaaacatgaacaattctatccatctacaccaaagaataaaatgtggctttacaactaaaattacatcttccttcctaaacgtagttcaaactaacatattataaccaatgcataacttagattgtcccaaagctactacttcacgaaaaatatttaatccacatccaaaagtaccaacaactttactagtgcattaaacatcaaaatattacaaatactccatcatacaacccaacttagttctaattaactttaataaatttctataatgctaccaaattcgcctccccttcatataattcaaacctaaaaatttaacttaaagcctctggtccatcaaattaataagtcattaatgcctaagtctattttttcatccatccatccaacaaaaccatctaaaaatccccattaccacaaatatagttaaaaaaattgtggcactaccaagtacattgcacacatatatcactataatgagcaaatccaaagaacgaatgttgaaaaccacaaatttgggataccctccgaacgaatgttgaaaaccacaaatttgggataccctccgatctagggaggactttagtctacttagagctgtcaccacctccacacccacctcaaacatactgtgagagatgaagcaaacaccgaaaattaactacccagaaactacgtctatgtagttaataactactttagtgtttataactcactaaagcaatcactatattttaatggactatagtgaacaatgatcccgtacattgattaggaactaaccaagagataactctcatagaataaatcttaattacttaaaatgatattcgattaaagcagagtaattaacagagtaaaacaaataagaagaggattgccgacaactccggaattcctctgacttcctctactctactctactctctacctaatctagtatacaataaagtacaatagagcctcttataattcagcttatgctttggtgtgtgtgagaatgaaggaggagaggggtatttatagtgtggaggtgacttgagagagtggagatgctaaggaatattctccatagaatccaaagagcatcttccttctccctttgccatgtatcccttctgatgacagtttcaaccggtattaacggccacaaccgtcataggattatgataactatcagctggtgaaaaatgggcctggttgggccagctggtggtttggccgaaccaggggttcattcgaacctgactggccattcagcccagctccttctctggtgttatgacatgtaggtcccactatatgtttgttgacagttgttaagtaccaaattaacgtcgtcaatacctgcataagaccataaatatgaaacatccaacatagtggtagggtttatttcaaacaatttccacgagtgttggtgtatattcgtatgcaggtgacaaactacctaagttgagaggaaatatacatgaaggaggagaagaatcaaactcatatccgaacttaaggagttttggacccaacaacccaatcaaagacctccaaatgggccaaacattcatacgaacggattgaggggcccaaaatgaatgtccaggccaaaaaccggagtgaatggagccgtctcgggttcggccaaaccctcagtgaggccgttggctctgcctaagtccagttgggtagcaatccgcttcccaatgactgttatgaccgttttcaccggtagaaaccatcataagtatggatacttggcaacacaagagtgaagatgctctttggatgcttggaggatctccactctcccaaggcacttctccacctataaatacccctctcatcctcacttgtaaacacacaccaagatgtagagctgaattacaagaggctctaagtatactttaggttatttacatgttctatagtatacttggaatagggagatagtaaagtagaagaagttggaggaatcctctccttattcttgtactttgttaattactctggtttaatagaaatatcattctaagtaattgagatttgcttcgtgagaattattcttggttagttcctaattatatagtgattgctttagtgtttagctggcactagagtataattattaattgcgtagatgcggtgtctgggcaattaatttccagtggttgctgcgtatcccacagtacgttagaggtgggtttagaggtggtgacagccctcaagagcacttaagtcctccctgtccaggtacgtagtagagcgacatcagcgaacagcgggttgctagtgcttgaagtattgcgttaggattaaaattaagctttcctcagacattgtttctcactaggaaatcctctttaccctttgcccataaccgactaggatcctgggtatttccttgcggagcagatgtttgaaatttaacccgagtccctttaaatatattctatctatgcatggcaccccatacccagtcggatatatatgtcgtataggtatacgatgaaaacaccgagccgctcggcaaggctggtgagcgcgccgacgtgcaccggctcatgctccctcgcgatcctcttgacgtcgtagacgcggcgcacgaagatggaggccaccagccgcgtgaagccgtcgagctggccgggagctcgatcccttccggtgagcaacttgacggcgtaggccacgtggtagccgacagcgaacgtcgcctacgacgacggccgcgcccgccggatcaggccggagtcccagagcagccacgccgtagcctgtaccaatcgacgccgccgcgcggcagcctctggcgaagtcgacgccgcgggctcgcatcgcaggtgcgcgatggacctggcgtccctctggcgtggcaagtccaggttgccgacgtcgaagccgttcaggttggactcgaagacgaacgcctcgccgccgccatcgccagtgcggatggcgaggccgacctggatggccctgagcgcgtcgacgttcgccttgagcaccccgtaccgctgctcggcagtgagctgctcgaacggcctcggctcgccgccggggacggggcagccggggtattgcacgttaatataagcgcgacgtggcgggcgcgccgcgcgacggagcgtaggatgtcggactcggccttgaagttgtcctgccacaccgagtgcacggcggcggcgtccattaattgatgttaattagatccaagttaatttcgtagtccgttttgcactctgatctgaaccaatcggattaattggtttttgtacatgtacatgaagaactaagaaattatgatgggctatgagtaagggctcctttatagtaacaagaaagaaataatgaacgcactactacataaaacccttttccctcgtatttaaatatttcaattattattttttctatcatatataacttaatgtttcattcgttgatcaactgaaacatttggccgtccaattttttaagttatcagacgtccgatgtgtagttttctcctaatttagtttttccattgtaccgagcggacagccggacactatgctagtatcagttaaatacgggaaattatatctattgtaattttgagtttcaaactatttttggacaatgactgctttaagcgtggtagaatgttttgcttgttgtttacccatttgagccatatgatttgttcgccatacttattcgactatttttaaacacaagaaatctgtataaattatttcaatcctttttaaacacaggaaacccaagtttataacacgtctaactaatactacaatccttttttaaaaaaacatttcatgagcgtacctcatttggtaattgctcaagttatctagaccactttagaaaaagttatgcagtaaagcaagcaccatgagaacatttttgcattgcagagtttctattgctaataaaagagaacacagcaaatacgattcattacaattattgatgtgtaatcgagacatggaataacttgtgttaatacaaagttgcattgtctaaaagaaataatccatatatattcatctaacattgctactaagtaattaaaagaatggaattatattacatagaaaaaaaaaagcctaatcacatcggccgttaaaccgaagggcagaagcctcgaatcaccgcagatgatcgaaattgaaaaaaagatcaataagcgcggagcccacacatctgttggccgtgcatcgccacccgggcctcaccgaggcgctccctcaacgccttgaagcattgcagcgtcgagacggcgccggcgctggcgaccatcccatgttgggccgccaccggcaccacgccgatgcacgcggcgatctccctgagcgagaacccgcacgctgtgttcacctccgccgccagccgcttcacgtcgtagacgccctccccgagggtcccggtcgccatggtcgtgaaggcgtcgaggccggacgggagctcggcccccgtcaggatcttcatcaagtacccgacatggtacgcgccagtgaacgtcgcccatgacggccacgcttggagcaggccggagccgaggagcagcaaccggagcctgtgcggctcgacgccggcgcacgggagcctgccgaagtcgacgccgcggccccgtaggtgtgcgatggaggccgggtccctcaggtcagccgggttgttgatgtcgaagccccggagattgaactcgaatacaacgagctcgccgctgtcgccgtcgtcgtcgttggcacggatggcaaggccgacctgaatggggtggagctcgtcgatgttagccttgaccatgtcatagcgcttctcggcggtgagactcccgtactttttccggccactggtgcccgcttgggcgacggcgcatccggggtactgaacgctcaccgcgacgtggacagcgcgcggcgcgacggcgaggagctgggctgattcggcgtcaaagttgtcgtgccataccgagtggatggcggcgaagttcatggtcggcgctggggctgcggcggcggcgttcatggcgagcgcacgtgcacaaaccgaagcggcagcaagagttgggacacctgcaggtgggctggctactcggaagtctgcaaaaaaggttggagacaaagctagctaggcttggcgcacgatcgatcgaagacaagcggcggcggcgtggcagcgtggcgtctaaaatagttaatggagcacgggcgcaatgattgtgtcgtacgtgcaggctgctggacgtaacgtggggaatatatatagggaagatgtgttcaggtgacgtggtgcgcggccggccgcctgtccggaacagactcaggttggaagtcgcgtttatttcgttaattgacatggttgatgactttgattgtaattagatccaagtttcgtagtccgttttgcactctctgaaccagtcggattaaatggtttttgtacatgtacatgaggaactaaaaaaaataggacgcgactagactagggagcggccgttcgctgatttatgttttaatcatcaaccacttcatacacatataaatctctctttagcttaaaaaaaatacaatggtgcatttcttttttaacctatgtaatgacttatatcttttaaatcacatattatttttaaaatctatttgcatcattgtaccctgctcaaaatatgtgacaaaatgagatgcatgttgaatatattaaaaaacatattagtttaaaagtaatttatttaaattatagaagtaacttccctatagcatgaaaagtaattacattctgactgagttaaaataagaaactatgtggagtaaattcataagcaaagtgtagagaagattttcaagtaaatacatttataaaagtaaattcaataaagtctaaaggtaatttacataaatcataaaagtaactttgcacaaaatggaagtaaattgttacaacattagaagtgaattccttgtatggagaaaaata

SEQ ID NO: 8379 - DNA, 6007 bp, Oryza sativa
  unsure (1)..(6007): unsure at all n locations
caaaatatgtgacaaaatgagatgcatgttgaatatattaaaaaacatattagtttaaaagtaatttatttaaattatagaagtaacttccctatagcatgaaaagtaattacattctgactgagttaaaataagaaactatgtggagtaaattcataagcaaagtgtagagaagattttcaagtaaatacatttataaaagtaaattcaataaagtctaaaggtaatttacataaatcataaaagtaactttgcacaaaatggaagtaaattgttacaacattagaagtgaattccttgtatggagaaaaatatggtctatataataattaaatttaaagtccataaattatagaattgactaaaaccaataataaaaaataatcaacttacagcattatgaatgcataagaagtaatttaatcaaatctaaaagtaatttatatacggagtatatggtaaaagtaacttacatatataataaaagtaatttataaatataaatatttttttatcgtaatataatcatgtaagatcttgttgtgaagatttaattgcaacgaacacaatggtgtaatcagattgtaatggtgtaatcagattgtagatcggaaaagtaatttgaaagaaaactttacaagaaggggaaaaagatatgcatgtctaatagaaaaaggcatgcatgtgtagttggcttctccaccgttcccatgatcgaacggatatgacgcagcgtgcgtgattggacaaatctaagcagcgtcgtacgataagaatcgagaggcctcgtcgattagtttttgcgaaaaaattatgatgacttatgagtaagggctccttagtaaacacaacgaaattatgaatgcacttctaaatattatttttgctggcggccaaattaaaatatattttcgctggcggtcggcggtgcctccagtgaccaaaggccagtgaaaataatgcatattcactagcggctattcgaccgccaacgaaaatcgagtttcgcaagcagcatgctaaaacaaccactagcaaaaatactatcttcgttggttgtaagctaaagagaccaccagtgaaaacaatttttgggtaaaaaaaatgaaaatcggcaacgctggccgctacggccacatgcaccgccgggctccagccatcgctgacgtcgagagatctgtgacactgacgtcgccgaggccccgcagcctggcggtggcagatcagtgttccctatggcctagcggcgatggatctgtgctcctcaccatcgccttcccgacccgccgccaccttcccgagcaccgtcgctgagccgctgctgccactttcacactccccctctgccgtcgctgagctaacaccgccgagccccctccgctgctagcttcctgccgtccggtgatacttgaggaggggagtagaggagatggagagttgaggaggggagtagaggagagggagagagttgagggaggcagaggaggaaagaagactcaggatcgaaaggctaaggcaaagagagcgatgctctctagggatttaattatttaatttatatctcgattttatttgctcaggcggttctcctaagcattcgcaagtgaaaattgattttctctggtggttgtttaagtgggtcactagcgaaaatagctatattttttttgcgatctatgtaaccgaatcgccaccgaaaatcgattttcgccggtggttcatagccctccttgttacaatttcgctagcagttttcacgtatggccgctagagaaaaaaaataggttgatgtcatgaataatcgattttgtagtagtgacaatttttggaggatttaaatatcccaaaaatagaaatcctatcaggccattttggaacaaaggactaatccctaaaggttcctttgaaaatcatatgaaatgagcacctctttttgaaattttagaggaaaataaacatgggcgtgcacagctctacatgcagccagtgtcaactgccttgcccagtttttgcacaccgattgtcgaaacaaattttcggcaatatgaaaaggggtagcgcacgagacctaaaagtggatggatgcggagaaaaatgatttagacaggttcatgccctctcgatgagaggtaataccctactcctatttggggatttgaatccgccggggtgtagtattgatctgacgatcaggttgtctcatgccccctagagggcctcctgccccccttatataggatggggggcaagattacaagatagaaaccttaaccaatacggtatcggtttcctaaatctactttacaatcttatcaaaccagaactttaggccgttccataatatacagggaaacgtaatacccaagttatgatccgttacatatttcataaatataagtcatcccctatagctagtcggataaccatgccgtgtgggtatggggtacccataatctccacagtagcccctgagaccttcacagtcgaaaagataatcttctctcgaactagattactccaaagctgagtgcttcaatcatcttcgccatggtctccgaagtacttttaaatatgaagactgtggaaggctgaaaaataaagtcaggtgcatcgactagatgcacctaataggtgtagcccccgactatgtggttagctgaacaaactaagcatatagtcaaggaataaataatccaaccaaacgagtggttttgataattgtaatcaaccaagtgacttgatatcaatatatagcatatgcggtgtgaatctatgaataacatgatccgagtgatataccgactgttttgtaaaatatgatgagtgtaacctaaagttggctacatcattgaaaattcacatagcaaaacagctattaagaagcttgtatgttgtgaataaagaaattttcaaagtattgggcatacgccatgcgcacaatgctttaacagatgtgcttaagtccctagaagacacatggttccaccacacctggaaatatatggcatatgtgctataaaatccgagtaaataaactcataaaggatttaccaaccgcctagaaaatgaccaaaatatataatcagcctaagccataatattggtcaataaaagtgcacacttacgtggcaaaaagcaatgatattgtatccaatcaattgctttatgaacccaaacaacgccttgacttatataaaaaaagtcagcggggagctatataaagcattactgtttggcaccttttaaaatgcattgtaccaactcctaaaaagttgagtaactgcggtataaaaggattttatggtattgggcacataatcacgtgcacttttgcctaagcagaaagatgcctaagtcactaaaagaacgtgacaagccacacctgaaaatatgggctgcagacatattaagcctaggccaaaaaatatgccttcgacaccctttaaaggatgacgcatgtaacatgctcccgagtaataaatctttcgggtgatatagaccaagtgtagctcatatgaatagctcctgatctgagtgattatcctttatgggatgctccaaaatagatataacaattgaattctaacgggcgcaagtattcggttgataacccttacggggaataataaatagtccagtctttgagcatagaaaatagacccatgatcatcaaattcatgttgtatgtatccggaataagtccaaattgaaggtacggtacttgtgtttgagatagtaagcccctgagtatatagcttgtccttctgtcgtagtcacaattgtccattgatggtagctgacgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaacagttaggtcagccagcaatgaatatgaaagtgcccagcgataaagttgtttagccatagcagcgaaataatcagtcggtgacagatgatgcagctggtgaagaagatgaagatgcccattagtggcgacataataatccatccatgaaggcgagcataccggtcggtggtgacgaaaacaagccgacggtgaagatgtagacacgcatcaaaggcgatgacgaaatccaccaatcatgaagatgaagaaaatagtcggcgacgacaaacgcaaccgacagtaatgatgataagcagcaatcatagatgatcgactatgatgacgaagttgcccatcaaacagcagtagaatagggctatgttgaagaggcttgacaggatattgatgaagatgatgatgtcggtgatccagtcaatagcagtgtagcaaccgatgataatgacgaagacgctcatcagcgtttgcaaagtaggtcaaccgtgagggtgaaataacaagtcggcaatgacggaagcaaccggaggagaagacgtagtcatccattaacaacagcagagatgtcagggccgatgaggtagaggtgctggtgatgaagtcaatgacaataatccatcaaactgttgagaagatatcgaagctcgaataattttcttgatacgagcgtgtgcataatgaagactgatgcaacgccccttgatttatgaagatggctgtagaacttagtgctatagctgttgcagatgcttcacttagaggaaagtatatgctgttggtcaactcattgaatctgatctgagttaattggttgatgactccaaactcccagacatgtaaattaaatctcaaacttgagaaatttggagtagattgtagcggcatgaagaagccaaaattgccggtgtaataattggagttgctgaaattaaatgtcggctctgaagcgaagacgaagataataactccccgagttgacttgttgattgattgattgcttcatcttgacataaagcttgtcgaattttgagagtcttgtatttgtgtagcccccgactcttggttagttgagaaacaactgaacatagagtcgagaactgtagcttcttgtcgttgagtagtcattgcttgagtgaatatacgcatagaagatgtccgagtagaaatcttgaatattggaacaccacttgttgtagtaaaataacatggcattatacttgttgacgtatgctaaggtgtcgaaactcttgtagtcgtcatggttggtgaagtagcaaagcttgcgaagtagaggcaatagagtttgccgatgccgaagataataaaaatgaaattgctccaccatggtgacaaagttgcatagccgtgatgaagtgaacatgagtcggcggcaatagaagcaaaccggtagtgaagatgcgcaattgtgaagataaaagcaccagtcggtggcggcataaccagttggcgacggaagacgatgatgtccatcagtagtggtagcagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcggcggcggatgaggcggccggtcggtgaagacgtatacgcccaacaacggcggcataataggtcagccgtgcaggcggaaacaacagttggcgtcggacgaggcggccggtcggtgaagacgtagacgcccaacaacggcggcataataggtcagccgtgcaggcggaaacaccagtcggcggcggacgaggcggctggtcagtgaagacgtagacgcccaacaatggcggcataataggccagccgtgcaggcggaaacaccagtcggtggcggacgaggcggccggtcggtgaagtgcaggtggaaacaacagtcggcggtggacgaggcggccggtcggtgaagacgtagacgcccaacaacggtggcannnnnnnnnnnnnnnnnnnnnnnnnnnnnnnnnnnnnnnnnnnnnnnnnnnnnn

SEQ ID NO: 8380 - DNA, 5770 bp, Oryza sativa
ggtcggttaaaaggtaaacgcccaacaacggcggcataataggtcagccgtgcagccggaaacaccagtcgccggcgaactagtcgcccggtcggtgaagacgtagacgcccaacaacggcggcataataggtcagccgtgcaggcggaaacaatagtcggcggcgaacgaggcggctggtcggtgaagacgtagacgcccaacaacggcggcataataggccagccgtgcaggcggaaacaccagtcggcggcggacgaggcggccgatcggtgaagatgtagacgccagctgtgcaggcggtgacaccagtcggtggcggcgaaagcaaaccggcggtgatgttctgactgatccattcctagagcgtaagagataagcttaaagccatgaatcccttttatgcatatctggatttggatcctgcagaacaaacatataggatgagtagtatctgatataaatataatactcgaggaaaattcaagcattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagttcgtcattaatggaacaaagtttcacgggccggagtttattactcgggtacttttgcaattattaagagcagaaaataaattatcttatctctatgcttttgatttattccgaataatacttagcaccttgcgttattcggtccatctaacaaacccccgggtgctaggaatcggcccaaaggcaactatccattggcaaaccaaacggaaagcataggaagatgaaactccatcactcgataggcacttttgtactcagattatatcgcaagcaatcaagataaatattataaaaaatgtttaaaaaatatgatataacatctgtagcccccgactcactagtcaacggcgaaccagttgatgtagtgaggcaaaggaaaaggcaaaatatcatataaagaataaaataaatgatgacttagctttgtcgtattccctcggtgacagcagaagtagtcgatctaggaacaaagtcgtccatcaatggcgatgaaaacaccagccgtggaagcaacctaggcggttggcggtgaagtcgtagacgcccaacaacggcggcataagaggccagccgtgtaggcggaggcaccagtcggcggcaacggaggcaggccgacggtgaagtcgtagacgcctaacaacaacggcataacaggccagccgtgtaggcggaggcaccagtcggcggcaatggaggcaggccggcggggaagacgtggacgcccatgaacggtagtgtgaccaaccaaccgtataggcgaagacaccagtcggcggcgacggaggcaagccggccgatgaatacgtagacgcgcaacaacgacggcgtaataggccagccgtgtaggcggagacaccagtccacggcaacgaaggcaccaatccgtggtagcgaatgccacgtatgtacgtgtatataaaaataacagatcaaaaagtaattagagatctataaattaaatgactagaaaaatcaatagattaatctggtttacataaagaaaataaaaacgatagacctgatgaaggtttatgacccagactcttgatgcacgtatgttgtcggcattacatgtatcgacctggttagtctactgatcaaagaatttggaggtccacgtgtccttttgcatgtccaggaagcctcagtgatgagatttaataaggatatgtgtcctgtgtagcttgtcgtgctcctgcttgcatgcatatatgaacgtgggccggagcaaacttgaacaaactcatgttgctctttaattgtgcctgtatgcatgcatatcgacattcagcaggaaccgggcagacagcttctgtcttgtcgatcgaaaaaagaactcgcggcggtggaaattggcatcaaactcgccgagccgagattgatcttctggttagattgatccactcggtgtcgacgaagtaactcaaaattcacgggctgcgcagcatgctaccgatctcgaattcgatgaaaattatcttcccgactgagttgaatcttgaagcgaagacaacgccgataactcctaatattagttccatcacacttgtagacgggtaattcgacgccacccctacctggcgcgccaactgtcaaaacaaattttcggcaatatgaaaagggggtagcgcacgagacctaaaagtggatggatgcggagaaaaaggatttagataggttcagaccctctcgatgagaggtaataccctactcctgtttggggatttgaatccgccggggtgttgtattgatctgacgatcaggttgtctcatgccccctagagggcctcctgcccctcttatataggatggggggcaagattacaagatagaaaccttaaccaatacggtatcggtttcctaaatctactttacaatcttatcaaaccagaactttaggccgttccataatatacagggaaacgtaatacccaagtcatgatccgttacatatttcataaatataagtcgtctcctatagctagtcggataaccatgccgtgtgggtatggggtacccataatctccacaccgattgagattgtgagaattataagagagatagcatttgcacatcccccgcccacaaatccctcggcgccaccgcgttggggcggcatccgatgtcgtgcccccgcccaccccgacgtcgtctgctcctgtggggatcgatggcgcttcctccggctttggttctaggtcgtccgggaaaaggaaggggagggcccaagcttctccgaccagtggccgggaaggatgttctttatgtttgttcggtctattattttagtgtttttgaatgtttgttcagcttgtttatgtgttcttgggtgtatatgattttttgataccgattaatatattaatgaattctggtcagggtgaaggggagctgctcgagcattggctcgattttttttattcttagaccacctcaaatgtgtcgttcactgggtgccgtttagaaaatttggcattcatggatgtttcccaacaggtatctatagttgttcctgtagcagtgggtacctgtgtgtagtaccgtgtaacatgcatagtgattgctactagagagaattaagagatggtacctgtctatactacatgtagcgtgggacactgttgttctcattttcacggacctatgcttgaaaccaaggtatcatgtcctaaacctatgtgtactatatatatcggcacaatgatcccgcggctctatgcgtttccaatgagattcgcctcggcgatgttaaatttcgagcaaaataaggtccgaggtgtttctgatgacaatagcacttcaggtcacacgttggctgagtactatacctcagttttcgcgagcactctttctaatcaaaagctgctaaacttaattaataatgggcagcatttattaaaataaatgtaaaatttattttccaaattaataatatataatacttaatttatcatgagtcaattagccgttgaaaagtgtgcctggttaataagctcatccatgaactgagtctaatgggaccttagggcatggttctttttcaaggaatagaaaaatagattaacgtgacatgttacgtggagagtgcatttcaaactcttgagggaaaatcctattgttgtttccatgtcacttaaatacttatgaacaaaattgaaaagatgtattaacatataatatataacttcataaatatgcaacttaaaatttaacgtctctatatatcgcaatgaaaaaacaagtatgacatgtacaagttgaatgttgcatgtttgtggagtgatatatcatatgttaatatatcttcttaaacatttttttaatttctttcataacaactatttgagtgacacgaaaaaaaaagagacatcctctcgaatacattcccatgtaatgtgatcttgtaagtggtgtgattttcgacaaaacttggtatatctgagttcttaatttaaaaactattttaaatttaattttcaactttatttgcattagtacctcaaacaatgatcacaaaatcattcgtgtcattcagcttttcaagaaaaaaaaaagaaaacaaacaaaaggaagacaccgaagacggctcgaccgtaaaggcgaagcgatatattcagctgcagcagtggagcaaagagaaagaggagtgacactagctgctagagaaaacgttttttttttgtctggatatgacaaacggcatgtaagtctgcgtctgtaaaaatcaacccacattttcacatccggcttgttaagaagagtgcatgcaaaaatctatttttaaggcggatctcttaacaaaccgtatataaaaaaaataagcctattttcacatgcggtcctaagtagccacatgcaaaactctattttcgcgtgcggacgaataagtggttcgcatgtaaaaatactcccttttttttctatccttctctctctttccctcctaaccacttcaaaaattttcacccatctctctccctctcctgatattctcccctctcttaattctctcctcctccgaatccgtgtgggcagcagcaggtggcgacaccaacaaggaagccaaccgttctgtgtggcagcgggcggacggcgagggtgcgacggaggatccggcggcgccaccctcgggtgcggctgtggcttcgcgtcgatgggcggtgatggtgggcggcggatccggcggcgccgctctcggcggggcggtggggaggggggcggatccgtcgcccttcgatgaggctgtgacctcagcgacggcgggcggcgagagtgacggatccagcggcggccgctccccctatgcgtcgtggcggatctggcgccagcgatagcaatggcgggagtagcggcggggtgctcggccggcgctagcgaaagagcgggtggcggagggggttagggtttggttttttttttgaaattttattttttttcgtgatttgaaattttatcagtgtgtatgtttcaaacagttaaaacgtaatgtttcatacacaatagtaatatgttttaatatgtatcttcagtgtatttcacaaaatttatggaactaccagccactattctccctcctctctctccactccatgcttgcatgcattttagcaatgttcaaaataatttgtttttttaaactacttttccaatctgtgttccggtcgtactgttgtattcattgtaattacacattaacaataaggtattgcatattttgatggaaaaatatatgtttcaatctgctaacacttgttgttttatttgtgatagtgacatgtatcaacccgtgtttctgtttcacaaaatatttaaatatttaaattatgttttttcatcatatataacttaatgttttactcatggcaaattttgctacaggactctgcttatgtgtggttttagcactaggacactgcccaaactcacttttaggggaaaacactccataaacgtggtaatttgccagtagacaccgcgccgattaaaataatactttccggttgaagaggagagataaatcgcgtgaaatatcaaaaatgcccttgggcccacatgtcagctctatatcctatctctcttctcatctctctctatattctctctcactctcatagacg

SEQ ID NO: 8381 - DNA, 6960 bp, Oryza sativa
ccccatgcgcctctagtagtgagagagaatagagacatgagaagagagataggagatagagctgacatgtgggcccaagggcatttttgacatttcacgcgatttctctctcctcttcaaccggaaagtattattttaatcggcgcggtgtccactggcaaattaccatgtttatagagtgttttcccccaaaagtgggtttgagcagtgtcctagggctaaaaccatacataagcaatgtcctgtagcaaaatttgcctttactcattggtcaactgaaacatttgaccgctcgacttttttttaagttaacgggcttccgatgtagttttctcttaatttaattttttcgttggacagcacggacactatgctagtatccctaaaatacggtaaagtgcacccattgtaattttgagtttcaaactacttaggacaatgactgctttgagcgtggtaaatgttttgcttgttgtttacccctttgagccataggatttgtttgccgtacttattgactctttttaaacacaagaaatttgtattaagttatttcaatttccatatggttactctaaaatttccttttcccaaaagagacctagaatgtgaatgagtgcaaaccgctaaattatttggcaatatggattacaaacaaatccgttgtactgaaggttagtgataccgtctaactaatactataatcctttttttttcaaattccatgagtgtacctcatgtggtaattgctcaagttatctagaccactttagagaaagttgtgtagtgaagcaagcaccatgagaacatttttgcattgtagaatttctattgctaataaaagagaacacaacaaatacgagtcattacaattactgatgtgtcaatcgagacatggaataactagtgttaatacaaagtcgcattgtctaaaataatatatatatatatatatatatatatatatattcatctaacattgctactaagtaattaaaagaatggaattatttacatagaaaaaaagaactcctaatcacatcggcagtatccgaaggcaaatgacagcacggttaaactgaagggcagaagtctcgaatcgccgtagatgatcgaatttgaataaagatcaataaatccggagcccacacagctggtggctgtgcatcaccactcggacctcgccgaggcgctccctcaacgcctcaaagcattgcagcgtcgagacggtgtcggccccggtgactatcccttaggccaccgccggcaccacgccgagccacgtggcaatctccctgagcgaaaacctgctcgccgtgttgacctccgccgccaaccgcttcacgtcatagacgccctccccgagggtcgcggtcgccatggccgtgaaggcgtcgaggccggacgggacctcggcccccgtcaggatcttcatcaggtacccgatatggtatgcgccggtgaacgtcgcccacgacggccgcgtctgcagcaggccggagccaaggagcagcgaccggagcctatgcagctcgatgcgtgcatgcggaagcctgccaaagtcgacgccacggccccggaggtgcgcgatggaggccgggtcccttaggttggctgggttgttgatgtcgaaaccacagaggttgaactcgaacacgacgagctcgccgccaccgtcgtcggtgcggatggcgaggccgacctggatggggtggagctcgttgacgttagccttgaccatgtcgtagcgctcctcggtagtgagttgggcgtacttcctccggccaccggtgcccgcttgagcgacagcgcatccgggctactagacgctcaccgtgacgtggacggcgcgtggcgcgatggtgaggagccgggtagattcggtatcgaagttgccgtgccataccgagtggacgacggcggcgacggcattcgtggttggcactgggcagctgcggcagcgttcatggcgagcgcacgtgcaggcgggaggctactcgacatcagtaaaaaggttagagagaaagctatgtaggctcggctaggcagcaggttttgcataatgtagctataagaggtcgacaaggcggtgatcaagtcggattcgaaaacattgtcaacctaggcaacagacaacgagcaaagttctggttccactcggtttccgtcagggtttccaaaaccaccaggaccggggttaccgtgccccggcggtaagcacggttaccgcacggtaaccgtggtaactgtgaaaaaccgtacaaagccgtgcaaaatttatcaaaaatttaaattattttttaaatttatttaaatttaaggaggttaccgcggtatttatattaccgtatccccgcggtaagcccggtaactgcggttaccggcggtaagggaaaccctggtttccgtctccgtgtgcacatgtgtaaaccgttacaaacttatattgtttcagttacaattatggctatgtttagatccaaactttggatccaaaatttgcagccaatcattgggaagtgacatttcaaacttctaaatcggaatggggtgtttagttgactgcccaaaattcaaatgagggttcatagaagacaattgtacccctatttaatgcagcaacttgcatgtaacagcatacacaaaaattcaaatcagggttgcattcacacacattcctactgcatgcacacttctcagcagcatgcatgaccttacatgcaatccatgcacacatgcaaatcatacaaattaaaacagtccatacatatagttgcccttcaaaattacattacaactgttggttatcacatactgctagctgacatactattgctcataaattactacaccaacaaatgacagccacaacattgccttcacacatacatgtcctcacatattacaaacaacacatataaatcctcacatattgcagcagcacaaattattcctcccaagttacaacaacaattccatgtggtgacatgcaccacatggaaatacaagtctaaagagaattacagcatacaacacttgtgccgcaacattcccatgtctcatggtcgatgcaacaactcgagcgcaattgtatcgtgaaaagcattcatacgttcacattctaatagctaggagcctcatcttctggtggctgatcttcataggcctccggaggaacataattctcatctcggtcgcaacgaccaaagtgtctatccgttaaaccgctaagccttatgtaattatggagagctatgcaagctactatgatatgtgtttgagtttctgggggatacgaaggcacatatttcaatatgcgccacttctgcttgagcactccaaatgatcgctccatgacatttctcagggaggaatgtgcataattgaatacctcctctttaccttctggttctacggcgttttggaactcttggagatggtactttgtgcccttgtacggcgccaggtacccaatccggtttggataccacgagtccactagatagaacttccctgcagtggtaaacacttgtaagttacacgtgattacagttagacattggaaacatacaacaggtagctgtgtacctggaggtggatgagggaaaacatttttgtatctagtcattgcatcgttgaataccctcatgtcatgcacagaacccggccacccagcaaacacaaatgtaaaaatcatgtcaaagtcacaaaaggaatgtttctgaggcagcacatacctaacacaaatagcaccactaattgctaaacagacatagcttgctaaacatacataacacaaaaggcaccctaaacagcgctacatgaacatgtaaagcatgcataagaaggtctagctgtcgacccttgcgtagttctcaatgagggtcttcgttcctccaggattcgacagctcaaacacattaatgtctactgggtccttcaccatcttcaacataccaacccacagctttggggtctcatcagtgaccccgcactctctactcaatcccatgatacgctcggccacctcccgcacgcgtgccatctcatcatccttcttcttctcacgcctgcccaagtagttgtccatggctgctactttgtccttctgcaactcgttgtggaccttcaattcggacaccatggcgcgcaccactgggctcttcaactttttgctcggactagtagctgtactgcgcgtgcttggtgtgctcctcatgctgtgcgtcctcttcgtcccaacgcttaaggggcttaggggtccaagtcatcttcctcggagtcatcttcatcatcgctgtcaatgtcctcaatggggttggccggctgtgctgagggctaggtaggaacaaaggaagtcgagccgtccactgccacccccatgaacatgcggtccagttcgtccagatacttgggcatcccattcttcggcttcttcaactcagcatggttctgcaaaaatcacacaaagcggtcaggtgaaggacaattattgtggacaaaacatcagaatgaacaatgtaagcattgtaccttcgtgttgtcatcccaccacttgtcagaagccacaacggtgccatcaggccagcggcccaacccagtatatgtcctcaacttctgtatgaaggaccacatagttttcaaacccctatatctaaaattgaactgctcattgtcatggagcaacccagtgacagcgtaaaacccctttctgatctccttccaaccgaatttggtcatgcttccccttatgcagttgccgttttcaatttgcttgcaatacagctcgcaaaaaagtttcgtattttcattggtccactatgccctgtcgttcacttcctagaggcacaattaaactgacaaagcaatgaccttaccactaaacagaagtaagcagcggcatcggaatgaactatgtgatgactatgtgctgttagagtactataatcaagcgcaagtaatgttagagctctaaactcaatatgaagtttacagaacaataatcaatcggaactaaacataacacttgtaaacttatggtactttgcgaatccacacattgcacaaccaaaatatttacttacctctatgagccgacgccgtgcaccacaacccctgcctcggcctcgcgcctacgatgcggccggagcctgaggacggatgggaggcacgaagacgccttcgtggcctgcacctccaaatgaaggtggcattggcggttctaacccagcaccaatcgaatgcaggccgccgactcctggtgccgccatcggaccgccccatatccgcttgctccttgaccactggggcacccacgaaacccgaccgtgcggttcgcgctccgagacggacgtgtaagcccagagggcattggctgccctcccatccgccgccgcgaaggtcttggtagccatgcatggcggaccactcgtatgcggagttgaggtcgagcgtcctgaactcgagctgagaggggttttggctgctcgaagaccccttgccgaatcccccaaaggtgaaggacgtgtggccgccttcacgagaggggtgcagaggctgcgcgaggaagtctcgggtcgggatgccggcgccgaatctatgctcggcccagtagaggggcctggtgccgccgccgccgtagacacctccggtgttgtcggtgccgtaaccgccgacggtgctgccgtcgccgtacccgccaccgttatggctgtcgccgtagccgccaccgttgttgctgtcaccgtcgtacgcgtccatagccggttcgggtggtttccgccggatacgccactacggatgtggtggatctggaagagaaccccttggattcacccgggggaggatcgggaagatggagggagagtgacggcggcagagatacaaccctagggtttgcgcatgggaggagccgagggggaatggataggagcggcggcgtggatgcctcccacaggggtattacgggccactcatgccctaggctactgttgggccttcaatgtgtcaattggccaaattccaggtgcccacccgtttagttccaaagtgcagactgtggcctcgtgccagattttttttggcactttggccctatctaaacacggcctcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagtttgaaatgtcacttccttcattgactgcatttggatccaaagtttggatctaaacacagcctgaatccattttgcaattccgacaaacataccgaacaacacgaatatcatgaacaagggtttatcatgttttatcacggatatctacaggcagcttcagtagcagaaacgtagcattcagtcacgtttagatattttagatacaggcttcaagatagaatgaacatgaactggcatcactgaagcacacagcagcgaagccagcaaaccacccatcaagcagaacgaacattcagctgctaccgtcagtaggacgcgacgcagttgggtacacctgagaactcgcaaacccgacaaaagacgccacccttccgaatcgagtccccttgcgcaacttattctagttcttctttggcttcaccgggcccctgggtatcttgctcaaaaccttggcatccagcacctcatagtgcttgcaggcctcagagtgagcccttccagcaaagtggtcgac

SEQ ID NO: 8382 - DNA, 777 bp, Oryza sativa
caatgtgtcaattgccaaattccaggtgcccacccgtttagttccaaagtgcagactgtggcctcgtgccagattttttttggcactttggccctatctaaacacggcttcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagtttgaaatgtcacttccttcattgactgcatttggatccaaagtttggatctaaacacagcctgaatccattttgcaattccgacaaacataccgaacaacacgaatatcatgaacaagggtttatcatgttttatcacggatatctacaggcagcttcagtagcagaaacgtagcattcagtcacgtttagatattttagatacaggcttcaagatagaatgaacatgaactggcatcactgaagcacacagcagcgaagccagcaaaccacccatcaagcagaacgcacattcagctgcgaccgtcagtagcacggtacgcagttgggta

SEQ ID NO: 8383 - DNA, 398 bp, Oryza sativa
atgaacgccattgccaaatcggcaggtaaaataaaaccttgactaaatcatgttatttgccagatccataaaaatcctcgcagagttacaatgttagctaaaatgagtcgctacagaacaccgatgccaaaatatgtataaaaaaatcccacaccgttgtacaaattaccgtaaatttaccgtttacggcaattttcaattgtatcaagaaaattttctttggtagggacggaaacaaaagtagtgcacctattacactttaaaagttaaaaaaataaaggtaaaatcatgtaaaatatactaattaatccttatagttaggaagattgtgattctgccattgttctttttttttggatattgtgccccatttttctttaaaggtgaccatatttgga

SEQ ID NO: 8384 - DNA, 802 bp, Oryza sativa
gcattcataaatgttcgcctatgatgacgaagttgcccatcaacaaccagtagaatagggctatgttaaaaaggcttgaaagaatattgataaagatgccaatgtcggtgatccagtcaataccagtgtaccacccgatgataatgacgaagacgctcatcagcgtttgcaaagtaggtcacccgtgagggtgaaataacaagtcggcaatgacgaaagcacccgaagaagaagacgtagtcatccattaacaacagcagagatgtcagggccgatgaggtagaggtgctggtgatgaagtcaatgacaataatccatcaaactgttgagaagatatcgaagctcgaataattttcttgatacgagcgtgtgcataatgaagactgatgcaacgccccttgatttatgaagatggctgtagaacttagtgctatagctgttgcagatgcttcacttagaggaaagtatatgctgttggtcaactcattgaatctgatctgagttaattggttgatgactccaaactcccagacatgtaaattaaatctcaaacttgagaaatttggagtagattgtagcggcatgaagaagccaaaattgccggtgtaataattggagttgctgaaattaaatgtcggctctgaagcgaagacgaagataataactccccgagttgacttgttgattgattgattgcttcatcttgacataaagcttgtcgaattttgagagtcttgtatttgtgtagcccccgactcttggttagttgagaaacaactgaacatagagtcgagaactgtag

SEQ ID NO: 8385 - DNA, 1988 bp, Oryza sativa
aatgattctgatcccttccattgcatgtgttttgctgtatgtgcagattaagacaggtccaaccgtgcaaggtgatctagtcactacaagaagctcaagtagctctgatagacaaaaaccactactgcaggaaagatcataggtgccagttcgaagaccctcataggtgctggtttcgagcccggtaccaattacccaagacattggtgccgattactgaaccgacacctatgggcattataggaacgaaccggcacctatagtgatctcggggatgacctggatgctttataggtgctggttattgataggaaccagcacctataataccatataggtgccaattctatggtttttttttgctggcacctacaatgccacatgggtgccggaatcggcacctatattcctcaagaaaaaaaaatccttaaatacagaatattaatttcctgaaacaaagaatattacatattcacataaaatgcataatcacacgttagaaaaatacatcctgacgccgcagatatatgtagtccaaatgaactggaaatcctatgtcctaattaagtgggtaacacctacagacctactccttggttaagtgctacaaatgactggtggatttatggggatccctctcccactggtggatttatggggatccctctcccataaaagcttttcccttggccttttcttttggagccagaatggaaaaaagaaagtgcactgtagaaggtggcacaacagtgttgcatgatcaatgcacacttttagtggatgaagcaagctagctagctaggtgagttggggccaatattaatgcatgcagggtttgcctggttggttctccatcatctggggtatatggtatttgcataattgggttggaaagggatgctggctctggaaaggggtttaggcccattcagggaataacatgatgagcttgggttgaagggacagcaagctccctcaggagcttcagtggggacacataaatattcattattttttttctttttctttttatttttccaccgggagggtatgcgtttttgcaatcgaagagtctatgaataaaatcctcatcaaaacttagagaagcaccactagtggtagtcatgggtgcatgcctctaggatttaaatgttggtgctcaggattatcatgaacttgcaaatgcatttttaggaatttagtgagtgtagtgaattgctgcttttttcagtctttataagcacgtgttaggggtgtgtgcatttgtgttttccgtgtaatggtaagaaaaaaaaatcttccgaccatcatataccaggcaatcaaatcacttcatgccctctggtctagctagccctatcatgtaaaaatgtcattacgagctaacctccgtaagaccatctctatatgccggttcaaataaacctaaacattttctctctaatatcgcctccttcaagcatccactctagtgcggtctccaaaaaaggatcatattgcatgcctacaaaaggttgagtgggtcttgctccttgcaccaatgcatgtttgcttcgcccacttccagtagtggatatagaaaatgtttagagcttagacaaataaattaaagttagtattgctatagggattctatcttctatcctcctaattacataaaattttaatggagcatccgctgacaagtccgaatggctgcctaggactgccaggtcttgaatccgcctatgctcactcatctttccccgttgccgtcatccacttgcagcaacccttgcctaggttgttagcatctcctctccataatttcgcaatggtagagcggctggtatcggatccgtttaaatatcgtcttgtgtatgattgactatatatttctggttcttgcttcttgttcctatgacaaaatcataatttctaaaatttccgatgatgttgcttaattagtttttgggttttgtttctggatattctgatgatgttttcta

SEQ ID NO: 8386 - DNA, 1025 bp, Oryza sativa
atgtctggttttgtggttcaggagggtaattcgtactttttcccatattatttgtaacaaaccaagacatgcaacggccaaaatctttgcttagtttggctttgcaagcaaatcaaggtctcctttagaatgtatcctaaaatacaacaacttctccactaaaagcatcacaaacagcttcccaaaattatatcttaaaaattttggttataggaatcctaaacagatattaaaggtgttaaaattttcatcccaccacaagattgggtaaattagctttctaaaaaaaactaaaagtaggacccacgagaaaacttccaacggaaaaatcgtttctagttccctctctctctccccgctagatcaggccgcgagcgtgacccttgccggtcggccctcgccatgaccgcgtgcaaaagagcgacgtgagaagtattgggaacgaaaccgagccactagaagtggagaacgaaatatccaaagttgagaactcgattaattgggaacacttctgttgtatccgatttttgaacaaaaattcctaaattgcatatagggaatggaataaagaagctgttggtggtgctctaacatttttttttaaccaattatgaccctccactatttaatttcccatctactttcacttatcatctaatcataacatgctctctcatttaattatacctacttttcataataacatgttcatcctaaaattttttatattttaaaacaagggtagtagtatattacaactgaattgattaggttccatgatctaaccgtttgcgtttggtatttgatttggtatttgtacggttaaaaaaatactccccgttctattttaagtgcagcaataagtttccgtgttcaactttaatagttcgtcttaattattttttttttaaaaaaaaaaaatataagctatttatatttcatcatctaataccattaaattctaatcataaaaaaatttaaattaaataaaatagacgatcaaagttgaacacaaaactttatgg

SEQ ID NO: 8387 - DNA, 2402 bp, Oryza sativa
agaggtatatagaatcgaagccaggtcttcaggcaaaaaaaaaaaaaaaaaggtagtagaagccagtcatatggtatactcgtatttcattaaaaaatggtaatgatttgaaaacaatattttattaaaaaatcagattgtttagctactcattgtagacaactattcccaacagtttcacgttggctgtgtttagattccaaaatattttggccaaaaacgtcacatcaaatatttggatacatgcatggagcattaaatatggacggaaaaaaacaattgcacagttagtatgtaaattgcgagacgaatcttttgagcctaattgcgccatgatttaataatgtggtgctacagtaaacatttgctaaattaggcttaataaattcgtctcgcagtctacatgcgaaatctataatttgttttgttattaatctatatttaatacttcaaatgtatgtccgtatatgtaaaaaaaaattggctaacgaactaaacacagccattgttgcaagttaggatcataggtctgacacatatttgtaaaatttgtgccaacagttttttaagactcgacattgatggcataaatatcattaccgatttttctagaaaactatttgagttagtgtcggactttttaaaaaccgacactgatatattaggagcccacgaagtctactgtttagattcagagacttaactttagtctctatatttagacactaatttaaagtattaaatatagactacttacaaaactaattatataaatgaaagctaattcacgatataaattttttaagcctaattaatccataattagagaatgtttactatagcatcacataggctaatcatagattaattaagctcaatagattcgtctcacgaattagtccaagattatgatgggttttattaatagtttatatttaatatttataattagtgtccaaatatccaatgtgatagggactaaaaagttttagtcccatctaaacagggtcgggaaaccaatatcggtgatgggtttgatcgaacaggtactatactaatgtgttgttctatgtagtaatgggaacataatgattagtctattgcagaggtagaacatatatttattcattcaattattccgagacttctaaaggttaaaatagaaaaattgtaatgtttcaaaaaccaaacgaaaaacatatgaaagtaaaaaatgcataggacacacaagagggagatccatttctttgttcacccttaaaagatatacttggtcccaccggttttcaacatacgagcttgttgaaattagacaaatgttttactattcctcttactggaaacattttgtaattattatttatttttctatgatttgttttatcatcattgatactttaaacatgttttatattttttatatttacataaaaatttaaataagacaaattaatagttaaaatgtatccaatagttaaaagtgttgtaaaatgaaaactggaggaagttatattttaacaaaaaaaatatagtctttaaagacattgtcctagtgtagtcgggtgtacgtcagagcatccaggattaaatttgccgataaaactaaattaatttagcaggctgtcagcatgtcacagtcagtaaatttaaatacggagtactccactagactgttcgggaagggaactttaattactcccggttagcaaccctttctagtcccggttgtctaaccgggatactcaatctggaactaaagatgtttatttttctgcaatcgagacgtccgatccgggactaaagattttcatcttttgtgcaaccaggactaaaaatacatacctagtaaaaaaaacccagtcttcatgcgcgttaacatcccatctactacacacatttgacttggatagatatgctttctttttaaactaaccctggaggcatctttagtctgggttggatggtaatgttgacaaagatgattatggagcatatctgtagagattattgtggattgaatagtgtatcaccttgcattacttacgccattatatttctagctaggttgtattgattcgagtagatgttttacagcaaacaagatcaaagaagatagtgaaattaattgtgaaagaatccgtcgtgattgtaatggttgcacagcgacaagcagccactgtgtgaagatttcaaaaaaataggacacgtggcattggcgttgtggtgatggaggatgtacgggctatggtgcacttacaaggtattcgacgcttagttcattggcgcaaaaaaaaaggtgacaattaatggaggggggaggggatatgaacgccattgccaaatcggcaggtaaaataaaaccttgactaaatcatgttatttgccagatccataaaaatcct

SEQ ID NO: 8388 - DNA, 4722 bp, Oryza sativa
  unsure (1)..(4722): unsure at all n locations
nnnnnnnnnnnnnnnnnnnnnnnnnnnnnnnnnnnnnnnnnnnnnnnnnnnnnnnnnnnnnntgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaatgggggttgtgggaacaaatcctctcacacgtgtgcgagcacttttttccttccgcacttgcacaaatcttgaaacaaatctaacagttcaaaattacgtgaaagttacatacaagttaaatattgtagttacatgtaagttatagcgtaataatatgtaagtttcaatctaattatattatgattatgctataattacatctgtcaaatttttaggagaatatctatcaacaaatatatagcaaaattggtttgtaataatgtatttctgaaaaacatacgccctccgtactagtaaagaaagccatttagaacaatgtttaagttaaaccttggaaatataaatcatgaataacttagtttgaaaatgtaaaaattatatgaataaatttgtcttgaaaaatacgtttataaatcatacatatatcacttttcaataaatatttttatagaaaaaatttaaaattgtgttatgaagaccgtgtcgctgtccaaaacgcctcctttaggagtacgtgtgtacgtacgcacgtgtacgcaacgacgcgcgccacaccacccaccgcccgcgtggccccgcacgtcagaggccgctgctgcacagtcgcgcaccgccacgctgccacgtaggcgcgggtggagtacggaccccagtccccagaagagacgtctcaaaagtcaaaagccgtacgataggggagccgccttgtcagcgtcgtacacatccaaaggacgccgctgctgccgtcaacacggggactgttcaaaccgcaggaaggactgcaggagacgctggtggttgagggcccccacgtgtcagacctccggtcaaacgctcgtctataaaagatttttctttcttacaacggtcactggtcttcatgtctagtagttgggatagtttggactgagttcctagctccattcccttatttctcacgtgcatatttttcaatatatatgctaaatggtgtaccttctgcaaaaaatttgaaagttgttttaaaaatcatatttatctcattttattttttaagctaacatttaattaattatacgataataaacttttttttccgtgctagaagggaaggtttctaaccgacacaaacgaacgcatctatgtgtatttagtactgaatttacagcttaattaagaaaatctatttttataggaattaaccaaatcttgtaacacaatggtcaccttgaaagaaaaacggggcaggatatcccaaagaaagaacaatggcagaaccaccatcttcctaagtctaaggattaaatagtctattttacatgactttacctttatttttttaaaacttttaaagtgtaataggtgcactacttctgtttccatccctaccaaagaaaattcacttgatacgattgaaaattgttgtaaatggtaatttgtacgacgatgtgggattctttttatacatattttggcatcagtgttccgtagtgactcaatttagctaacattgtgaccctgctaggatttttatggatctagcaaataacatgatttagtctgggttctgagcctttttggttgccattcctgcgacaaagctgtggctgcaacgcttgtgttgtgtggttgcagctgtgctgtttgttgcttcagctagctgccgtgcagctgtagaaaatgccagccgaacagaccctttaacatcactggctgatttggccaatggcgttcatatctctgatctccactaattgtcaccttttttttttgcaccgatggcctaagccttgaacatcttataagtgtaccatagccagtgccatatgtcctttttttgaaatcctcacgcactggtggcttgtcgttatgcaaccattacaatcgctatgttacaaaatccattacgccggattcttttgcaaataattccactatcttctttgatattgtacgatgtaaaacatctactcgaatcaatacaacctagctggaaatataatgccgtaagtaatgcaaggcgacacgctattcaacccacaataatctctgcagatatgctccataatcatctttgtcaacattatcacccatccataaacactacaatgcatattgtttgcctactcttctttgagcgcaaaatgaccatcttctcctctaccaaacatgggctgagttcgtttattagagctcctagctccactcccttatattttcacgtgtatgtttttaaatatatatctgctatatggtgtgctttttttaaaaaaaaactttgaaaagttgttttaaaaaatcatattaatctattttaaaagttttttttgctaacattttattaattatacgctaatgaactgttctgttttctgtgctagaagggaaggttcccaataggcacaaacaaacgcattccgtatgtgtttagtactgaacttacagcttaattaagaaaatctctttttttaaggaatttaccaaatcttgtaacaaaatggtcaccttgaaagaaaaatggggcaggatatcccaaagaaagaaaaatggtagaaccacaatcttcctaagtctaaggattaattagtatattttacatgattttagctttattttttaacttttaaagtgtaataggtgcactacttctgtttccatcccaaccaaagaaaattctcttgatacaattgaaaattgccgtcaacggcaatttgcgacgacgtgggatttttttatacatattttgcaatgggtgttccgtagtgactcattttagttaacattgtgactgtgagaatattcatggatttagcaaataacatgatttagtcagggttttattttacggccgatttggccaaaggcgttcatatcccccctccattaattgtcaccctttttttcttttgcaccaatggcctaagccccgaataccttataatgtagcccgtacataatcgatcaccacaacgccaatgccatgtgtcctttttttcgaaatcttcacgcagtggcggcttgtcgctatgcaaccattacaatcgctatgctacaaaatccattacgccggattcttttgcaattaattccgcaatcttctttgatattgtacgctgtaaaacatctactcaaatcaatacaacctagctggaaatataatgccgtaagtaatgcaaggcgacacgctattcaatccataataatctctgcagatatgctccataatcacctttgtcaacattatcacccatccataaacactacaatgcataatgaccatcttctcccctaccaaacatgggttgagttcgtttattagagctcctagctccactcccttatattttcacgtgtatgtttttaaatatatctgctatatggtgtgctttttaaaaaaaaaactttgaaaagttgttttaaaaatcatattaatctattttaaaagtttttttgctaacattttattaattatacgctaatgaactgttccgttttctgtgctagaagggaaggttcccaataggcacaaacaaacgcatcccgtatgtgtttagtactgaacttacagcttaattaagaaaatctcttttttttataggaatttagcaaatattgtaacaaaatggtcaccttaaaagaaaaatggggcaggatatcccaaagaaagaaaaatggtagaaccacaatcttcctaagtctaaggattaattagtatattttacatgattttagctttattttttaacttttaaagtgtaataggtgcactacttctgtttccgtcccgaccaaagaaaattctcttgatacaattgaaaattgccgtaaacggcaatttgcgacgacatgggattttttttatacatattttggcatgggtgttccgtagtgactcattttagttaacattgtgactatgaggatattcatagatttggcaaataacatgatttagtcagggttttattttacggccaatttggccaaaggcattcatatcccccctctagtcacccttttttcttttgcactaatggcctaagccccgaataccttataatgtagcccgtacataatcgatcaccacaacgccaatgccatgtgtccttttttttcgaaatcttcatgtagtggcggcttgtcgctgtaaaacatctactcgaatcaatacaacctagctggaaatataatgccgtaagtaatgcaaggcgacacgctattcaatccgcaataatctccgcagatatactccataatcatctttgtcaacattatcatccatccataaacaccacaatgaatttttttcacctactcttctttaagcagcaaaatgacgctcttctcctctatgaaaacataggtagcgaaatgaccgagaggggtagtatagtactatcacccttaaccccctcccccctctctctctctagcatcacattctctctcacccctttgacattttc

SEQ ID NO: 8389 - DNA, 1574 bp, Oryza sativa
  unsure (1)..(1574): unsure at all n locations
cgaggagaaagtatgcggcctccgctatttatatagtctccgtttgcttttctgattcttgcataatgtggattcgctcgctggctgatgaccgtggcgttcgccatgcatgcaggaagaagcaaacgagaaaggaggtggtgcgcgtggcggcgagcgggccggcgccggacttgtgggcgtgccgaaagtacggncaaaatcggatcaaggggtccccgtacccgcgcggctactaccggtgcagcagcaacaagaactgcgccgcccggaagcaggtggagcgctgccgcttcgacccctccttcctcctcctcacctacaccggcgcccactccggccacgacgtccccctccaccgcaactccctcgccggcaccacgcgccacaagccgccgccgccgccgccgctcccgtccgccgccgacaagtctccggccaccgcggctgaggcggcgacggcgagccagagccccggcctgtcgccgaccacgccgctgcgcgcctcgtccatggagctccacggcgaggacgacgccgaggccgagctgcaggtggaggaggacgacatggccatcgacgacgaagacgacgacgacgtcgccgacgagaccatcagcaccgtgccgtggggcacgcccatctccgacgcgatcatcgcggcgagctacgagtggagatgaccaccaccacctcggcgacctcgccgtacattgccatacatagcaagcaattcagccgtcttagagagagaaattaagggaaagagacagaaattaaagagagagttgaagggagcatccgatccatgcagctagtatctccaacacccagtagcactagtgtttaattacttaattaattactacaagcacctagtagcgtctatttacagaactacctccgttccaaaataagtgcagtcgtgaatatccgtacccaacgtttgaccgtccgtcttatttgaaaaatttgtgaaaaatttgaaaatatttaatcacacataaagtactattcatgttttatcatctgatagcaacaaaaatactaatcataaaaatttttcaaataagacgagcggtcaaacattgaacgtgaatagtgtaaaactacacctattttggacggagggagtagtacttaattaattagctagtgagtgctggcctggatgcatgacaatcatataatcagacaataataatgtgtaattaatcaaaatctccaacagaaataaaattatcttcatttcctcatatagtttcctcagtttgtcctcctttcttggacatgtttgcgtcttttcttacagattctttatttcgttttgtgcaacattttctttttttttccatacataggagtatagatatgtagtacatacatatgtacataaatagatcgaagtagtaacagtatcagcaggtacccagatgatggaacagctaataattaaaagagttgaggaaaagaggggaaaaaaggggtggggtttgttggtgtgggttgtggtggctctttttggctcattccctttcactgtgcccatatttgggtgtgatatgtggctttca

SEQ ID NO: 8390 - DNA, 5418 bp, Oryza sativa
gtagtacttaattaattagctagtgagtgctggcctggatgcatgacaatcatataatcagacaataataatgtgtaattaatcaaaatctccaacagaaataaaattatcttcatttcctcatatagtttcctcagtttgtcctcctttcttggacatgtttgcgtcttttcttacagattctttatttcgttttgtgcaacattttctttttttttccatacataggagtatagatatgtagtacatacatatgtacataaatagatcgaagtagtaacagtatcagcaggtacccagatgatggaacagctaataattaaaagagttgaggaaaagaggggaaaaaaggggtggggtttgttggtgtgggttgtggtggctcttcttgtctcatccctttcactgtgcccatatttgggtgtgatatgtggctttcagttcaggctagcactgctgttgtgcctcttttttgggcagatgaggaccatttgtagtatgcatttaagggtttgcaatttcggtaaccaccgaaatttttataatttcgtgaatttccgtgttttcttcacaaacttatttgaaatattaacatatttccactgagtttgaacacattttaatcaaattcatatatatttgaaaaatctgaaaattttgggggagatttgtgtttgaccgctgtttacacccaaatttgacacgtagtaggatataaatatgagaatattgccaatgtctgaagagcgtcgggtttccttcatggagccagtctgaccgccgtctatgggcaggtctaattggtggcatgtggtcggtcagatagacagagtctgacgccaagccaattttcgtcggtctcgagtttccatactcagaatatatgtttcaggtttttattggtttctaagttaagttggacatgaaagacgacctgtaggaggcatgaccaacccctatataagggccaagaccgatttaattagcaacacaatctacttctaacacaattagccaattgtatctttttttaatatgcagttaccttttcacttagtttagcctactttcatcaatctttatcgatttgcgctttaaatcgtccacttttgccgtgagagtacgattatccttttgtagatttgtcccatatataaatcttccgttcgccaatgagacgggtaattatcttcaaatcgatttaaatcagccttgagattgatttgatatctaaattggcttcactagctagtttagtcttacaaaacccatcttgatctagttttgctaggtcaaggtggctagcgactcaatccatatccccgcaaggtgtttaggtgtcccgatcatgattgttttcttgccaaaaaaaaaaaaaagttgccaacgctcgcatgttaaagatgatgcaatagcaatggaacggatggcattttagttctctcctttaatttgttcttgacttctgccactagctaccattgcatctattttgccaactgttcctgcttctatctgctggtgtttttttttgctggattcaatgtgttttaaatttgattgtgtggtgtgattaatgttggttaattaattactctttactgtacactttaaatttctatttgatgttaacatttacagtagttgaaagtgtacaatacactttcaaccactgcaattgttaacaataaagagtaattaattaactagcataaattacaccataaagtcaaattttaaatacattgaagtattttttttttcacatgtgaaaaaagacactgctatttattgagtacgactagcttgttgttactactatgtggtgcaaataatattaatccctttagtttttaggtaaattggaaccatgccattataattttgcaaagtttgagatatgccatcggtatttcaatgacacgtaggacccacatgagtcaatgacatgtgggtcaggatggcatatcttaaattttgcaaaattataatggcatagttccaattttcctttttttacgaaccacaaaaaatatctttttccacatatgatttttttaaacattaaccagtaggtgacacaactgaattttgtaagacgcgtgaaatgcaagtagtaacttgttgtttgttataagaacatgttccattattcggaaagttgattcatctaatttccttcacaagggaatactcttacgccctaaaagggcactaacagcagaataatgccgatttgatatatacttttttttaacaaactgtatcaaactctccgtctctcataataaggtacaaaaggagcttttttattttctaaagatcaacttacctgctcgaaaaaagtttgaaaagtcacttgaaagcttacatcacaattgaaagtggcgaacctatgtgcttctcttaatctcttatcgggttttgacagcggtgaacctatatccgaagaactcgtgtaaattatttgactaattaatttatattatgttaattagtataaatgattaaatatgtatagagtctagtaatttttattctaagttcgggattggccaatcgaaagagttaatcgatcaaagccggcaacctgatgaacaacagtgatgattcctgtacgggcggcggcagcggcagcagcagcagaaccagctcagctatgttcgttcatcgtgcaaatcgaccgtcagatcttaccctaaaattttacaccctatcacattaaacattagaacacttacataaagtactccctccgtttcgaaatgtttgacgccgttgactttttatcatatgtttgaccgttcgttttattcaaaaaatttaagtaattattaatttttttcctatatcatttgattaattgttaaatatatttttatgtaggcatataattttatatatctcacagaagtttttgaataagacgaacggtcaaacatgtgctaaaaagtcaacggtgtcaaacatttcaaaacagagggagtattaaatataagctaaaaaataactaattgcacagattgcaactactttgcgggacgaatcttttaaacctaattgctctatgatttgataatgtatgctatagcaaacatgtgctaataacagattaattaggcttaataaattcatctcatggtttactgaccgatactgtaattatttttttattagtgcccaaacattccatgcgacaccctatataatacccgatgtgatatgctaaaattttaccccccagaactaaacaccccctaattctaagatggagatcttttttttttgtcaatgcgttcgtgtgcatgcagttgtgcagtggtagcagttatcagtgctacccctaaatagtagcttgctaagagccagtggtagcagttatagcaggctatataagtcagctataacatcgagaagaaaagagaagagagaaaaaaacgggctacagatttgtagccagctgcaatacgaactctaagacgttatgtgtgtatgagaggtaggaccggatattaatgatatagtatatttttatagttaactattgtatgaattggctattagattagctataggtgaattggagccagtagttggctattctattaaacttgttctaaaaatataagaatatataatgtttcttagtacaatatatttggacatgtttagatttattgtactataaaatattccattcagttttagattattgtatttcgggtcagagggagtacgggtttaacttttgtagcctgatcgatgatacggtagaagcggacgaggcttctgtttgtgtagtttgtacatataccactatactgtaggctatagaaagtactccctccataagaaaaaaacaacgatggtagaatgtgacacagtagatttgttgtaataagattgtcacatcaaaatactaggttgacttttttttatagagggagtacggctcatatattagtgatttaagtgcaaaccgcggatccacttttatcataagcatgtattgtgggttttatatgttctagccctttttaattatttattattactatttccattatttttgaaaaatagtatgaatttgtcgatatttgatgtcgcgattccggtatttgcatagaatggggatcgttggtaccaggatacatgcgagacttaggtaaaagagatagaaacgatgatttttatacaggttcgggcccctgaattgtcaggtaataaccctactcctgttggccgaagccggtcgttgctcttattaaccataaccctactcctatctaactgttgtcgacttggcggtctgaagtgctgactcgtagtcgacaacagggtagccttactcctcgaatccgcatccggcaagatcaaagacagcgctatgtctctcctatcagtatccgtagacaccgtaggggactagccatgctaatctctgaagtcgatatccggcgtcttgtcttgacgtatgttagcttgtatattgatcttgtgtattgatctattgttccgtgtcccctctcctcctagggggccttgtatttatacccataggtgtccgcttgtccaagtagaactagggaaaccaatatggatacaatcacagtagtccttatcgtttccatgtagaactctggttgtctttccttatccggaacttctcctatatccgaaggttgtttccgtataagacatggtatatggtgggtcctgccgagatttagtcgactattattaggtatatggtatccataaccctgacagaattaccctactaaactatcgcggtcgaccgaattacccccgtagacttgaaaactagatattttacaccccaaactattgaaaccgaacaaataccactccctcactcaatccggagaaaaaatggtggggcctactatcagatctctaccctcccacctctctccaccaccatgtgttgtggccgacgatgatgccgcctgtctcccaccatccctctttacccaccacctggcgccgccgccacactcctcgtcctaatcgaccctccccaccgcacgcaagcgcaggcgtccccatagcaatagccgtcggtgatggcggcgccgcgtcgtccgtgtcacgggcagcgtcagcagcgatacaccacgtatccactaccagcttctccttgggtgatgacctcactggagaagccgccaccatggacaacaacgacaacgacaatggccgttccagcatcttctcgcgagacagccttccccaccaagccgagcaacgcaaatgtatcctcttctcttcgatcctaccacggcgcgcttgctgtcacattccccaactccaaatacacctccatcaccatccgggcactgctagggtgcacctcctcttcggccttcgccggcacatgcacgaggagagtcatag

SEQ ID NO: 8391 - DNA, 2064 bp, Oryza sativa
ttgtgtgtgatgtgaatgtgatgtatctgtgttgaattttgtaaaatttgtgatgtatcgatttggggagttgaggatttgaggatttggggataatttatttgggattttgggatggggatggggtgaaatcgatatattaaaaacaatgaagaaaagaaaataataatggagtaaccggatctagctagcctagctctatctttaatcccggttggtaaaaaaatgttctatctttagtcccggttggtgttaccaaccggggctaaaaaggttctatcttaccaaccgggactaaaaatggatttttactcccggttttttcacccggtcccggatgggggttacgaaccgtccgggggttacgaaccgggagtaaagcccctttctccaccagtgtttggtcggtttctcagccttcacctttaaaccacgaagaatatatagaaataaaatcctatcctaaaattattgtttaggcttcgtgcctcgtatataccagatgatcgtcccgcgctttacgcgggatatatgttagataatagagaaatgatttacattgaaatattatgaaaatgattcgagaatgataatttagcatgtgtatgtttagttttagaataaaataaattctaacatataattactatatgcttacatattgagctgtgtatgtatgttttatgagtgctaataatacattaatactatactacaagtatattgagttgtaggtgtctatagcaaagggtagtagtaccactatcataccggtgagcacgataaattaacagcgctgcagctggtgcgaagaaccaaaggctcggttctgcgtatgcatgcatacatgcctttcggcaaggtcaacagccacgttccagaccacagtttgtcgccaacatggttgatgccgccctcactcctggaaacatttctacactccttcaaaaaaaagtctctaattatactatggtgacagtaaatctacagtttttatttttaatattgttcttttagtttcaacaaattgcctcataatatttttaaatattatgggatagttcaacattagtttcaaacaagtaaaaagcagataatcaaataagtaaataagttatactaagatatttaattaaaaaatatattttgctatgatatattgtgatttttttcttctacccatagcaaattaaagcttgaacattttgctagtacgacatacatgcatatggtcagtgaaaataaaggttaatacagctctgactataaaagcctctgcgggaaaatccatcagatagccaatgtgccgggacctaggagacagcaatgacctggatagatagatggtgaagcaaaaaccgcacattcattcaatcatgcatgcatccacatccaacccaccctactcaggtcttggctagtcaagtggtaactggctacccaaattggatctaaaatatgtactctctccgtcccaaaaaaaataaatttaaaactacatgtggcacattctagtagaatggatctgtacagaggtatgtccagattcatattactaggatgtgttgcatccagtactaggttggttttttatgagacggaggaagtatagcttagcgacattctccaatctccacctctggttcgaaacatttctgacacaaatttttctccattctgtaatttcattcgggtgatgtgaacaatttctgtctacattggatttaaagtataggtagccacattattcacctccaatctggaactctctgacaaaatttctctcgattcaacttcatttaggtgacctgaacactctttctaccagaaatttgtgtctccaatacaataaaacttgtttcgttcatgccaaatgccgccacagccttcagccaacaaaatgacaccgttcggagtcaggccaggcagaaggtatacatacgagccaatggaacaaaaaaagcaaaatggaaagacacaactcaaataaacaaccaaatacttagataaatgtgtgcagacatggattacaagcaagtaaatattagctatgcagaaggccaa

SEQ ID NO: 8392 - DNA, 7864 bp, Oryza sativa
  unsure (1)..(7864): unsure at all n locations
nnnnnnnnnnnnnnnnnnnnnnnnnnnnnnnnnnnnnnnnnnnnnnnnnnnnnnnnnnnnnatgatcagtgcgatgataaagaaggcataatgttcacctttgagtccttacatggacattatatatctagtgtccttctctgaatcattataactactgctgcaatgcaaggatagaaagcactgattttattgtacaaaggcaagatatggcatggcagatgttgcgataagctagcactcacagtggcagggaaatgttgtggtgaacatgatgaataatgcagcagcactgtgtgcaacaactggacaaaggagcaacagtcaagcatacctttgccaaaataaatgtacagggttctgattgcagcctgaagttcaggagaattaggccaccttgacgataggtcaatgcaaaatggtcaagcatccgaatcctgttgctggaagaaaacattttctgggacagtaaagcacaacgaacacattcatggactgaagctcatctagttgaccccccactgggccattctggtcttggccactggccagtgctaaattacattgatcccacatcacatttggagctttgcaagaaaaaagaatatcagtttcgtttgggttgaacattcaaacttctcatgttaaatgtcataatattgcaacacagctcaaccatttcttccttacgttctaagtgaacagcacagctcaatactgttgacacatcttctctcgacatcagaccatcaaatctgaagtgttttggttaaattaatagataagtttgttttaaaccgttaaaaataaagaccttcaaatgataggaactcgacatatgcatccctttatccagtgggtattaaactgaacttttagtagtagtatgatatacaaacataaaagcaactcaaaagttcctttacattcgagacataactgaacctaataagagattgtaagtgggatggactatcaattatgctgagataatagactagcaaagtaattataaaagagcatctataatgggcataaaaaactatgtgatgtctgaaatccttggaatgttatgttgttgacccaaagaaagttttgctctgaaaattactgacgtatttttggaaaaatctgattagttttcctagtgactgaccattttctagctctagatcaacctagcaatttagcatctgtgtttattcctttcatattagtggttcccaggatgacaaataagcaaatcacaataagtaaactgcaggtggaatcaaaactgaaatgaccgttctcaaatgtgttttcagaaaccgaaaccattttctcaaaactgaaaagaactctatgctcagaaagtacgtttcagaaacgttacttttgaaaggtgaattgattagtggcagactaagtaataaacttaccacaacaaaaaattgaactgcaagttgtcatgaagcaaggtctttacaggaaaccatttcacaatgatgaccctgatccatgaatctagaaagctaacaagcatttcactggacctgtaatttgcacaagcaactgagtgagccaaaatctgctgtatgctggatgcttcttctacattccagagccttgttaaatcctatcactagtacaaaaacatatgcagttttagtgcaaatcaatatgaatgtctgagcaggtatatgaaattacagaatgtactgctatttacttctggccgataattactatgagacgtgccattcatgaagaaagaaaatatgaacatatccataaactaagaaaaactttggcatgacagtgaagcatattgcaatactctgacagagaaattaagtcacactatcgaaagctttctgcaatgctgaggaaactgcacttaatcatatggaaacaggaaacagctctcgacggaatcttcagctccacgccaactatgcctcaaagataattttaaacttgtagcatatcttcgtggtttggctttattaactaacttaacttcaagtaattccttcccccctactcggagttcctcccactactaggaaaaccatctttcatggcagccatattgggttttcactggcggaatttggagccgccacaaagcaaaagccagagaaaatagaagttttcacaggcgggaattgaaccaccagcgaaaacggatttttgctggcggctatattacacggaccgcttgtgaaaatggattttcgctggcgactgtgttaggcgggccgctggcaataatccatttttgcaggtgtacgtgttaggatgactgccagcgaagctcatctttggtttaaaaaaaaattgaaaatacccgaatgcatcttctctctaaccgccagatgcaaagagcaaatgagcaaatgcattcccattccgcattgcaaccatttcacattgcaaatcaaatccaagacccattcccattccacatgtcgcagtacaaatccacatatctcaacaaattccacaaaacccatttccattccacctatcacagtacaaatccacataaaaaaaccttaacaaattccaaaaaaaatacaaaataagcaaatctcaatgagcacatcgacgagcttccccgcgccgctgccactccgtctgtcactgccatggacgagctccccttaccagaagcagccgctgccgcggccgccgttgcccgtcgccaccgccctccccctcccttcttcggttggatctgggaggggaggggaggggagccgccaccatcctccgccctccctcctttggctggatctcggaggaaaggggaggggagccgccgccacacccaaagcagcagcagccgttgccaccgccctcccccctccctccttcggctagatctgggaggggagccgccgccgcgcccgaagcagccaccgctgtcgccaccgccctcccccctccctccttcggctggatctgggaggggaggggaagggagccgccgccgtgcccggagcagccgccaccgccgtagtcgtcgttcgccagcgccgccaccatcctccggccacagcttcggggccggatccgaggagaggagaggagtggagaggagagaagactggacaaagttggtggtggatgggtgggtggggatgcggtttttaataccgtgcaatgcattttccagtcggtgctcaacagccaccagcgtagattaaattttcgctggctgccggtaaagtggaccacctagaaaaatctaatttttgcacgcggttgtttaggtgagccgctagcgaaaatagctatatttttgctagcggccctcttaacccggtcgctagcgaagatctatttttgctagcggtccgtagcccctcaatccctttaatattttcgctgacggtttccacgtataaccgccagacaaaaaaaaaaaaggtggtgtcactaaaaatcgattttgtagcagtgtctatatttccctgcctgaactaatgtgagtatgtgacctttataatgaatgcatatggagaaccatgagcattctcaaacaagtaatgtatgtaataaagaagaaatatgctgacagtgcacttttgacaattgcaaattgtagaacatagtgatctttaattgacatccattaacagcggcaatgtggcatgagcaaatctgcatttattccttgagactgttgagtattcacatcttattttcacaaaccatttctgctcataccatattcagaatgaccaaatcttattttcgcaaaacatttctgctcataccatattcagaacgaccaactaaacccgataatgcagtaagaaaattcatctgacatagagcccggccggcctgcaaatgtacctggtactgagcaaaaagttacaaaatgaacgaactcggtaacatctagttataccttataaccacacaatgttttctgaatcaaaaacattattcaagattaggcgagcgaagtattaacctctaatcgatgggaagagcagccgctgcttctcgtacggcggccgcggcgggacggcgatctgtcacaatccgcgtcggagtgggtgaccaatccgacttgttcaatccgcttacgagaggacgtaattattttgaaaaaaaaaacgaaataggttctccaattaatttacccttgcctatgttaccccgataagggatacagataagataccgatacggatacagatatatagcgttttctaaaaaacatggatactaggatgcatttgtgaaattattatcatgattaatatttgtgatgaataattggctttacaaattatttatttaatgaattgatttgaaaagatgtgtggatgttggtgtgagtgcgtgtgactaatgtgggttaggtaggttgtgatatatgtgtccagaaacggttgttttgtctgattgtgtgcatgtgacttgagatcagccttggtcaatggtgaggatcgggactatgctcagggaggagcagaggctagtgcggtcggaataacatatgagaaggtgactagagttaggactctcgcaggttaactgttgagattataggcatataatgatttaatctattccataaataaatcatgacattacagatgaaaactagcatgaacgcatcattagatctacacatataactacacagtataacatgaacatatcaaatatgcgcaacatattgaacacgtaccaaggtggcggaaagactcggtcgaaacttttcgcaggcatctacgaaggcacgcagcacgcgagcgaagaggaagacgagccgtcgcggaagaacagggagcagtcacgcaaagcgctccccaaaaaccttattgccgccttctcccagtgcagaatgtcgaaggtagaggttccggagacctgctctcccgatcgcaggtgcacgccggcgagcgggatggagtaatctacgagcgacggcacagcacagagtcggaggcaaaccctagattgatttcgcgtgtgttgcgtgaaggtggcggctcggtttatataaagaagggtcgcttgatcagggcacccgcacgatctccactgcacgtaaccgaaccggataagtcgcgcgtaacttatccggactccacgccgatctgaatttgcagcaaaacaaaactgcaaaaggaggctgcatctgcgcaaggtgaggaaccaattttgacggaccattcgacgcgtagccaggcgaggcgaggcgagcgagcgcgcgcgtgtgttccccctcttctctccaccacacatgcttcaagtggctaggagggcatcctcccttttaaggaggtccccctctcctaaaataagcaaggtggtactaaactccacatgcatgccatcccatgaggtgggcttttttgatttttcaaagaattaatcttcgagtgggctaaggcccattcattaattctgacaatcccccaccaaatctcaaaatcccactgagatttgccttttccaatgtactgtttatatactagcggttcgatggagaccgattaaagttgaacatccacctagaactccaagctacatttactcacaacttgaacaatggactatgccttgaattgcaagtcttgtgcaagcaagtttcactcagaatcttatcttgtactagaccgtctgtagactacccctcgggtggagcgtataagtcatactcctaggtctttagtaagcttcctagaagattcacccaaaatctccatagactgcgaccaacagtcaagctcacaaaggtgagttctttcaagaatgctctacaggacagcatcttcgctaattaaagccaacagaactcattaaggcatagccaacctgccttgcagttcacgagagtacatgcatcttcacttagagagggtatagattggtactctcctctaatttacttatggtttgttcttcccatattctaattcacgggatctccgatcacatagactgggttaccaccatagtataactcacatgggtctcaaatccatctccttcgatgcattgtctatcacatttcatgatagtcccttcgtgaagggatctgccaggtttctagctgtttggatgtaatccaacgttataactccggagtttcttaatttcctgacagacttcaatcatcttttcacatgtctagacgatttcatattatccttagaactattcactttgacaattaccgtttgattgtcacagttcataaggatagccgcctccggtttttcaacaatagtcagatccatttgatagatcacgcagccattctgcctcaacagtagcggtatccagtgccatcagctctgcttgcatggttgacctcgtcaaaatggtctgtttgcaagacctccatgaaacagcaccaccacccagtgtgaagacatatccactagtggctttgatctcatccacatcagagatccagttagaatcactataaccctccagtaccgcaggatacccagtatagtgaagccccaattccacagtacctttcagatagcgcattactcgctcaagcgcacgccaatgatcatctcccggattagaggtaaatcggctcaacttgctcacaacaaaggagatatcaggcctagttgcactagccaggtacatcaacgagccaatgatttggaagtattccagttgattcctagcaattctcttgttcttgcgaagtaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaaaaatgatttaacctcatttatcacctcaaggtttgtcccaaatatcagtatgtcatcaacatacaagcataaaataactccctcacccccaccatggcgatagtatacacatttatctgcctcattgactgcgaagcctgcagatgtcaatgtcttgtcaaatttctcatgtcattgcttaggagcttgtttcagaccatacaaagacttcaacaatttgcacaccttgtcttcttgaccttcaactacaaacccatcaggctgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgcgaaagaaatcttcgccttctttctgagtgtagcccttagcaacaagccgagccttgtacttttcaatagtaccgtcaggcctaagcttcttcttcaacacccacttgcatctcacaggtttatacccatagggtcgctctgtcacctcccaagtcccgttagcgataatggaatccatttcactacggacagcctccttccagtagtctgcatcaggagatgcatatgcttctgaaattgatttaggagtgtcatccacgaggtacacagtgaaatcatcaccaaaggacttagccgtcctttgtctcttactccttcgaggagcttcactgtcatcctcctcagtgacatgttcatgtgtatgttcagtttgttctggtggtgtgattgaactgagaattatttcagatggttggctcgaactactatgtgtatccttcattgggaaaaagctctcaaagaaggtagcatcacgagactccataattgtaccaacatgtatgttaggtacctcagatttgactattaaaaatctataggcaatgctgtgatgagcatatcccagaaagggtaccgagctcgaattcgcccta

SEQ ID NO: 8393 - DNA, 2702 bp, Oryza sativa
agcacccccatgtgcgcaaataagaaagtgatggttttctcccaatcaatatctcatatggtgttttgtccttatttctattaggaactctgtttaacacatgattcgaggtcaacaatgcctccccccaccatgctttaggtagtcccgcagtgtccaacatggcattcaccaagtcagtcagtgtgcggttcttcctttcagcaatcccattagactcgggagaatagggaggcatcctctcatgtatgatgtcatgttcctcacagaataagtcaaactcgtttgagaaaaactctccaccacgatcagacctaagtctttttatttttctgtcaagttgattttcaacttctgccttataaattttaaaatagtctagagcctcgtctttcgttttcaacaagtacacatagcaaaatctagtagcatcatcaatcaaagtcatgaaatatcgttttccatcctttgtcaacaccccattcatttcacaaagatctgaatgtaggagttctagtggtgccaagtttctttcctcggcagccttgtgaggcttgcgaggttgcttcgattgcatacaactatggcacttagaacctttgacaatggaaaacttaggaattaaacacatgctggaaagccgagacatcaagccaaaactaatatgacataaacgtgagtgccaaacattagcctcatcatccacactgccacaaatatggttcacagacttgttgcagaaatcagaaaggtaaaagcggaacaggcctccgcacttataatctttaccaataaaatatccatgtttagacacgactactttattagactcaaaaaccaacttaaatccatctctagtcagacgggagccactaacaagattcctgtcgatagaagggacatgctgcacgttcttcagctgcacgatctttcctgaagtaaacttcagatctaccgtgccaacaccatgaacagaagcatgtgacccattccccattaggacggtggaaccccgtgcgtcctgataagaagaaaacaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtatgccctgcaggtgccttcatccccttgcgctgtggacacttcctagccagatgaccaagttggccacacacaaagcaagtcctctcatcctgattaggattgttgttcttcttcttttgcttcttgaagttggtggtctgttgagctttgtacttccctttgctcttgttctgggccttgcgcacaacattggcactggactgtccaccatcgcccttagatgcgacatctttttcccgagctttctcctcaacatcaagagacgctatcaacccctcaacggagtattcctgtctcgtgtgtttgagtgcagtaccgaaacttctccaagatggaggtagtttcgcaataatgcacccggcaacaaatttgtcgggtaagacacacttaaggagttcgagttccttagccatggtttgtatctcatgagcctgttcgactacagaacggttgtcagccatcttgtattcatgaaactgctccatgatatacagatcattgctagcatcagtagcatcgaatttagtattcagtgcatcccacaactccttagcgtcggtcatatgcatatacacctcgaccagacgatcgctaagaacgctaagaatgcatcccacaaagagagtagtggcttcctcaaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacaatgcctacaataagggatttggattgttgagattatagacatataatgatttaatctattccataaataaatcatgacattacagatgaaaactagcatgaacgcatcattagatctacatatataaactacacagtataacatgaacatatcaaatatgcgcaacatattgaacacgtaccgaggtggcggaaagaccggctgctcgatcgaaacttttcgcaggcatctacgaaggcacgcagcacgcgagcgaagaggaagacgagccgtcgcggacgaacagggagcagtcgcgcaaagcgcttcccaaaaaccttattgccgccttctcccggtgcagaacgtcgaaggcagaggttccggagacctgctctcccgatcgcaggtgcacgccggcgagcgggatggagtaatctacgagcgatggcgcagcacagagtcggaggcaaaccctagattgatttcgcgtgtgttgcgtgaaggtggcggctcggtttatataaagaagggtcgcttgatcagggcgcccgcacgatctccactgcacgtaaccgaaccggataagtcgcgcgtaacttatccggactccacgccgtttgcacgcaccggatttttcggaacgtttccaaaacaaaaacgaatccgaatttgcagcaaaacaaacaaaaacgaatccaaatttgcagcaaaacaaaattgcaaa

SEQ ID NO: 8394 - DNA, 2902 bp, Oryza sativa
ctatagggcgaattcgagctcggtacccttccaacaataacttcggtcaacggtgcggatcgggactagactcagggagaagttgagatccatatggttaaagataccggatgacaaagttggatacgagatggcacacggtggatagacatcgtgtgagtgagatctttgcagcgggcttcacgaggtttgcatgcagacgtcggtgttcgcgaaggagattggaagaaattgaggaggggtatatatggtgctacagtgcttcgggttactgtgtagcatgcatatatgtatgtgtactgtggctagcagtatatattgtatcgcggcttgcgtgcatgcatgtatgcgtgatatacatgtgtgcggctcgatggttatgcttgctggtgccgatgcatgcatgtgcagtcggcatggcaggcgacagcagcggctcggttggtgggcaaagccgagtcggctcagggagcagcagcgagcagtgaaggctcacgcgcgaggagatcgagtccgactcggtgtggtgcggctgcaggttttggtaaattgtaaagggtttgaaaattaagggattgagttctactgtgaatagaagttctacatctactttgactagtaaattttaggtataaatagatgagggttagggctaggagatatcgactttttggaaaataaaagttagggtttacttcgaggtttcaatcctagttcgtgagttgagagaggagttctctagatgcactttgtaaacacatattgatgcaataaagttgatatactttcaagtgtttcgtcgatacgtgtttttctagatcccgacggtttgaccgaaggcgagtcggcggtctaaccacacgggggcggtttaattgacgataaggcggtggttagaccggcagcgtgcgagctgtctgaccggcggcgacaggactacgtcaagatctccatcgatttaagggtaacttttatttccgctaaaagtttttgggtttttggttttctctactattcacccctctctctggtaggtttgtttggttttttgcgatcctataacattgatatatatatctatgtttacatattattaaaatacagaaaattaaggaacttttgcaaggaaatagcaatataacactgagtgctagcgcagctgacttccataacaattttctgcacttctctcttatagataattccagttgacgaatggattaagcatacacaagtgtaagactataaatagtacacaaatcacaatttaatagctcaagttactcttgataatttgcatcaacaataacagcagcggcactaccactggacaatctaaaaaagcgatagtacctgtcgtgatcagaaaataaggaacgcatgcagatgaagcgaacaccaaaagtgtagacggctccagcgacgggcgacggcgtcgtcagatctggtctccccgcttggccggggtgaccggcgacgggctcggtcgacgccgacgcagctccacggacctggcaggggggtggctagcagcggcgatggtggcggatgtggcggcgacgaagttggcgacgacggcggtggactgcggcgcgtgccgcgacgccagccctcgtcaagaaccttgctgccacgagggaggcgcggcgccctcgtcaatgctccggcggtgaacaccgtgcccgtgacgccttccttcatgtgccggcgacccgcgctttgcgctgcacctccgatccgcgccaccccggtcggatctagatggctggcgtctggcgacgctggctagcgacggtggcggctggacgggggtgtccgtggcggtggcggtggcgatgatggctgacggtggcggctggtgacggtggtggctgtggcaatggcggtggcggctgtcgacgatggtacctatagcggcgatggttgaaggccatcatccggctgacggtgcgtcgtcgtcagcggtggtatgtggaggcggggaaagggtctggtagcggggaaggaggagtccgggtgcgggcgcgccatcgacggcgggaacaattgtgggcggtggccttggccgaatcgctgaagggacaatgttgttgaccgacgacgatccttcttgtgcggattggtggtgtgggtttggacagggaatcgcgggcgaaagccttgccgagccatttggccggctgacaatggcgacgccgtttggcgttgttcccctccttggaggtgttgttttagcgtacccctttcctttccctaccatattctctgggtgaaaaccttgcttcggttccgaacgagcggtggcggcgatccacgtcgcatcctccttgggggcaccgctttggagaaacctcttcgtgcaaggatattatcattggtctatgcactggcttcgaacttcagtcctaggcctggacgaggccttctagctccatattttgttttgcttttctcagtttgggtcctctcttctcttgtttggtgtgttcaacttgtcttggactacactctcttatggagtggatctttgtaataattggttgtagttctttttaagtaaaagccaggatattatattctattatctaaaaaaatcacggggagtcagcgaaacaaaggaaaagaggtgctccgtgcttcgatggccgttggttctatgcccggcggtggagggcggcggatgaagggcagcggcgagctttgccgtctccagatttgtttctttatttggaaatcgcgaatatacaaaatacgtatacatggcagtaaaaaaaatcaaagttggcatgtttctttatcgtgtccgaatcggtttcctcctgcaagatttttttttgaaacattatttccgcaagatttttggaaacaatttaacgagtatttaacaatcctatcctcctca

SEQ ID NO: 8395 - DNA, 3505 bp, Oryza sativa
caaccccgaggtgctgaacgcgctgaacgggcgacggacgaggccgcggcggaggtgccggcggaggacgcgcggcagagcggcgtcgagggaaagatcacggaggccatggcggcggggaggcggcggttctggcgggacgccgccaacgtcgaggcgctcggggaggcggaactgccggtgttcgaaagggcgctccataagctcaggggcgccgtcgtgcgccgccgccgccgcctcgccgcagcaagaagaagctcctgaattagacattacaccgtgaatgcttgttaattaggtgccactgattaatcaattgcaaacgggtttagggctgccatttaatttgctccgtttttgtttagagatcgagcagctgcaataatgttaaacttaagcatgatggtatgttaagagcttttaattatgcgacggaagaaatgcctttcttgcttgatgctgtcaataatgttttgatcacaagaaattattaatgcatttgtgcgtctacttgttacataaaaatctacttggtacgtaaaaactagatgataccttgcacgttgccacagtataatttgtaatatacatttgtatgtcattgcaaataataccttggggaacattatatataacgattgaattattcaaaatgaaacctcagcaagtttttactgaaaagagaattcaagcaattgtaaaatacaacctgcaaattgtcatagcttatgaatctagttatttagtagtagcagatagtagctttagttatctatactaatataaaaagcatgagttcatcgaatacctatctttcctgacccttagatctattcatccaacggcttatatcaaaagttgaatcaacctatgcaattagccatccccacgttcgattagcagcagttatagcgatacagcgatcgatcacgagaaagaagcggaaaagaaaaaaaaaaacttctcttccgtgccttagcccgtcgccgcctcctggagccgctcgccgcctcctcgcacgcgcccgccggaccgccgggcaccgccgccagctccgagcgcacacccgccggagccgcccccctaccccgccaccacctcgcgcgcgcccgacgctcgccctaccccgccgctgccgcctcctcgcggccgccggtgagccgggttcaccgtcggctggcgccttctccaccaccgccgctgcctcctcgcacgcggcctctggagttctggggtcaccgtcggccggctcctcctcgcgtgcgcccgccggggagctgtggtgggttacggcactacgcagtacagactccaggttaaggtgatgtcctctcttcctaaatcctcaaacaacaaagattttgtgcttttattattttggggtcataaaattgtttacataaggtttgggcagggttgcttatgatacggggccccaaatgtttagtcaattggttctctcgtctcgctatgttatttgctcttgtttaggagataattttacttgctatgaattctgcttgctaagcatctcacaagtatcatatcagtcatgcttcctcaggaaatgtctaaaaacatggtggactgccgatcacacaaatttattctacaaagcaattatcagttaatacctaaggacttggctgactgccgattaccgattatagtgtaaacggtaagcatcagttgtggcagtgcacataattgaataaacaaaatgcccaatgcccctaattaatctgaaagcaatccatcagtttaataaattaagttgtgggatgcaggttgcaattagtgtttggccgtcaggcatctggcattaattagcattcggccatcaggcgtcttgcattctgtctgcttgctttgcctatttgattgggttggatcaggggtccaatgtgatttggtctgggggtcccacactaaaattatacatagcctataggttccacaatatcgttaaccaaagcactcgcccttcccatattcaagtggatccccattgatctaggttggcaaatcttactacactatttcgttacctcgtaagtactaagttcttttatggaacatattttcagatttaattccaatgataggcttgaagatattatgcagttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctctattctctggatcaaagagtgcagaggtccttcaattgcattctacggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaatattaccagattttttttctccaatggaatgttaattgttaagtgcaatatatattcttaattaaagttgtgtgcatagatgacctgccaacaatactatcccgtattgttcagtccattgatgattgaactggatgtcaactccatgtcctcattgtcttgataggcacagggaggcaacaatccaatccaggagagatgggataggatcccagctcaagggagccctggtggcagctacggttgggaggacctaagccctacaggcaagctctataatcaacccccttttgcttaccggcttccagtgatgcaggtactgatcccctcctccagtgatgtaggtactgatcccctcctccctccctctccctccctctttatcacgacattagctgattgatcaccagctttttattccgattgctccagtgaactttgttcacaaaatagtgtttttttcattttctgatgcttgtgtctatcgtgtgactcctccgccgacatgtacattgatatctgcccaactgattgatgaaatgatcgtttacattttttttgttcagtcaatagtttctgatcagcttggagtggtctgtgccatgttgctgtgataatgctacaggttaatcctcctggctctctgtacttaaacaatttctctggatctctttcccttttgttttggacgttatacaatctgttggctaataatggcattcatgaataatagatcatgttaaagctgtttgcatggtctgctgttgtcaaatagttttatgcagtcacaactcttattaaatgatcaggttgacttcaagcattgggctaaaaactaagaatatgtaagttaaataacatatatgccatcatcttcaatttaagtgatattgtgtcaatcttctgatcaactgttcacatcttcggattatatagattcatgtcacctgtgtatgtcttcggaattatcta

SEQ ID NO: 8396 - DNA, 2866 bp, Oryza sativa
tatttatagatgcaatttaaaaggtatgccacttaggaaccgacacttaggcacatgcacctaggcttgatgggtaagtctggccaatttacatatggggaacataaattaatttaatcagttattccaatttattcttctttgtttctatgcattgcaatgccaatttgagtgcctatcttgtcatgctattcagcataatgtcttggcaggctctgcatatgttcatgcttatatatgcagcattcatataagtaaggattaattggatcgcttgctttgtctaatgcagcctcaccatttaatttgtggcgagcaccttaattccatcttgccattaccgagggagtatatcatatgcacctaattctgtatatagagtatttattgactagggtcttggaaatttttgaattgctgtcagatgtaagttcctcaggttgatgatttgattactttcacagctaataccattgatcacagctaaacaccacttatagaagtttaatggatttttatctaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaattattgcatgcattcctttgatatcaaagattgggatgaaatttccagcttaatcctgacagccacaatgtgtcttgagcaaaaggaagcaaagctgcaactgaaacacggtgaatagtaaataaaaatctcgcttttaggaaaaaaaaaggtgagtcgtgcacaagtgctgtaatctggttttggcaaatttttatcgagatatacaactccgttgctttgtttacacaataaacctgaactctaggtgtagcagcttgaagcgttaaaaaagaagatggcagcaaacatatgtttgctttattggatttaatacttggatattccactgtgcttcccaaattgagctgaataaatagcttgacgaattgttctcttaacatgtctcagttgtcctttgtatcaaatgagcagcataagccattcatggattgttcttttccactgtgatacagatagttacttctaatgtttcatggaaaagtttgagcgacaaaaatttcttaagcaagcttacggattgtttctgatgagtttagcaactctatggaaacaagcataagtgcttctcatctaaccagttccaagagagaagtagccaagtaggtagaacaatcccaaaactgcaaacttattttactgtatatatatatatatatatattttcctttttagcattttctgtaaagtcccagttctgtattgcagttggcatggttgtgttcatcagaatattgaatgtcaaatcgaaaggaggcgccaacctatagctatcaacgacatggacaccatggttcagattcataaatttggggatcatggatgtctaggttcagaaatttttggattttagacaacaaattttgtagaattaccaatttagaaaaacacattttgcattttgttataatgtaataaaataccaatttatgtttatttgatgaattatcaaagcaacgcttacagtacttttatttttatcagtgcatatgagctacaatgtatcaatatatatcgctgtgcatcaacaatggatgtgttgttctccaatatacttcgcttagtatatatatcgacgtgccttgcacgtgcacgctcactagtgctaagtaaaagtgctgatgagtctttctattgggagtactgaggctaattagttatcaccaaccatacatccataattattgaggatagaaaaaaatgcacattgatcgattaactttatgtagctactgtcccaaccgagaaagagtaattcacggacaattgattgaatcggcaagttttgtcaatgagaacaacaataactaatttgaaattgagctaaacaatactgaaacttaatccgatggaattctatgaacttttgaggtctgactcaaactaaaaatatgggcgggcgaggagcatacatatacctcaacaaacatacaaatactgaaaagagcgaacctatttagttacacccaatcggtgcatacatatactcgaacaaacatacagtgtaaactgaaaagaaatgaacagatgttgttaaagttgtttgctgcaaaaagataattgagtaaataaaaaggaaaatacaattttattttgatcaagaaaaaagagaagcatatataccagggttactgtgggggggatctgctttgcatcttgtgctatgcaggttaaagctccagcagcatattggtgagagggagattaatcgaaaggaagtaaaattaagaggtaatatatagcaatgctcaccggatcagatcgatgccttgcacactactaccgaagtggtctttccatgcaggcgaaaacgatttacggtccgttcgcatgcacgaaatcgtctataaagatcacgatctttgtatacggccagggcaaccgcatgcgaacatcagatctttgcatgtgggcgcctaagccgaccgcatgcaaagagaaaaaatcacgaaaaaaaataaaattcaaaaaaaaggaaaccctagccggccggccgctcccaccgccgcccaccccccgccgccggccaccccagtcgccgaccacgtcgtcacccgcatctaggggcggatctagaaaaaaatagtagtagggctgaataaactatatcagcataaattgaaccttcagtccccacatcctatgatctatggaaaaaaaattagtgggggcttaagaggatc

SEQ ID NO: 8397 - DNA, 3008 bp, Oryza sativa
aggggaaagggtaaaaaaatagaggggagagagggaggagatgtgttagaaaaaaattgaagtggtgggagggaaaagagagtggagggagatgaaaaagttggggtagtatttttgcatgcagaccacttaagtagccgcatgcaaaaatagtcattaaaaattaatttaaaaatatgagaattttgaatcaaattttatgatattaaatgaactcatatgaaaaggttgtcaaaaacaaagttgtagactcgttgagatctaccaattttcttttggtcatttctccatccgagtttgattgaactatataaaatttaaattttataatgtaagaaattcaaataatttttcggatagtaaatgatttcaaatggaaaagttgtgaacaataaagttatataacttatcaaaatctacaacttttctattggtcatttttctatatgactttgtttgaacagtttgaatttgaatttcaaatgatgacaacttcaaataacattttcaaatactaaatgatttcaactgaacaagttatcaataacaaagtggtataactcatcaagatctataacttttattttggtcatttcttcatctgacaaaatgatttgtaagatttttcacaaaatgaacatatctcttatatagtttcataaactataagagagatatgtattttttgtgaaaatgttactatcactttatcggatgaagaaatgaccgaaataaaagttatagatcttgatgagttatacaactttgttgttgatgactttttcagctgaaatcatttactgcttcaaaatattaaaaagttttgaaattcaaaattttaattgataaacacaaagtcacaacaaaaagttcccaaaataatagtagtaagaacacaataacatgatagagcatgattttagaaacatttaggaaaaagaatcatccaatttggagttcatatgagtaaagatacactagttttaaatttttaaaatttttcaaattttattttcgcatacggctacttaagacacccgtatggaaaaatcgatttttctatgcgggcgcttaagtgagccgcatgcaaaagtgaccttatttttgcatgcggatctcttaagaggcccgtatggaaaaatcgattttttcatacgggcgtcttaagaagccgaatgcgaaaatggcgttcgatttgtacagacgccactaattatggtccgcatgttaaaatgatggggcctcgtacagaaaaatcaacttttcagtagtggcagttatcgaagtcgagaggtcagttgacagtttcgattggggaggcaggataggctgacaaatcaggcttcgctaccaattactactggttgataccccgcgcgttgctgctgacttttgtaaaatgcaataataactaaatttgaccatgaagttagaaagcgatatgctttagtgtgattaagcacggagtatgctttagtgtcaaaaagatgttatcaagattaataattactagcaaaagtgcctgtacgtcgctacgggaagtgtaaagactagaaaattgaggaaaagttgaaaaaaaattacattatgtaattaattgaaatacaaatttccttaaaaacttggaattttctaagttggtaggtgtataattaaatcaattaacaagtaaaataagtgtgaaaacaattatatggttggatttacttttaaaaaaattattcataattaattacaaacataattaattcttcatattttaaattttcagagcttaattgctaattttgataatacaaacataatttcagcatttattctttagcctgcgaattgaaatttcctgttcgtactcttcatggtaaccgaaggtgaagtgttatttgatgcgaactctagatgatttgttgtgtgttggacttgggatgtgtcagggttacggataaggcataccctctatcctacgacttatggaatataccgataaggtataccttcacatatacggatggtttccgtatacgccgttaggaatttgcctcaagttaaggaatatcccccacgaagttaaggaattgccgaagttctactcggaaaaggtaaaatctctaatatatcgtgtcggtttacatatctccaagtcttgcttgagagtcgaggtattccacagtataaaagggacccctagggagaggcaaagggcattgcatctcatcgccaacacacccaccaaagtttacgaagccggagtccacgaagccaactcgccgggagatctcgtcgaaaccctcgacaaagatctcatcagtatcccctatttcggttactctctttgtaatctattctcatcaacatcaatcccatataaactggactagggctattacctgataaggggcctgaaccagtataatccttgtcttttgtttgttttgatgtcgtactacgtagatccctgttccaacgtaccccaataccctattcttctggtccgcgagtatcactcgtcgacaggatgttgcggacaaaaataggtgaggacggacgaaaatttcaccggaagattaggtataggtatttaggtatatagaaagttagattagagatagagaacgtataaacgatgaatacgatagaaatcggacttttttgctgcactttttttccctttttacatacaatcggacttttttcgctcttttttttattttaggcggacaacggaaacgttttcaattatttaggtagtagagattagccattttcattttcaattatttagtttattaatatataattaattaagtattagcaaaacttaatttaaaaaatagattatatgttttttaaagcaactttcatatagataatttttgtgaaaaatgcgtcatttagtagtcttagaaggaaagaactcagccctaagggatcaaaattgaacttattctgtgcggagtgtacatgcggcccataatgcagccaattgtgtggtgagccacagccatctg

SEQ ID NO: 8398 - DNA, 926 bp, Oryza sativa
aactcagccctaagggatcaaaattgaacttattctgtgcggagtgtacatgcggcccataatgcagccaattgtgtggagagccacagccatctgatctgatcttcggtcccggttgatctggatctatataaaagttcggcagcccaaaccctaaccctaaaatcatttcccctccccctctctcttaaaacgacagcgtcaacggcgcctcttcccgtccgttgtagcggcgctgctccccctctccctcccacagtggcaggcagcggcaagtggtgacgccctcccttttgggaggagcagaggtagcgagcagggtggtgccctcccctccgctagatctagcgggaggggaggcagcggcggccccgtgtcccagcgatggcccggcgtcccagcagcggcgcctctctctctctctctcaaaacgacggcgccagcgacactgttcccctccccctctcccaccggcggtgacgccgctccccctccccctccacggtggcgggcaggggcagcgccctcccctccgccagatctagtgggaggggaggcagcgtcagcctgacatccctgcgatgacggcggcggttctatggcgacggcagcaccctccccttccggcctcggtgtttgagcttatgatgtgtcttgtgttgtcgttgttgttgatgaaatatgttcttgtgttcttatagtattgttttctccaggagttgggtccaaatttgatgcggactcgcattaagtgttaaattgaatcggactttctcttgtttttttgtttgtatgtttttataacccttttttcgtaattacggcgatggaaacgttttcaattttttaagtagtagagatagagattacgattaagatatatcgcttcagaagtgtttttaattaattattatacaataaaaaat

SEQ ID NO: 8399 - DNA, 884 bp, Oryza sativa
  unsure (1)..(884): unsure at all n locations
ttttggaaacaatttaacgagtatttaacaatcctatcctcctcaacctgcaaattgcattgatcgagtcgagccttccagggcagagcacgcaaagaaggaagaagccgcaccgcccacgcccccgccgtctcctccgccgctgcctctgcctcctccgccgtcaacgcaagagccagccatgggtcggccgcgaggggggactagcaaggggaagcagaagatcgagatgtgctgcatcgacggcaaggagaaacggcaggtcaccttctccaagcgccgccggggcctcttcaagaaggcgtccgagatatccacgctctccggcgcgtccatcgccatcgtctccttctccaaggccggcaacgtcttcgccttcggctcgccgagcgtcgacgccgtcctccgccgccacgtcgtggccgggccttccacctccacctcccacgcccacgccggcggcgacgtcttcgcggacgacggcggcgacaaccccgaggtgctgaacgcgctgaagcgggcgacggacgaggccgcggcggaggtggcggcggaggacgcgcggcagagcggcgtcgagggaaagatcacggaggccatggcggcggggaggcggcggttctggtgggacgccgccaacgtcgaggcgctcggggaggcggagctgccggtgttcgaaagggcgctccataagctcaggggcgccgtcgtgcgccgccgccgccgcctcgccgcagcaagaagaagctcctgaattagacattacaccgtgaatgcttgttaattaggtgccactgattaatcaattgcaaacgggtttaggnnnnnnnnnnnnnnnnnnnnnnnnnnnnnnnnnnnnnnnnnnnnnnnnnnnnnnnnnnnnn

SEQ ID NO: 8400 - DNA, 992 bp, Oryza sativa
ttcgaaaaaaatgtgcgccgccaacgcacgcatgagctagcttttccgattataactagcgctgaggctcaacaccaacaaggttagtgttgaaacatttgaccccgacgccaaggactttggcattgagcttttcccccaatttgttcaataaatccctttaggggtctatatttggaatatctttcattttcaaatataaatacttctaattaaggatctagacatttacgttcaaatttataaaaataataagaaaaaaagtgtgacttaccccataaactattacggccgatcgattaccccctaaacttaaataccagacattacatatcctcaattattcaaacgagacaaataactcacctgcatcaatccgacgtggttttcatcctacgaggcagtctagtcagtattttttttcaaaaaagaatcatgggacccgtttgtcatattctctttactctctctttcccctcttccctccctctatctctcttagtccctggttgcgccggcggctacgagtctcctcgcgctcgtaccggcgaaggctaaggagggaccaagcactgtgcgccgatggaggccgaggagtcgtgtgccactgctggcagagactgagggaccaagcgttgcgcgttgacgaaggccaaggagttgcatgccgccgccagtgaagacggaggctgaggaggagttgcggccgccacgcgtgcgtttggtggaggccgaggatcaggagccacgcgtcgtgtgccggcgtagcccgaggaggagctgcagcgactatgactctcctcgtgcatgtgccggcgaaggccgaggaggaggtgcaccctagcagtgcccggatggtgatggaggtgtatttggagttggggaatgtgacagcaagcgcgccgtggtaggatcgaagaggagaggatacatttgcgttgctcggcttggtggggaaggctgtctcgcgaggagatgctgggacggccatt

SEQ ID NO: 8401 - DNA, 621 bp, Oryza sativa
acaccagtcggcggcggatgaggcggccggtcggtgaagacgtagacgcccaacatcggcggcataataggtcagccgtgcaggcggaaacaacagttggcgtcggacgaggcggccggtcggtgaaaacgtagacgcccaacaacggcggcataataggtcagccgtgcaggcggaaacaccagtcggcggcggacgaggcggctggtcagtgaagacgtagacgcccaacaatggcggcataataggccagccgtgcaggcggaaacaccagtcggtggcggacgaggcggccggtcggtgaagtgcaggtggaaacaacagtcggcggtggacgaggcggccggtcggtgaagacgtagacgcccaacaacggtggcataataggtcagccgtgcaggcggaaacaacagtcggcggtggacgaggcggccggtcggtgaagacgtagacgcccaacaacggcggcataataggtcagccgtgcaggcggaaacaacagtcggcggcggacaaggcggccggtcggtgaagacgtagacgcccaacaacggcggcataataggtcagccgtgcaggcggaaacaccagtccgcggcggacgaggcggccggtcggtga

SEQ ID NO: 8402 - DNA, 707 bp, Oryza sativa
ggctgctagggaaagtagcacacgaattgtggtcaatctagcaacaggtgagtaagtgcgaaagaaatcttcgccttctttctgagtgtagcccttagcaacaagccgagccttgtacttttcaatagtaccgtcaggcctaagcttcttcttcaacacccacttgcatctcacaggtttatacccatagggtcgctctgtcacctcccaagtcccgttagcgataatggaatccatttcactacggacagcctccttccagtagtctgcatcaggagatgcatatgcttctgaaattgatttaggagtgtcatccacgaggtacacagtgaaatcatcaccaaaggacttagccgtcctttgtctcttactccttcgaggagcttcactgtcatcctcctcagtgacatgttcatgtgtatgttcagtttgttctggtggtgtgattgaactgagaattatttcagatggttggctcgaactactatgtgtatccttcattgggaaaaagctctcaaagaaggtagcatcacgagactccataattgtaccaacatgtatgttaggtacctcagatttgactattaaaaatctataggccatgctgtgatgagcatatcccagaaagacacagtccacagtcttaggtcccagtttgcgcttcttcgttattggtacattgactttcgccaagcacccccatgtgc

SEQ ID NO: 8403 - DNA, 559 bp, Oryza sativa
  unsure (1)..(559): unsure at all n locations
aacaactgggatcttggcgctgtcgtgaggtttgggtgcggcgggggacgggtgagcccggcggcggcgttgctgggcgaggcgtgggagtacgacgacgacccgttctcgtcgttcctcgcgccgcccatgacggcgcagcaggcggcgctgcccgccgtgtgggaagagggagacgacggggacgcggcgtggatggcgccgctcccggggcttcagaccggtggtggctggggtgatcaggcccccatggtcgtcgacgagctctgcggggccctcgttgtggcccctcctccacctccgaagcaacaggaggtgcttcaggtccagcagcagccgccgccggcggacaacacgcagcccactacctaccagcagggatccggcggcgacggtgagagcactcgcgccggcggatcaaggtcggcgaggagaaagtatgcggcctccgctatttatatagtctccgtttgcttttctgattcttgcataatgtggannnnnnnnnnnnnnnnnnnnnnnnnnnnnnnnnnnnnnnnnnnnnnnnnnnnnnnnnnnn

SEQ ID NO: 8404 - DNA, 573 bp, Oryza sativa
attcttagaccacctcaattgtgtcgttcactgggtgccgtttagaaaatgggcatcaatggatgtttcccaacaggtatctatagttgttcttgtacaagtgggtacttgtgtgtagtaccgtgtaacatgcatagtgattgctactagagagaattaagagatggtacctgtctatactacatgtagcgtggaacactgttgttctcattttcacggacctatgcttgaaaccaaggtatcatgtcctaaacctatgtgtactatatatatcggcacaatgatcccgcggctctatgcgtttccaataagattcgcctcggcgatgttaaatttcgagcaaaataaggtcagaggtgtttctgatgacaatagcacttcaggtcacacgttggctgagtactatacctcagttttcgcgagcactctttctaatcaaaagctgctaaacttaattaataatgggcagcatttattaaaataaatgtaaaatttattttccaaattaataatatataatacttaatttatcatgagtcaattagccgttgaaaagtgtgcctggttaataag

SEQ ID NO: 8405 - DNA, 147 bp, Oryza sativa
ccttgtaccccttgttggattgtccggataggttgctaagtgcaggccaatcgttgatggttacgaatagcagcgctcgtatgttaaactcctcctgtttgtccctcgtccacatggggacaccttccttcttccacaacagcttaa

SEQ ID NO: 8406 - DNA, 4618 bp, Oryza sativa
  unsure (1)..(4618): unsure at all n locations
ccttttcactttcgcagtcctccttggcgtcctgcaacatctgaccaagatcatccgcaacgtcgttaccatcagcatccatttcctcctcgcccgtttgatttccttcaaatccaacgtactgagcaaagtctggaatattgtcgtcttccacttcatcttcttccatttcaacaccttgctctccgtgggatgtccaacaattatagcttggcatgaaccccgactcaaacaagtggaaatgaatagttctgcatgcagaatactccttctgattcttacacttattacatggataacaaataaaacctctttgcctgttagcttcggccactctcaaaaaatagtgcacgccgtcaataaacactttggaccgccggtcagcgtacatccattgccgatccatctacatgagtcgaaaaaaaatcgtacaaaaataattattcttacaataatgacagtcatacaataattataagataattacaaactgtttcaacagtcatacaataatgacatatctttattcatacaaaaatcatgaaatattacaccaaataattcttatttactatttctaaagttttaaactaattttaatgtgttttacttcttttaattttcattttagttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaaacattggaggatgaagttgcaaaccttttaggcacctccgatttgtatgtaattaccaaaataaattcactagaaattttggcatcacctcccctcttttttgaagaaattttgaagcttgctcgggcagctggaggaggaagaagacataaatataggggtgggactttagtcccggttagtgttaccaatcggggctaaagatcccgggatctttagtcccggttggtaagttacgatctttagtcccggttggtaccaaccgggactaaagatcccggggggcctgacaggccctgacaacatttgaaccgggactaaagatgatctttagtcccggttaaaaagggtaacgcgcatatttaaagatcatctttagccccggtttttattgcatccgggactagtgtggagttcggccgaccgacaaaagatggtttctccaccagtgtgtgtaagggttcaacgatgtcgcctttttaaatactctctccgtcccataatataagggattttgagtttttgcttgcaccgtttgattactcgtcttattaaaaaaaatttggaattattatttattttttttgtcacttactttattatccaaagtactttaagaacaacttttcgtttttatatttgcacaaattttttaaataagacaagtggtcaaacaatgcaaacaaaaactcaaaatcccttttattatgggacggagagagaagtagtatatggaggatgctgaggaacgtccatttgaactatatgtcatccgaaattcatactctcttccgggacaaatatgtagtgatataattaattaagcgtttattagttagattgacatggttttcggtgttgaaattagaatcagtacggcacaactcgtttttttactaaacatgtaattaataaaattgctaattaagttaatagttagctaaaagttctaaatgtcatttttgtataacacatgtatatatgtatttcaattatctactgtggtagtatattataaagcggcatcaatgtattgtaatatcatagctaggaaacacattagctaggcatgcaagaaaaattctggtccagcaacagtgctaaaataaaaagcatagaaagggagttatcacctcccacccaaaatgaacgtacgacacccaagtaaaacaacaataagaaaataacaaataaacaaaaggtccagtaaaaaaaaacaaaaggattgatcttccttacatatctgttgcacccaaattgtctaatttgttatggaaaataagcataagcatagatatattttttagataatggaaatgggttacatctccggcttctgttataagacacacagccataagcatagatatataaataaggttcttaattatccatgtggcacgtaattgttaattaacgcctttgttcggtttgaaggggattaagggagaataattccacaccacaataggtgttgaataaattgggaaataagtaacaatattgatgtggcgctagagtcttgatcatatccatcatgtttcgaatccaagtgtcaaaataaataaggtcacatgcatccttgggtactgcatgtagggatggaaattatgcatgtgatctatatatgtacataaaattataattaagtaaagctaatgatgcgttcaatatggtttatattctagggttttgccttctcctctgtgctgcgtcgtcgctcgtagactactccattccgctcgcangcgtgcacctgcaatcgggagagcaggtctccggaacctctgccttctacgtcctgcaccgggagaaggcggcaataaggtttttggaaagtacttggtgcgactgctccctgttagtccgcaaaggatcgtattcctattcgctcgcgtgctgtgcgccgtcttcgacgtcccgcaaccggaagtagttcctgcagagcaactggtctttccgccacttcggtatgtgttcgacatgttgtgcatatttgatctgttcatgttttactgattagtttacatgtgtagatctaatgatgcgttcaatctagtttacatatgcaatgtcatgatttatttatgaaataaattaaatcattattttgttataatttcaacaatccaaaccttatataggcactgtgattttactatggctggttttgccgatgcactgaggccggataaattcaccggtgtgcacttcaagagatagcagatcagggtcactctgtggctgacagctatgaaatgcttctgggtgagtacaggcaagcctatgggcgttcttaatgttgatcagcagaaagaattcgatgaggccactactctctttgtgggatgcattcttagcgtgcttggcgatcgtctggtcaaggtgtatatgcatatgaccgacgctaaggagttgtgggatgcactgaatactaaattcggtgctacggatgctagcaatgatctgtatatcatggagcagtttcataactacaagatggctgacaaccgttctgtagtcgaacaggctcatgagatacaaaccatggttaaggaactcgaactccttaagtgtgtcttacccgacaaatttgtggtcgggtgcattattgcgaaactacctctatcttggagaggtttcggtactgcactcaaccacaagagacaggaatactctgttgaggggttgatagcgtctcttgatgttgaggagaaagctcgggaaaaagatgccgcgtctaaaggcgatggtggccagtccactgccaatgttgtgcacaaggccctgaacaagagcaaggggaaatacaaagctcaacagaccaccaacttcaagaagaagaacaacaacaacaattctaatcaggatgataggacttgctttgtgtgtggtcaacctggccatctggccaggaagtatccacaacgcaaggggatgaaggcacctgcagggcagacctctaagtctgctaatgtgaccattggcaacactggagatggaagcgggtatggtaatttacctactgttttttcagttaatcagtctactaattggtgggttgatactggggccaatgtacatgtttgtgctggcatctcattgttttcttcttatcaggtcgcacggggatccaccgtcctaatggggaatgggtcacatgcttctgttcatggtgttggcacggtagatctgaagtttacttcgggaaagatcgtgtagctgaagaatgtgcagcatatctcttctatcgacaggaatcttgttagtggctcctgtctgactagagacggatttaagttggttttagagtctaataaagtagttatgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcagctttccagcatgtgtttaattcctaagttttccattgtcaaaggttctaagtgccatagttgtgtgcaattgaagcaacctcgcaagcctcacaaggctgccgaggagagaaacttggcaccattagaactcctacattcagatctttgtgaaatgaatggggtgttgacgaagggtggaaaacgatatttcatgacgttgattgatgatgctactagattttgctatgtgaacttgttgaaaacgaaagacgaagctctagactattttaaaatttataaggcaga

SEQ ID NO: 8407 - DNA, 16276 bp, Oryza sativa
  unsure (1)..(16276): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttctgatttctgcaataagtctgtgaaccatatttgtggcagtgtggatgatgaggctaatgtttggcactcacgtttatgtcatattaattttggcttgatgtctcagctttccagcatgtgtttaattcctaagttttccattgtcaaaggttctaagtgccatagttgtgtgcaattgaagcaacctcgcaagcctcacaaggctgccgaggagagaaacttggcaccattagaactcctacattcagatctttgtgaaatgaatggggtgttgacgaagggtggaaaacgatatttcatgacgttgattgatgatgctactagattttgctatgtgaacttgttgaaaacgaaagacgaagctctagactattttaaaatttataaggcagaagttgaaaatcaacttgacagaaagataaaaagggttaggtctgatcgtggtggagagtttttctcaaacgagtttgacttattctatgaggaacatggcatcatacatgagaggacgcctccctattctcccgagtctaatgggattactgaaaggaagaaccgcacactgactgacttggtgaatgccgtgttggacacagtgggactacctaaggcatggtggggggaggcattgttgacctcgaatcatatgctaaatagagttcctaacagaaataagaacaaaacaccatatgagatatggattgggagaaaaccatcactttcttacttgcgcacatgggggtgcttggtgaaagtcaatgtacaaataacgaagaagcgcaaacttggacctaagactgtggactgtgtctttctgggatatgctcatcacagcattgcctatagatttttaatagttaaatctgaggtacctaacatgcatgttggtacaatcatggagtctcgtgatgctaccttctttgaaagctttttcccaatgaaggatacacatagtagttctagtcaaacctctgaaataattcccaattcaatcacaccaccagaacaaactgaacatacacacgaacatgtcactgaggaggatgacagtgaagctcctcgaaggagtaaaagacaaaggacgactaagtcttttggtgatgatttcactgtgtacctcatggacgacactcctaagtcaatttcagaagcatatgcatctcctgatgcagactagtggaaggaggctgtccatagtgaaatggattccattatcgctaacggaacttgggaggtaacagaacgaccctatgggtgtaaacctgtggggtgcaaatgggtgttcaaaaagaagctgaggcctgatggtaccattgaaaagtataaggctcggcttgttgctaagggctatactcagaaagaaggcgaaaatttttttgacacttactcacctgttgctagattgaccacaagtcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaaactcctaagaaatggcatgagaaatttgacaaaacattgacatctgcaggctttgcagtcaatgaggcaaataaatgtgtgtactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcctaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcctaaatcattggctcgttgatgtacctggctagtgtaactaggcctgatatctcctttgctgtgagcaagttgagccggtttacctctaatccgggagatgatcactggcgtgcgcttgagcgagtaatgcgctatctgaaaggtactatggaattggggcttcactattctaggtatcctgcagtaatggaaggatatagtgattctaactggatctctgatgtggatgagatcaaagccactagtggatatgtcttcacactaggtggtggtgctgtctcatggaggtcttgcaaacagaccattttgacgaggtcaaccatggaagcagagttgacggcactggatactgctaatgttgaggcagaatggctgcgtgatctattaatggatctccctattgttgaaaaaccagtgccggctatccttatgaacagtgacaatcaaacggtaattgtcaaagtgaatagttctaaggataatatgaaatcgtctagacatgtgaaaagacgattgaagtctgtcaggaaattgagaaactccggagttataacattgggttacatccaaacagctagaaacctggcagatcccttcacgaagggactatcatgaaatgtgatagacaatgcatcgaaggagatgggtttgacacccatgtgaattatactatggtggtaacccagtctatgtgatcgaagatcccgtgaattagaacctgggaagaacaaactattagtaaactataagagagtaccgagatataccctctctaagtgaagatgcatgtactctcgtgagctgcaaggcaggttggctatgccttaatgagttctgttggctttaattagcgaagatgctgtcctgcagagcattcttgaaagaactcacctttgtgagcttgactgttggtcgcagtctatggagattttgggtgaatcttctaggaagcttactaaagacctaagagtatgacttatatgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgttcaaccttaatcggtctccatcaaaccgctggtatataaacagtacattggaaaaggcaaatctcagtgggattttgagatttggtgggggattgttggaattaataaatgggctaaggcccattcgaagattaactctttggaaaatcacaaaagcccaccacatgggatggcatgcatgtgaagtttagtaccaccttacttattctaggagagggggacctccttaaaagggagatgccctcctagccacttgaagcatgtgtggtggagagaagggggaaaacacgcgcgcgcgctcactcgcctcgcctggcctagcagggcagggctggcggcgcgcgtgcacgacgtacacgtcgaatgatccgcaaaattggctcctcacccttgcgcagatgcagcttccttttgcagttttgttttgctacaggaaaattcggatttgttttgttttggaaacattccgaaaaatccggtgcgtgaaaacggcgtgaagtccggataagttacgcgcgacttatccggttcggttacgcggagtggagatcgtgcgggcgccctgatcaagcgacctatctctatataaaccgagccgccgccttcacgcaacacacacgaaatcaatctagggtttgcctcctcctctgttctgcgccgttgctcgtagactactccatcccgctcgcaggcgtgcacctgcaatcgggagagcaggtctccgaaacctctgccttcgacgtcctgcaccgagaaaaggcggcaataaggtttttgggaagcgcttggcgcgactgctccctgttcgtccgcgacggctcgtcttcctcttcgctcgcgtgctgcgcgccgtcgtcgacacccacaaccgcgagtagttcctgccgagcaatcggtttttccgccacctcggtacgtgttcgacatgttgcgcatatttgatctgttcatgttttactgcttagtttagatgtatagatctaatgatgcgttcaatctagtttacatatgcaatgtcatgatttatttatagaaattaaatcattatgtgcttataatttcaacaatctatgcgtccccaaaaagtctatttgggataggatatgatctatcctaagataggaatgccctgtttggtttagggactaaattttaatccctatcacatcgaatgtttgacactaattagaagtactaaacgtagactaatgccaaaacccattccataaccttggactaatttgcgagataaatctattaagcctaattaatccataattaacatatgtgatgctatagtaaacatgttctaatcatagattaattaggcttaaaaaatttgtctcgcgaattagctcttatttaatcaattagttttattattattctacgttcaatagttctaactagtgtccaaacatccgaagtgacaaagactaaaatttagtccttagatccaaacaccacctaagacaggaatctagatatctagattcgttgttctatgataggccacgtcatatcctagattatttctttttggaacggagggagtaagtatactatcgatcataatggcgacgtgaccaataatatacgtgtacaattaccaactgtgtactccctctgtcctataatataagggattttttagggaggtctagacaggctccttatctagattcgtcaaactatgatgtgccatatacttttaaaatcctttatattatgtgacgaagggagtaatacagatttatatgtgtgatatgacatgtagatatcttttgtgggttctcaaaccacggtatactaatatgactgcgatatgtttacgtaacctttatagcgaggtagatttattttcagataagtggaatcgactttgtacatagtaaactctaaataattagtatgtatgcactcatgaaatcggatcaatgatcttaattattaagccttgattttgcatataacgtgcgcacatgatcaattcaagtatcttatctatctacttcctccgtttcagattataagacgttttgactttgatcaaagtcatattgtttcaagattgactaagtttatagacaaatatagtaatatttataatactaaattagttttatcaaatcaataattaaatatatttttataataagtttatcttgggttgaaaatgttactactttttttataaacttggtcaaatttaaagcagtttcactactacaggaaagattttcttggataccggacccttttatttctaggcggactgtaaatggaactgcaaaggaaatggggcggggggggggggggtacatgcgccagaccatcgcccgcataggaaaatcaattttcgtgtgcgggtcactatatagtccaccctacacgaaaatagtccaccctacatcgagcgctcgatatcctttcgcgcccctcgcccctccgcccactgccccactacctccctctctcccacctcactctctccctctctcccactccactcctctcctcccactcagcggagacagcaggcagcggtgggtgatatagcggcagcgcttggcccctccctccctctccctctgctgtgggtgggaagaggggcagtgacagcggtggcggcgggcgaccacggcggcgtgcggcccctcccctccctgcccttgcatatccggtggaggggaaacatgggggcctggtggatccggcaaagctgcgaaaggcgacgtgcgggggcgggaaggaggaagcccccccccctcggtggcgggaggcagttggacaaagtcggcctgcgtccctcggcggtgttaggtggtgggacaaaggcggcccgcgccggatctggaggtgtggcagtgtcaacggctggtgtggaggtgtgactatcggcaggaggtgcgacagtggcatcagcgatcgatgtgagttgatgcccctcccctcccctcccctccccttgcagatctagcggaggggaggagcgtcttcagctggcgactatggatccgacaccagcgacgggagcgggtggtagatctgtagccggcgaccgcgggggcaacggtggcgggcctcggctagggcaggggagattaggattagggttttgtttttattttttttgtttcgatattttattatctcgtgcgggcagcttaagcgcccgcacgcgaaaatccgattttcgcgtgcgggtgaggcacctgcatgtgaaaatcacgattttcccagacccctgggtgcgagcgggccgaccatccgcgcagaaaaattattttcgaccgcacgcaaaaatctttattgtagtagtgtttgactttgactaaagtcaaaacgtcttataactgaaatggagggagtagaaaacaatattttccctttagtaaactcatgaaaccatccggctttgcaatttcaatagacactaaaatttctgttgttgccaaaattttgaaaatttcatgaatttcgatgttttctaaccggaaatattttaagttttaacatatttttgaccaaatttacaaatatttaaaaaaattagaaaaattttgggggagatttgtgcttgccggtggagcaaaatttgtttttttgaacgactcgcacaagacggtgcgaagttttattgatagagcagaaaaaaattacaagattaaccaagaaaaaggaaaaaatataccaccacccacacaccgacagcgccaacacatgggtccgggagaaggctagcaccggacaggccgtcactaagcgtgaccaaccgccactaggccaacaaaggaacacagaagagaacgcccaaaaaacgcccttacaaccaacacaaagcccaactccatctagattgtgcttgcaccaatcgttcgagtggtttcggcaaggggatgcctaaacgacgtctccaacgagagaagcgacggaaaaccgtcgccaccatccgtcagggactcaaaagagccaagattgggctttcgcctggcaaacacctttgagggatgagacggcacgacaacgccctcaggagggggaatgaaccatcgttgtcggtccagtcaagaccaagctgggttttcacccaccgctcatcacctgcaaatccacggctgacgcaccgatgctccaccacagctcaacctctgccgatgtgtgggaccactgcaccccgtccccgccggctagccttcgtgcgccgaagaccgcgccacaccctcaatctattatcagtcatatgtatgagagcaaccacggtatatcgaaaggtaaccttatggcaatgattacatttataaagtggaacacatacattgtgagaaatagctttagcttagagtgcatcttatacttaaggtctaccacaagcataaagaaaatattctctctctcatttatgtcatgaacaagagctgaaaagcaggtttttctatctcataagggccccatattattgttaaatttcagcaagggattagctaaaaaactgttgcaggttttttgagtaaaaaactttcaaatctaactatagtacataattttactagaactacactataataattatataacttgtatagatgtattaaaataatatatgcaactttatatctaatttgatagagataataatgtagttactgtaactagggtataactggagtataagtaacatgtaacttgctaattttttaaaaaacttgcaagctggtgggatcgaggtcctgggttcgaaccccatgcagcgcacaaattatgtttctcacacgggatttttttccatgaacgcgccagcacgaatcttgagatgaatctgacggtcaaaaattcgaaagaatttacccccgttttctgtcgatagaaaactagcaaatccgtttcagcaatagcattatgggaattgctttaacaacaatcaaactattcatgggccacttctaagatcacactagacccatatacattgagattgccctgatatatccatctaattcatggacattttcctagtcttggggggatataatataataggagctagaggggggcatgggtagtgaagtccagccagcgcagaagatccttggggggatctggttgcaatggggatggccaatgaggagtcgccaaattatcaggtgaaaaaaggcggccggattcctccacgtaaggaccaaatccatccacagatcgccccgctctcctcgatcgatcataatatgatctcgcaatggcccccctacctttccctcatccccaacttgccctgtcttcttcttcttcttcttcttgtacctatattattacaagtcatcgatctcgctgatcgatcagtgatcacaagcatttcacaaccctagctagctgagctgatcgagctcaagtgacctcacctgctatagctaacttactagctagctctagctagttgttgtttgtagctcgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcgtgagtatcaatccaataatcctgatccggccggcatgatcggctcgattgagccgtgtcgattattaatttccatcttatatattattaattgatgaattcttgattgattcatcgatcctcctcgtcttttcttggcttctttgtttttgttatttagtcaaaaacaactcttcatttctgctgcctatatgccgtacaacttcaaactatcaaaggtcaaataatcgatcaatatataccaagtttgaattaatttggagcttaattaattaattactggcttgcagcagctggtttatagtattgtttctagctatatatgtgagggccgtgtgtgggatgtgatttgcatctttcgatggcgacttaattaattcgatgatatatttcattgcatatgcatacggatccagcctctgtctatactgtacgattccacatacgtatatgtacggttaagtcagtatatatacttttagatagtcgcgtgtgcttttcgagttcggtagctatattttagattgtaaaaacaagtcagaggctaattttataatctagaaatacttatttccccatatataagcgtatgttaaatattgatggtgtaatctacttatatgtcaggaaacatcattgcttgctttctggcgctttcttctacatatcagtagaggaaaatggaaaaaaaaagatgaattttgatgttgtagtttgctatattcagcatatataccatcagttatacatatgcagatcttgctaaaaccaaaataaaaatagaactgtaaggagatattgtgcttctcggtctatttacttacagtttgttgagaagtaatacgagcaagcaaatgtatatatatatttctttagaactgcaaggagatgcatatacatgtgtgattcaaacacacgtactgcacattcaaactataaaaacaacttgattgccgtagaagttaaaagggagacatatccatgggtttcggattctaaatcaatctatgtgtaaatgaaactttagtatagtaggaaataggttttcaaaaaaaaaagtatagtaggaaatagtatgtgtatatgcctttttaacccttaattacaagttgttataattcagtgttaacaaagtcacggactcacagagtgtgcccttacacaatttcagactaatttgtaaatgcatcgatcgtcacattttatgtggttcaattatctgacacagttaattaatggtggccgatcgatgtatgctcttctagctttccagctatatgcgtatgtaataaatgaataaaacgtgtaggatgaaatgtgaatacgcatcattgtaattaatttgattaatgctagtaaaaaatctgcaaatttgtctttttgaaattaaaatatgccttataaaattaatggacccaggcccctagggcaaaatatattggggcacaaaatcatgtccatatatacattcttatttgaaagtagactctgaaacaaaatatgcccatataaatcaagggaggttacaactaactgcatttgcttatgcgtacatctggattgtaacttctatgttttgtacatacgatgattaattgtattcgagcttcttaattgtacatctattaactaactagttttgcagatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatagataattacagtgcgtatataccactgactatatatgactgatcatcatgcatcacatatatatatatatatatatgcattattagaccatacatacatatatatatatatatatatatatatatatatatatatatatatatatatatatgtgcttgcatataacctatatatttaggcatgcaattcggtaatatatatatatatatatatatatatatatatatatatatatatatataattagtgatcgatggcccattcagaaaacttgattgcatgcatatacattagcttgctgaataagaaggttgatctgcatgaagataagaaggttgatcatggaaatgtatgattcaaacatatatttgttcaagaatcaagaggttccttagatgctttatcactctttatattctttaaaccagctaatatttcttttgccaaaattgaatcccgcatgcagtagctctgatcaggaagcacaattaatggtgctgggatacataggataattatttggattcaagtgctagtctttcagattttgtccaaattgactaggttacaagaaaaatccctaattcaaagttccacgtatcctctatatatactttcgctaaagatcgataaccatgttggcacaccaaaataaatgtctaaagaaaacagggtccttaattaattcttccatgcatacatcacacacaatataatagtggaacataagataagatgatagagaaatattattgtgcatgcatgtatatatatttgtgccatgagagagcatacatgtatcatgcacaatatccaactaaaaattggttcctttttaatagcacacagccactaaaacttgggaaataaatctagctaacttctgttccgttcacctttagttatgaaattacttggaaagaaattattggccggaaactagtttctgatatgatattgaatgaatttcatgtttgacaagttaaaataatttgtaatacatattcaactaagctctagttcaatttccataagaacaatctggctccattataactgatcataatgttatctaaccggtggtagcgatcaatcgagttagttgatggaattataacaacttgtaattaaggctatctatcggggcaatatatcctatgcacacgagcttaccgtgcacacttcgtgcacaccaactaacaatgtcataaaaaattttataaaaaaattgacatttactcctaatagtactacacatatctacaaagtctcgtattgaaattcattatattgtagccgtaacaaaaaagttaaaaatcttacagttttaagggtaaaaaactgtcagaattttgtcttttttgctacggctaaaatataatgaatttaaagataagatttcacatgtagttgtaatactattggaagtatgtgtcatatttgttttagaattttctgcgatatttgctagttggtatgtatggagtgtgtacgggaagtttgtgtgcataggatatgttcccatttatcaatggtaaagagtattggctactcagttgatccagcagtttgcagttggactttctaccatgaaattatagagaaattcttataatcgatactatagaaaacactatcattgccggttcataattggcaccagcgacagttttttaactagtggtaacaaattaagtggcaaagatatttggggagtataaaaggagttatatagaaactggccattttgatagtaggatcttaattacgtttgaattttgcaacccccaaaatataaggccaagtagtatgacatggtttttcatacaaatatatatgtgtgcatgcggacaaatggagtaaaacaggcgacctctatctgtcatgcaaaggctctttaccatctcaccaataagatagatgctttaatttgacccttcttttccaaaacttattgacgaatatttgggcatctaaataaaatggaaaaggtttcacctatatgaaagttgtacatctctcgtgcatagagagctacagcattgattttttttcttcatccgtattagtatgaaaaaattatgaattttctaagttataggttgctataccattatttttcactcctggaacacaatattgtttggctcagccttgtcactatgtgttataaaggtggcctatattaatgtttgtataatggcaaacattcaactggaacctggaagttaattaggattgataagaaaaaaaatacctcttctgatttatgttctcctattaactatatctttgttgtcttcttattttctcctcctaaagcggtgaaagtatggcactttagtgaggtcatggatttgccacatgattcctccaagtgtgaataaaaggaacgcactcatggaagtatatgtccatgcatcttctatataatctgaaaaaaaagagaacatcttacaccactttttctcacttgactttgtggaagatgcccgattgaatgatctccattggccgggttgggttctaccatatatgttctcatacctgatctcattcagtagtatattcttttttcctagcccatatctgtttctactaattaatatagagaaagtcttcgatcccttgagagaaataaaaagtaacaataaaagatacatagcactgcatgtgagttgttaattaaaagtcgaaaatagttttttttattgaagtttgttagcacataaatttccaaattaagcagcacccacttacacacactagaacgggattgcttatctgtgacgggctgaaagcctcatcactatcgggtaaggtccccgttactgggcaaaggtcactgatgtgagaaaatatctcaatccggcaaaagctcgtcacggatggatgttatctcaatcgggccgaaaacaaagcccgtcacagatgagtatgaccagtcaaaccagcgtagttaggagcccgtcacggatgactaatctcaatcgggcacacaactaaacccgtcacggatgagctgtcatctcaatcgggcatttagataaagcccgtcaccaataggtttgaccccacgtgtggagtcaaactagtcccggttcggatgacttatctctaacgggcttgaccctacagcccgtcacggatgacatatctcttttgggcattactaaaatgcccgtcaaggatgagtttggaaccaaaaaaaaatttataatttggctagcctcaggcctttgctagccatgcccgctgcaaaaattgacagaagcacatttatatagttgttgacaaaaaacacgaggcctcggagatctgcttaactccagtgcaggtccaaagctcgccttcgaatgtatgagcatgccagttgatttgatcctgtaatcaacaagaaatagagacaaagaattcgtggttaaatctataaatgatagccgatcggctaggtgccgatgacatatcatttatctttgagccgatgtcatatatgaatcgatcggcggttataaatagacagtaaggaactaaatctattcgatcggccgtagatattaacgatatatagttcttatattaatatatacttaaatcaagtaattgggatagatcggtcaccatgccgagacagtataaatcacttagaccgaaatatatattaataacaggattatatatgtttatagcatagccgattagatagatctagcatgtatcggctaatactccgatactactctatacaaacatatcaagacaagtataatataccaaacaaaggcttaatatacttaaatgcactaagatcttgacataaagggcggatttaacatgtcactgaggcacatagatcgaatatggttaaatcagatatgattggctgaaactccgatactaccctaatcagcaaccagaggataggctagagattgatattctaagcacgacttaatagatcaaactcaactgatgcatcattaagtatgaaaagaagaacaatatctagacaatcaagccgctggatgtttcataaagtggtaaatatcttatataatctaggacaacgtcgctatttaacctaatcggctgccttctattaatagatgttagccgattgtaggttagatgacgatattgccaaagattatgtaagatatatgataactcgacgaattatataggcaagattagagtgtcataaagatggaagcactaatcttgagaacacaagtcgtcataacaagttttacctcttgttgaagatcgaaactgatgcagctcaacccgcaagcaagaactcgttgaaacaaaactaaagcgaaagggtggcgatgcgccgaaattgtattgaacgtgtgtgttaaaaattacatagggctcggggtctatttatacccgagaattacaagatatgtccataccggacacgaccactatctctaacaaactctctaagataccataaatctttgcggcagacttttacccaaacatatctctaaggaagttacataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacctagacccagccgatcctaatcgtagccgatctggacttctgccgattcttgctctgttctcgaatcaatctccgccttcgactccacctggatctagtctcctcttccgatgctgatattaccaaatttggttgttaacacatgccccccaagtccgggatatttgataatgttccggatttgccgtgtaccgactccgagcaagtttcgcactctgctatttttcgaccgttattctatcgctttaaataccaaccgttgccctcgagaaatctcacgccgtgacttccgttttcaccgctcaagcgaaacattgtcctttnnnnnnnnnnnnnnnnnnnnnnnnnnnnnnnnnnn

SEQ ID NO: 8408 - DNA, 3764 bp, Oryza sativa
  unsure (1)..(3764): unsure at all n locations
nnnnnnnnnnnnnnnnnnnnnnnnnnnnnnnnnnnnnnnnnnnnnnnnnnnnnnnnnnnnntgttttctgcttcccgattcctttggatttgcagcacctttccaacctagttgcgattcccaacctatcacacaaaaaccactattttcttggcccaatcggcaatcttgaccccaatgatttcatcattagtgaaaccaacagaatcctctttagactagccaaccctaacctgggtcactggaagaataccttcaagtcttggccatctctcgaaaagcctacccctgataagagttggaccacctggtaccaacgcatatcggctagtaagaaagtccactgggatgagattgggatcggccaagcgtttgctctcaccatagccaattctgctaaggatgaacctctgatggccgccgccacctatttctggtccaacaccatcaatgccttcttatttaactaagggccgatgactccaactttgatcgacatcatcatgattactgaattagatgtaacttcatcggctaaccctatgagtatgaacaccaagaaccaatttgacttcaagaccaaaagcataggagggtggtctggttatgtagcggcatacatgggcaaagggcctatcactcctcgggagcacatagctttcttgctaatgtggctagaaaagtttctcttctgtggattcagctgtggtcccacaaccaattggcaatttgtagccgaagccttaaaatcaaagaaacaattccccttgggcaaaatccttctcgactatctataccaaatgttgaacaatgcatcggctaagatagccgtcggctcaatagttgaagaaggtggaccatggtggctactgcagacctggctaaacctggtagtcataaaagttgtcaatcggccatctgtaacaaaagctgaattcccaaggttggagccaattgtagaagatgatggagaagaacgcacccatcacagatgcatgtcatatggagaatatgcatccacaccagcagatgctggggcaaaactatcggctgagctgctcaaagattggttctgcagcttttatgaaggcttctagaaagatgctcgtgtttggtttctttatgaagactcagcagaccttgagctcccatcagacttcagatttgaagacatcaatcatgaaagatatcaaacatccagggaaatctttatagccgcaatcagcccatgcatcctacctgtcggtattcaccaaggaagaaatatccaagtctcctacgaattctatcaccccacaagttcagctagacaacttggattaggccaactcccaatcgacttattctttgctaacaagatccaatgccgaggagaaatttcttcaactctaatgatggatcgactgcttaacctccaaggacctcccttaggcaatatcgacaatattgagttagcaggattcaggagcaggaactttgacagatggtggggtgaatggaagttgcatctatttcatcaatcggccacaatgtacatgacagatctattccccgacgtcataccccaggtaaactttgtcatcactaaatttcataacggttagccgattcattacttgactaatcttttgttcctgttttgcagacaactaagtcctcccctccacatcagagcaatagtggtaggaacattgaatatgccctaggtctgattcctaatggaggcggattgtctccccctgtcatcggctatcatgcctctaaggtctcaaccctcctccaaggcgccatcagggaaccaaccgatgtaaccaagaaaagaaaaactagatcatcggctgtgagcaccttgactctagctccaaagaaaaaggccaagtctaagaaaaccaagccaaccgacgacctgtctgctttggatccatccattgaacaagctctggatgaagaagatattgaggatgatgttgatcaggctgcagccgaagtaagtgatactaaaaaaacaccatcggcttcgcctaagcagatacctccaactccttctgcccccactcacttcttcagagtaaaacatctttccttgcaaacccttttataatcattattttcagccgactactcataggctttgtagttacagaagaagaaaactgctataaaaaagaaatcagcagcaccaattctcaaaccagctccaccagtaagacactcccaattttactagttgattccagccgattttgtctaacacttgtctttttacagcctcttcctcctccttcttcccctgtacaacaaccatcgagtgaccgaactccatcagccgtggggagtcatcatattgtggaagaagaacaaccagctgctcctgctatcccagtaagttttcctttgatgcaagaatttagatcggctatattgacttagctctcaaactttctgaacttatacctgcaggttctagccgatctcttctcttttgatatcaaagattatcttgttgaggcagaagaagatacttcaagcaaagctctagctcccttatctgacgatgcaaagaaaacacttgaagatatctcgcgtaggctagaagcctcttctctggatagcttagtggtcgactatggatcgattaggacaagattgcatgaagttcaagctctaattcctgaagaactggccgatgtcctaactccagccgcttatcatgagcaacatcaatttaaactagaaaaagccaagctaagactagccgaacgccgtgagcgcaaggagattgaagccacaatccaggtcaatcggtagcttgtgcatgaagaaaaaatcaaactcgatcagctatccgaaggtccgatcaaatccaatatcgatcggcttgaagcccgcaagatcgatctcttggcacagcttgaagaatgcaatgctgaattggatatggagcacaaaaagctagctgatctcccaaaatctgtcgaagagcaaaaagcaaggctcaaatcggctatcaagaatgttgctgacctaaccaagtccctgaaggtcatttctggaactgatgctcaagatgcccaagccattgaagaagtcgaacaaattaggcaaagagctatttcggctatccagcagtacttgtctcaataacttttgtgtaataggacttagaaattcttgtaatcggctaagataccttaataccctgctgttttaacaatcctttgtgccgattaacataacttctaattttcactttcattttttgtatatatgtgccccccaattttataatgtcaacagcattgataaaattagaaaaccaactaagggcgatataacaatatcggtcgttatatatcagcaaaccataaccgattacaactggaaaaacgactaagggcaatataacaatatcggccgttatatatcggcaaaccataaccgattacaattagaaaaacgactaagggcgatataacaatatcagtcatctcaagacgatgtaaacacatcggctgtcatgcatcagcaacactagccgatcatgcgtcaacccaaacacttgggtaatacttcttcaagtatttggcattgagcgcccgtccataaacttcatcatcaagcccttgcaacatatatgcccctttagacacaaccttattgatttgaaacggtccttcccaatttggtgaccacttgccgaacttgttatcccgagttccaatcggcaaaatcaacttccatacaagttcaccttccgaaaaaat

SEQ ID NO: 8409 - DNA, 7738 bp, Oryza sativa
  unsure (1)..(7738): unsure at all n locations
taannnnnnnnnnnnnnnnnnnnnnnnnnnnnnnnnnnnnnnnnnnnnnnnnnnnnnnnnatatgcccctttagacacaaccttattgatttgaaacggtccttcccaatttggtgaccacttgccgaacttgttatcccgagttccaatcggcaaaatcaacttccatacaagttcaccttccgaaaaaatcttaggcactactttcttgttataatgcctagcaactcgttccttatctttggtaaccttagcaagggctcgtaaacacgattgaacaaaatcctccctctcatcggccataaggttataatactcatcggctgtcaaaccgtcttgcaattctatccttctagagccgattctaccttcccatggcaaaacagcttcatatccataaacaagcttataaggaggaacttgaattgatccatgacaagccatccgataagaccacaatgcttcggccaaccgggtatgccattgccgaggataatcagaaatcttccacttaattaatttgatcaagctcttgttagatgcctcggcctgcccattagcttgtgcataatatggtgaagaattcaacaatttgatacacacactctcggcaaactaaacaaacttatcggacatgaagatcgaaccttgatcagttgtaatagtttgaggaataccaaatcggtagattatatgttcttgaacaaattaaattgcatccccagaatcaactttcttcaaaggaatggcctccacccagttggtgaaataatcagtcgccaccaatataaacttatgccctttacttgatggtgggtttatcataccgatcatatcaattcccaaacctttgaatggccacggtttaataataggattcatagccgacgccggcgctcgttgaattgccccaaacttctggcaatcttgacaccccttataatatctgaagcaatcctccagcattgtcggccaaaaataccctgcacaccgaagtaaccacttcatcttatgggccgattggtgagtgccacaaattccttcatgaacttcgccgattgcaactttagcctgatcggcactcaaacacttaagtaacactccattaatcgttcgataataaagctcatcatccaatagagtgtacttcaacgccttatatcttaatttcctagaagccgattgagatggattatgtaaatattgatgcacatcatacctccaatcatcggctgttattgctgcaatttaaaccttaacatctttgatcatcagtttataccccgatgccccttgggccaaatcattagcttcaatattttgttctcgagatacatgctttaaagtaaccagccgaaattccttcatcagttcttggcacttctcattataaaccattaatatatcattcttgcactcatactcccctgccaattgactgattaccagcaaagaatcccccatgatttcaatagcatcggcttcaacttccttgagcaactgcaaccctttaagcactgcttcatactcagcttgattattagtcgcataaggtttaatagcataagcaaactcgaaacatgcccccataggggaaattataactaggctgataccacaaccatgagtacacaccgatccatcaaagaataaagtccatggcaccatttcaaccgagccgattgaatcatcacgatgttccacaataaaatcggctatagcttgtcccttaatcgccttcagtgactcataccgaagatcaaactcagttaaggaaaatatccactttccaaccattcctttcaatattggagccgataacatgtatctaacaacgtcggccttgcatataatagttcattcattggacagtaaataatgccttaacctcgtgcatgaaaaatataaacataagcataacttccccataggagaatatctagtctctgcatccaagagccaacgactgagataaaatacaactcgttctttttcattcaactcctgaatcaagactgagccgattgacttctcaccggctaacagatacaatctaaaaggtatccctttctgtggaggaatcaaaacaggaggggaactcaggtatcctttaatattatccaaagccttttgctgctctgctccccaagaaaactgctaatcagccttcaatctcaacaatgatgtaaaagggtctaattttccagacaaattagaaataaaccttcgaaaaaaattaatcttgccgatcatctcctgcaattcggtcttgttttccgggggcttaatcttttttatcgcattgatacttctctaagttatctcaattcccctctcatggacaagaaatcctaagaactggccagccgatacaccaaaagtacattttgtcggattcatcttcaagccatatttccaagtcctctcgaaaacttttattaaatcggctatgtggtcttttatttccttagatttaacaaccacatcatcaatatagacctcaaccagccagccgattagatcatgataaatataattcatggcccattgatatgtagctccagcactcttcaagccgaaagtcataacaacccattcaaataagccgattgcaccaggtcatctaaaagctgtcttatggatatctacttcagcaattaaaatttgattataccctgcgtttccatccataaaactcaaaattttgttccctgacgcagcatcaaccagctgatcggctactggcattggatattcatcttttggtgtagatttattcagatctctaaaatcaatgcataccctcaccttgccgttcttcttgatgacaggaactatgctagaaacccactcagcatatcggcaaggacgaataaaaccagcatcatataaactcttaatctcagccttgacaggttcaagcatatcggctttgcatctcctcggaggctgctggtgtggcctaacccctagtttgataggtagccaatgttctacaattgatcggctgagtccaggcatctcataatactcccaagcgaagcaatctctaaactcttttaagagctctatcagcttggttctaaattctggagacaaattcatactaataaatgtcggccttggccgatcgcttggacctatatctatttcttccaaatcatcagccgacataaaaccttgaccttgcttgccaagaattggacacttttagaaaatctccatcccaaacttttccagataaacaatcaaggccatccatctcccaaagagctaaatcggcactggcaacattaactgacctgtcggctggcacgatctctattttgtcgccttgccactgaatcaagcattgatgcatagttgaaggaatacaacaattggcgtgaatccaatcccttccaagcaacaagctgtaagaacacttcccatcgatgacaaaaaacgtggtaggaatagtcttactgccgaccatcagctccacatttagaacacctttgtttttcgatggattgccaccaaagtccttgagcaccatatttgtcttgatgagatcctcggcatttctacccaacttcctgaatgtagcataaggcatcaaatttaacatggccccaccatcaaccataattttagacatcggcttcccattgacatagtcatttatatacaatggtttaaaatgccgattctctgtcccctcaggcttcttgaacaccgcctgttctggtgatagaaccaacttagtcgattcctcttccacctcatcgacatcgccttaatcgatcccgaattcggctggcaaggtaaaaaccatgttaactggtgccgtcacaacactctttccttttgccaacctctttgcctcatcggctgcaacatcatcggctacaggagcctgattcttaacacgccactcctgcctcggttttgctttcttcagccgatgattaatttctttctcgacctcctggaagcgttctctactcctcaatctttgaacccttcttttctgattcttcataaaaataccagaaggacaccattgagtcttcctattttcgttgtcttccaaatcaccacgttggttcactgggcccaatctttgatgaacaggtactcttgtctgttttggccgattgcctccatcgtacaatcggcttgaaccccctgcaacatcactgcatccaggacaatcctcgatagatggtagcctcataccttcattccaatagaacctgaagaactcacagccccaatgaggatcaaagccaccattatcttcttcatgatgcctttcctgttgcttgccgtatttcctttgatatttgtttataattctagccaaacttacttgataacccctcatgcaccccgtatcagctattcggtcagctatgtgtaccatgttaacaggaaatgggttaccatcgaccctcatcggctttttgtaatcatcaaacttaatcttgcctccctcaatggccacctgaatctgttgtctaaaaaccttgcaatcgttagtagaatgggatccgaaattatgccatttgcaatatctctttttgcctaattcctcagccgatggaatcgtatgaccagcagggagttgaatttgcttccctcggagtagcagatcaaaaatcttgtcagctttagtaatatcaaaaacatacctctcttcctttccagaactctttacccattggcacggtatgacctttttactcctcacccattcggctgcagctatttcagaatcatcctcatcgtcatccgacccatacatgtaaggacaaacatgattaaccttcttagagcttttcctagcctccgcagacctatgctcgtgcaaggtcaccttttgtatcagatgtgacaagctatcatagtcttcggacgagaatttctccctaatcggagcaatcatgccctgaaaggctagatcggctaactgagcgtcagttaaactcaagctaaagcatttgttcctcatctccctgaatctctgaatatattcgtgcacaggttcatcatgccgctgcttaatcacagtcaagtcagataacttcatcttatgaaccccactgtagaaatagctgtgaaattgcttcttcaaatcggcccaactattgatcgacccatacggtagagaagaaaaccaagtaaaagccgatccagacaaatataaccagaacaacctatccctcagagcgtccacagccgatgcttcactacactgagctaaaaattggctaatgtgctcataagttgacacaccatcctgtcataagtccggaactttgaaccgattggagagaggaactctctcaaaccactcagggtaaggctgccgatacaagcctccagtctcttttggtttaagcccaaactgttccctcattacatcagcaatcacatcggcccacggtagttgctgagctgctccctgtgactgttgttgcatgggctcgaactgaccgtactgagacacaaactaaggttgagccagtccccctggctgatattgggcttccggggaaggaggctgatattgataattcaagttgccccctggtaattatgaaggttcggctgaatattacgtgccaaatgctcgggaacaacttgaggcattactgtgccatccggctgtacgtggtgaaccaagtgttctgggacgacttgatttaaaaattgttgtacaggctgtcctccaggcgtcacaaacctgaccgatgtgctcattgagccttggtgctaaatcggctgaacgatttgctgtcttaacggcgcctactgaattggccgcggaggctgttgccttggtggcgtttgctgaactagttgcacaacttgttgctggattggttgtacaacctgctgaatcaggagtgtctgttgaatcggctgctgctgtattggatcaacagcatattgaggcggcagaaacgtggcagcaacctgatcctgcatcagccgattcgcaacctgcccactatgctgtggctgctctctcattaacaaccctcaccagctggcctggtgccaatgctgacggagcaggtaagggagtcgatgccagcgccgtcggctgagctgatggtgcgatggggggaactgcctgaatagatggctgggcatcagtgatcaaaggccgataatttggaaagacacctccttgcaaataaactgggcctgcagcctgatgctcagctattaatccatcggctattgacttcatcatgtttgataaggtattgactaataccccagactgattgatcaaagcatggtgcacaacatagtcgacccggtcttagaaattattgaaaaaatcgtgtgccgcatcactattctgattaagatttcccccttgcaacccctaagcaccatcaccttgaactccatgcactccatcgccttgaactccatggatcccttgagagttgtcaccttgacttcctagagaaccgttggtagcacctttgtcactcagttgagccgagccatctagagcttgtttcctgtcttcacctttggaagaactggtcccatgatctacatttactttatacttctgaaccaatgttcccttgcggatctgcatgaatgagttcaagaactgatcccaggcttgctgcaacattgcttcaaaatccttcttctgctcaggtgtgaatttctctggatcgatgggcacgacgtttccttcattgacgtcagtcaaccccaacttctggatcttttctttaacagtgcttgggctagccgaggatggtgacagcggtggcttctcggccatgaggaagaattgcttgctgacttctaatcggtcccactaggcctgccaaaagcgtgttgatagaaaacacgaggcctgggaaatctgcttaactccaatgcaggtccaaagctcgccttcgaatgtatgagcgtgcagttgatttcatcctgtaatcaacaagaaatagagacaaagaattcgtggttaaatctataaatgatagccgatcggctaggtgccgatgacatatcatttatctttgagccgatgtcatatatgaatcgatcggtggttataaatagacagtaaggaactaaatctattcgatcggctgtagatattaacgatatatagttcttatattaatatatacttaaatcaagtaattgggatagatcggccaccatgccgagacagtataaatcacttagaccgaaatatatattaataacaggattatatatgtttatagcatagccgatcagatagatctagcatgtatcggctaattctccgatactactctatataaagatatcaagacaagtataatataccaaacaaaagcttaatatacttaaatgcagtaagatcttgacataaagggcggatttaacatgtcactgaggcacatagatcgaatatggttaaatcagataagatcggctgaaactctgatactaccctaatcggcaaccagaggacaggctagagattgatattctaagcacaacttaatagatcaaactcaactgatgcatcattaagtatgaaaagaagaacaatatctagacaatcaagccgctggatgtttcataaagtggtaaatatcttatataatctaggacaacgtcgctatttaacctaatcggctgccttctattaatagatgttagccgattgtaggttannnnnnnnnnnnnnnnnnnnnnnnnnnnnnnnnnnnnnnnn

SEQ ID NO: 8410 - DNA, 2043 bp, Oryza sativa
gtcataaagatgaagcactaatcttgagaacacaagtggttataccaagttttacctcttgttgaagatcgaaacggatgcagctcaacccaaaagcaagaactggtggaaccaaaataaaagcaaaagggtggcgatgcgcagaaattgtattgaacgtgtgtgttaaaaattacatagggctcggggtctatttatgtcatgaccggaaataacccaacgggcgttccttacgtgcgtgtattattctttgtcccaggaggcaaggtacaccaaaagttgatacatttcagactttctcaagcggaagcgtaaataattaatttattacatgggcggcgaaggcccagcacacacaaagacaaacgggaaacagcggaagactagggcgacgaccacaggcgcttgacgacaggcacgagctagacaccaaagccttcatcttccaggaactcctcttccgggtttgggaaaaattgagcaagactgagtacaaccaccgtactcaacaagacacacccacaagtgcagaataaatgcaagggagtacaaggggggttataatataagggttagggtttgcagtaaacagcattaaaagacccttcgttgctcaaagctattttgtaaatacgatcctagagctatacaatattattaatcaaggccgtgaacccacacgaacctgccttaacccaaggcctacgatgattcggaccgaactagcaacccgaccctgggtcccagctcgtcccaagccaacccaggccaaccattccacattttagttgttaagcaggttttaagaattaaaacactaacttgggtacattgctcggcttggccataaccgagggcgcggctattcgaatagcttatactctgatcagaggtgtacatctttacccacaagacacatcttcctcacgtgtaaccacgtgccacataccaccacggtatacggacggaagacgtcacatagtttcggggatcctaccatagacaagagtcgacccacacgcatgcaagctcgaaacctccgggacaggtaggcaggactgagcccctaacagcaggacaccggccctgtgccatgacatctcgactaccgggccgcagctcgtgtagccttcatttgccctagagatgtccatcgagccccgacttcatccatctccatccgtgtactatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccaagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaatagcaatactaataaggtcataacaaaggtaaataggcatggctaaataaaacattgataacgcgggaatttaaataaagcgataatgtaaaaatttaaatcaaaataattttgtaaactgggattcaatatgttccaggatgatgtgacttgtcttgctcgctttcccaaacgtcggcttcaacctccacgaagagcggatcttccgaagctgcggcgtctacacaaccaacggaaaagaaaaggcttttactctaataaactccatataacaagcaggaacaaagcacaaaattgggttcttgacttcttaaggaaaaattagagacttgaacggtccaattccgggaattcaaaaggccaagttatggcatttgaagtttatatgctctttaaatgaatatttgcaaatttcttcatttaaattttaattttaaaaagggtctattgc

SEQ ID NO: 8411 - DNA, 595 bp, Oryza sativa
tggttttacaactctagactttgggaatattcatatcacctggacactatggaatggttggattattgtggaattggattcacacctccccctctattcaaaaccctcaaaatggttttaggctgggcttggggtgcatggttttgatagtagcacctcggccatataaggaccggtcttcgggcctctattgcaaagcactaccgtacttccacatgtctagtgggtaaggcttagtttgtggctcagtctggttataaacaaaagtacacggatggagatagtacacggatggagatggatgaagtcggggctcgatggacatctctagggcaaatgaaggctacacgagctgcggcccggtagtcgagatgtcatggcacagggccggtgtcctgctgttaggggctcagtcctgcctacctgtcccggaggtttccgccgtaggtggggttgggtcggtactcttgtctatggctaggatgggttggaaactatgtgacgtcttccgtccgtataccgtggtggtatgtggcacgtggttacacgtgaggaagatgtgtcttgtggttaagatgtacacctctgatcagag

SEQ ID NO: 8412 - DNA, 6506 bp, Oryza sativa
  unsure (1)..(6506): unsure at all n locations
nnnnnnnnnnnnnnnnnnnnnnnnnnnnnnnnnnnnttttcgcatacggctatttaagaaacccgcataaaaatatctattttcgcaaacagacctctaaggggctatatgcaaaaaggagcatattttctcatgcgattctcaaggagccatatgtaaaaatagatttttgcatacgagccttttaaatggtccacatgggaaattgcctctcttttttcttcctttactctctctttatcctattaggacttcaaatttttttcacttcctctgctctctctctctccctcttcctctcatctcctgatattgttttcacctcctctcgatctctctcttcctcttctctcctctctctctcctctcctttcctccgaccaggagcaggcggtgggcggctcggtgacctcaggcaccactactgccaatgatgaggtggcagccagtaacagcgccatccctgtccccgcttagcacttggaggccgacgacgacaaggaggcggccaggagcggtgccaccatcgacgatgaggaggcggtcgggagtggctccatccccatccctgcctggcgccgccaccgccgacaaggccagtgacgggtggtgcacccgcatgaggttttggttttggctgctagccccatgacagcaggatccgccggcgccggtgctggcactgcgacggccagatccgcagccgccacaattggggagctagggttttgttttttttttatttttttcagatttttttttgcgtgtggacgacataagcacccgcatgcaaaaaaaaaacattactatatgcgggtgcaccaccctcatgaaaaatttgctatttccgcatacctttcctagcagattggcggtctaaccgtaaaaaaaaaggttttggttgcatgggaatatggtttttattgtagtgcttatgcaaacgtttaccagctggtatgcaaaagatataggacgattgaacatgtgttcaccaattccacttaatgaagagacctgccaaaacgtcagaaacctcgtacattcttaagcgtataaacaatttgccactaataatggaataagatatcgccacggcttcagatatagatcacctttgctcaaaactagatccttaattgtatttaagttttttagaactaattattttcaagtgaaaacttaggtatcaaaattaataccccggggacacacatcccacatatatccacgtgaggagagtaatttcatataccactacgctataagactgacgatattctatctaagcatctaaaaaagaatggatggagaacaaatgtcaacatcaaataatatgctttgtgatatcccagtgtgctcttcaacgaatacaagaaccaagtgtaccaaagagggtgaatggtttcaacaccaaaaacttaaacttttagtgcaaagacaaaaaagttaccctcaaacttaacaaaattgcactggtcacaccgctggattgctgctggttggaccgtagtactctcgccagtctaaccgcctgcacgccgacagtctgaccgccgtcttgtcacaggttggaccgctttcctgctgctggtccgcccaatgaactccggtcaaatcgtcgggattcagaaaaacacatatcgatgaaactcttgaaaatatatcaattttattgtatcaatatgtgtttacaaagtgcatataaagcactcatctctcaaatcatgaagtaggattaaaaccttggagtaaaccctaactttaaagtcaatatcttctaaactcaacgccttgtctatttatacccacaacattgctatccctagacacgaatccaactagaactaggactcctaatcacataggaaacctacccaaccaagaaaacaacatccccatacaactccacactccaacactttaaaacttggactcaaatccaaatttgactcctcttttcatactcacatatggaaaccacgtgtagtccatatgaaaagtttctcctccacatgcatcccacacgctattcttgaacgtctagaccttaacttctcctaagtctagtcctgatctattaccggctatactctcatagcctcatgcaacacatgcacaagaacaacaaagaaactccatatccaagtacaagttcaaaccaacttgacttacatcatcacacaatagtatcacatatgaatagaaactatctagaaattaaaaatatgaagcaatttaaaaattctacgaaaataacccgaaaccaactccaagcccggagtctaccggtatgactgtccggttacctagtcagaccgcccggatacccctagtctgaccggacacccattggcaacctgcactgttcaccgtctgaaacactatgtaccatattttccaaaacactcacctttgacacaattatatttgatcatcacttatttcacattcaccacgtgtacataaattgattatcacgtccattcatgcatatcacgatcaacatcgagtatttcggttatgcagtgaatattaactgtgctaatttaatttaattttgtgcttgcatccattcatttcatcggtgcctagctgcacgtacagaagtttatgtactttcaaatatggcccacctgctttgttatattcttctcttgtagctttcatgtttttgtcccctgctgagaatatattcatctgatcataccttgtttggaatggttttctttttggaaaaaaggcgaaacaccccattagctttacttgaactattaaatcagataggtatagtaagcccctaacttgttcatttggtccaaatgatctctgagcggtttcacctctatggtgtcactggtggagaaaccctttgtagtcccggttcgtaacccccctttagtcccggtttccaaaccgggactaccaatccgggactaaagatcgctatctttagtcccgggtgaaataaccgggactaaagatcgatctttagtcccggttggtaaccccaaccgggactaaagatggcttagccgtaccggttggtgttaccaaccgggactaaagatcgagctgacctttttttttgcgtggccctgttgctgcatatatatgtttcagtacatatatgcatatataatatatgcatatatatatatattattatatttatatatgtttcaatacatatgtacatgcataatatatatgtatttatacatatatatgttatgcaaatgcatatgtatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagttaaggacctatgaattgtgtttccgtcgtagtagaattcacccttgggatcaaggatttgttcgttgatgaatcccatgagttgttcttgaaccgccgcgataaattccttgtgcgtggtcaggttatccctcatgcgaataaactatatgaatgtatgaaattgattagtatttaaacaagaaatcgatacgtaatgaaattttgaatttatttgtacgtacattgagctctcttgtgatgatgatttggtctacaaggcagtggcaatactcgcacacgtaatagccgcacaagttagttcccttcttttgctttgcgcactacaaataaatgacaaacaacgagagatctaattaatatacacttgtatgtatttgaatcggagaataaatgtagagcacgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcaaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgccgtttggtcctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatcttcttgcaagaagtccgtgtccctgatcctcgctccgatcatctctctaccggtggcgctcatctccatgtacagctgatggaactcgtacatttgtgtgggtagggactgcagcagctcaggcttgacaagcagtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactggtttggactttccagaagaagctttcttcagcgttcgctcatagtccgatagcttaatggcctccttggcaggtgcagacatacccctgaagaagttcatgacactcgggtctataggaatcttcttttctgaacttcgaggcttgaattgtctcttgacttctgatgccacgtaagtgttaagctcctcttgcatgcaatcgtaccccgggtccttcttcttggcggcgtcaactttcgccttctttgttgcccttgtgtgggcaggcggtggagcttggggggcccttgactttgaaggtgccggaagaggagcttgcggaggagtcagtgtaggagcccgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccacttgttgcccagggaggatgatgtaccgcctgcgccatagaataatggcttggcttgtgtctcgtagatgcgtctcaccgtctcctccagggtaatccagctcgaggtcgtcgtacgcgccttcgaccaactcaacttcgaccttggagtatcctgctggaatcggcctgcagtggtaagtacctgaaggatccattgggatggccatgcccgacgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccaagctctgtgatcctacctgccccgttgaggcgcagctgctacggtttcctgacgggctcaccattgcaggaggaatggtcggctggggatcattggaccgatgtgcggccatgcgttcatcaaccttccttgccacctcctcttgcatgctgagctcgtagctcgataccctgaactcaagatctgcaatcttcgcctcggtatctctcttgctcctcatcccactcctgtatgtgtggatgtcctccttgaacccaatcttccaaggaatcacccctttccctcgtgtttgtcctggatgctctagagtctgcagggcgagtgacagctcgtccctctctctatccggtcgaaacgtgccgtcagaagaggcttccactgcgtctgttagtcgacgcgcagcctctcatatctgatcgccgaagaccagtgagccatcagctggtttgagtgttccaccgtgagcatagtaccagaacttcgatcgttccggccaattagcggtggccggttcgatacccctctcaagcaagctagcctccatctcctcccacttcggcattgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtttgcccattcaggatatatttcatgtacagctcttc

SEQ ID NO: 8413 - DNA, 945 bp, Oryza sativa
  unsure (1)..(945): unsure at all n locations
aatagccatgtatgctaagtgtaattgtcatatattagaaccctacacaatcttacatgctaagtctaattacaaatctaataatcttatactaaaactcaaatagtgacatatgctaagtctaggtgacgtatattataggcccctagctagtcaataattatatactaagtctaattacaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacgtatattataggaccctagctagtcaataattatatactaagtctaattacaaatataataatcttatattaaaactccaataatcttatactaaaactcaaataatcatgtattctaagtgtaactgtcgtatattagaacactacacaatcttatattctaattaagtctaattacaaatctaataatcttaattgcattacaattataacaatcatatatataannnnnnnnnnnnnnnnnnnnnnnnnnnnnnnnnnnnnctaccactctggcttgagggacaactccgacaacgtcttttctgcaagatacaaaaagatgcattaggataaacgcgaagtaacatatattgcattcgacgttcacgtttcgttcacgatatcgttcatgttcgcgttctcgttaaggtcacatttcattcacctacgtttgttcgttcacgttcattaacctgcctataattgcatttcacgttcacgttcattggctcgttcacgttcgtctgacaacgttctcgttcacgttcattcaccttgttctcgttcacgttcgttctctcgttctcattcacgttcg

SEQ ID NO: 8414 - DNA, 1882 bp, Oryza sativa
  unsure (1)..(1882): unsure at all n locations
gccatacatcaattgatttatatggataatcaatacatccaaaatagtttacatcgtgtacacaataattacggcaatacatcaacggtgacggttgaccgcacgtactttctcctcactatttgttccctccttgtgatcgctacgtgagtaaggggtgtcttcatttgataggaggatgctaggtcaatcgtcaccgtgaaagggggttgcccatccaactgatcataatcctcgttagtcttgtcctcaactccgacgatttttcttttgcctgggagaacgacgtgacgcttaggctcctcaggccctctgcccttctttcctttgctagacatgtccttcacgaaaaagacttgcgttacatcattggcaaggacaaaaggttcgtccgagtatccaaccttgttaaggtcaaccgttgtcatcccactgtcatcaatcattacgcctccaccagtcaacctaacccattagcaccggaacagagggaccttgagaagaccatagtcaagttcccatatgtcctcgatggcactgtaatacgtgccagttgttccatcgtgcccatggcatcgacacgaacagcgctgttttggttcgtgctcatcatgtcttgggctctcatgtagaatgtgtacccattgatctcatatccctggaatgtcgcgatcgacccagacggtccccttgccaggaaggcaagttgttggttgatcgactcgttacccatgagatgttgtcgtatccatgtggggaaagtatcaatgtgatgccatgtaatccatgcatccgacttaccgatgttcctggcgcgaactagagccaagtgctcctcgatgtaaggagctaccaatgaagattgttgcagaactgtggaatgggctttacggaataaattgttgtctaccgccattattgctttccttcgagagtttccctttcncngtagtctccnttcatggcgtgatcaaggtacccgattgggcgaagtctccgataaatttacgcaaattcgatgacctcctttgttccataacccttgncgatgcttgcctctgnatgagcacagttacgaacatacttcttcagaacgcccatgtacctctcgaaaggaaacatgttgtgtaggtacacaggccagagaatactgatctctttcacaaggtgacaaagcagatgcgtcattatattgaaaaatgaaggtggaaatatcaactcaaaactgatgagacattgcaccacatcattctgaagggcttctaatctatccggatcgatgaccttctgcgaaattgtgttcatgaatgcacatagctttgttattgttgcccggacattgtctggaaggataccccttattacaactggtagcagttgtgtcatcaacacatgacagtcatgagactttaggtttgtgaacttcttctccttcgtgcttattattcacttgatattcgtggagtatccagacggtacctttatgctctccaagcattcaaacatactttccttcactgccttgctaagattgtagctggctggactcaagtaatggcttcctttctcctttggttccgggtgaaggtcgccacgttgttccatatgcttcagatcattacgtgcttccagtgtatctttcgactttccgtatacacctaggaagccaagaaggtttacgcaaaggttcttagtgaggtgcatcacgtcgattgcgtgggtacgtccaagaattcccaatagggtaactcccaaaatatagagttcttttccacatcgccgcgtgaccatcttcgctctctataagctggcttgcagggcccctttccgaacactactttaagatctttaaccttagcaaacactgctttcccgttgcgat

SEQ ID NO: 8415 - DNA, 761 bp, Oryza sativa
ttattcataaaagtcctttgcctggccaaaacaaaataattcacttttattaaaatttattttcaagccagacaacttttcaaacacagataaaatcaatttcagattcttggcttgttataaatgtggaattaccccattaatggtaccaacatccacacttttgtagcagtgaccaagacctaagtcagtgcgttgccctgaaaattacatgcatatatgaaacagatggtgatttatcaaaaatcatatcattcctactcaaccatagagcgcaacatataacagaagctcctatgagaataagtttcctatttttcttgtccacccccagaagccaatcatcaaaaatatgagatatgcaattaggagggtaaagaccaaaagagaactatacagctctccaaataaactttgcaaaatggcattccataaaaagatgttgaatagtttcattcttcatacagaaacaacatttcaaacttccattccagttcctccttgccaaattatctttagttaatactacccctttaagcaagtaccacacaaagatcttaatcttcagaggcatcttagacttccaaataatcttatttctctcaatataaccattgtttattaaagccagatacattgaccggacagaaaattggccattctgatgatagttccatctaaaacaatcactctgttgattcaactcaatatgtacaatagaagcccacaattcataccactttgctagattctgaccaact

SEQ ID NO: 8416 - DNA, 1514 bp, Oryza sativa
ccctgatctttgggttggcaaataatatcccatcttgtaagtctggacttttttttatgatcatccccttgccaaaagaatggtgatatattataatcaattttttgaagaaccccttttagaatctaaaaaaagatatcataaacatagctaaactagaaagaacagaattaatcaaaaccagtctacccccaatagacatatgttttcccttccaactactaagtttcttctcaattctttgttcaataactttccaatctttgttactaagctttctaaaatgcattggaataccaagatatctaactggaaaagtacctaacttacaaccaaagatagtagaatattgttcataaaagtcctttgcctggccaaaacaaaataattcacttttattaaaatttattttcaagctagacaacttttcaaacacagataaaatcaatttcagattcttggcttgttgtaaatcgtgctccgaaaagatgatggtatcatcagcatattgcaaaatagataaaccatcatccaccaaatgtggaattaccccattaatggtaccaacatctttagccctcttaattagtagagctagcatatcagccactatgttaaagagaataggagacaaaggatccccttgcttgaggcctttgtaagtttgaaaattattcccaatttgatcatttactttaatatcaacatgaccaccctgaacaaaagaaactatccattgacaccatttaggagaaaagcccttcattctcaacgtttgttgaacaaaagaccatttaaccttatcataggctttctcaaaatcaatcttaaatattaccccacttttatttttacgatgcatttcatgaatagtttcatcgagaataacaaccccttccataatatttctctcaggaataaaagcagtttgagtaggactaattactttttgagcaacgccaattattctatttgtagcaaccttggtaaaaaattttaaaactaacgttaagtaagcatataggcctatactgttcaattttcatggcctccacacacttagagagatataccttcccattttgtttgatttggaacatcgcacaagtggttaattattcctcgacgctacattatactccctccgttatttttttttcgccggagaggccagaggaggccatccgaatatattaaaaagaataaagttacaagaaaaagcgatagaaaactatcgaggttgaaagtgcacgaccaaaaaccacatgctaaccacacaagcacaacccactgagagaggaacctagcactaaaacgacccccgctatgcatggccgatcgccactgggcatacgacaacaccacaagatgagactctgaagacgatgctgccacggaggtcacaacatcaaggacaccgccatcatccatctatgggagatatggttttcacccagagcaactcgccaagggagagagggatcctcgacaaggccccaaggggggttacgatg

SEQ ID NO: 8417 - DNA, 8153 bp, Oryza sativa
tgatttatcatcaatgtttttaagcatgacttaaatatttttatatttacacaatatttttaaataaaatgaatggtcaaatatttgtcaaaaattcaaagacgtcgtatattaaaagacggaggtagtacttgtttatcgacatgatgagtcgagctatgttatttctgccttcgtttgataaccttatcaaaggtgagaaaatgcagagcatggatttagcttctcatgttcagttagtttcttgcattcttttcatcaaattttgtgagcgcttacttttaaaccttggccaaatattttttttaccgaaaatagcgggagaggcttataccgtactatatatattatataattatataaggaggatatttactatgcggatgtttacacagagattatgggtaaccaaactttggtttgccgattttcagtatgctagttaatttggtcgaaaattgagcaccccctgtatattatgctgcaccaaagaaagaatgcttactctgcacagtctatatattcctctttgcagcatatctacctactttcgaaaaaaaaaaacctaggtcagtcaacgagaagttttacagcgaatatatataggtggaacaaaactatttccaatttgattaacattgaaccttgtatgacagattaaacatatgttaatgcgtcgtcaaaagtgctgttttgataaaaaaaatcctgaattattcaatgattttctaaaccaatccagagcaagttaggttccaaaggtgagatcatgcacccaaactactcatgtgacaaagcaagaatatgataaaacaaaggataggataggaatacatgtgtaaaatagaggattgaaaacacagaaacttcatagaaattggaattcggataggtggtaggaaaatcacatgattttttttattattgcataataaccatcaaacacccaacaatcaaaatttacaatgatcgaagaactaggcttatttcgttgcttccaccgttcatgaggtgatttgcctgtgtgagccagccaaaaaatgagctttgagtggataatagctttcctgtgtttttcttctaaaatcacatggaaaggaatttcatattttgttttttagaaaattccttgtataccctaaaattttagctaatcctttctattcctttgaattttgcttgcttctttatatacccaaaatttgatttttagcccttccatacccctcccatcagttgagcgttagttgaccgtctaatttctataaatatgaccattttaccctttgaatgaacatagaaatttataaattacaccattgaaaatgtaaaagtttgtcgcatgacactattattgttatgagtttgctctttgatacattatttatgacaaaatttatttttagataatgaaataaaaatatgtatttattttattttttttaaaaagtcataaaaatgaggagcaatcatgcaaagataggacaacccacgatattttttttataaatgctcccgataaaaaaaatattttcctattaaatttcaaataaaaattttaatttattacatttgtttcattttagaaatttatgtcaaaattttctgaactatttagtctcattagttatataaaatgtacatgctgtgcactcaaacaaaattttcaatcgtttttgaagcttatattcaaacataaatcaccaaggacattaaagacatttgccaccaaacttaacagtgaccgcttggccatgccgccaaaaaatacgatctaaaatcgagaaaagagcaagtattcatccacttttcttactaaaactaactttcttttatcttaaatctaattctacttacttttttctaatctttttcaaaaaatctattcatgctttttttttgatccagttatgattatagactctaccaagagtctgacgaattttttgcttcatccaaatgtgtaaaagatcgtagtcgcacttaaaagccgagtactctaccattaatgaaggaaaatgtaacggcaggggtgtataagggatcaaattgaaatttcagggggtatagaagtgatcggataatttcagagatataaaattgattgagtgattttttaagagtatacaaggaatttactctatttttttcccatttggtcattcctacgaaccaaaggtatctactgtgaccattcctgtaggattcaaattcctaagtttttcctccattccgaagtggtcctcgaaagctaggaatttggcaagtatcttgaaccatctttccaaagacaacaaaccaaattttggctagccaatgcttagtttggttccataaatcaagcacctgtaacactacaaagtcttaataaacgcatatgactaaataaacgcataattcttcagttcttccagcacttatttgtctggtgctgcatatccacttcgaagaaaattaggtcaatcagcaccaaattacagcgcgtatagatggagcaaaaccatgtcttatattgtattaatgttgactgttattccagtgaggaacaatccataaacctttaggctgagtttgaaagggagtttggattttgctactccctcgtttatcatgagaaccttcccgaactatcaacggtatgttttttataaatacttttttaattaatatagaagtttctttaaaaaatcaaatagactaatttttaaatttataataattaatactctattaattatgtgctataataacttatcttgttttactgccactaaaaatcaaagacaaactttactttaaaactcagccttagtcttatatgaaagaaaccaatggcacatcggcctattatattgtcaaaagtgatgtattattacgtataaataagaaaggcgaaaaaaaaaattcttcgaccgatttctaaaccaacagcagtggtaaattggattccaaacgtggatcatgcatgactgaaatgcaattccatagatagatgatttgaactctcttttccagaaacaactaaaccatgcagtaagctgcagctgaaaatcttaggatgaaccacacatatgaagccatatgcatgcatgcaggacaatgattatatatatatggctagtagtgtttctctggtgccacttgcagtgatgctctaatgagcaagaactagagcctttttctacatgcagcgttgcagagctaaatctggaagccccaacttgaccaccatgcttggtactttgagcaaatagaatccatgtacttctccaaagagtctaccattgatgctagtcacaaagctagcttgcttccattgatgctagtcacaaagctttgtttcaagtggatccatcaacttgggccttacattacatcttgtctgtgtacgaatgatggagattgatcaccctgaaaagcaaaatattaatatatgagtgtctagtcttatctaatactttctgtgtatgcatatcatcgcatggttatatcctctgctcccttcattggatgactacacattatatatattacatttggggaaactatatgcacatgatatgtaacatgcttcaaagcatatgccaccctattgatgcatatttgtgcataaagagaaaaaaatgctagaaataattttttcacataggtcacgcatatgatcccggtactagctaaccaaactatagttaaatacaagttttatataagtaagattgtagttacagtgtagttacaatatagttacaatgtaggtacacttcaattatactacagttacatttgaaagtttttcataaaaagacttgcggtacgatttagatttactcatagttttccatgatgcatttctgattattttttagttgtaaaccttccgtgggacatcttccatataatggatacatccttgatttgtgtgcataggtggaacaaccaattatgcaagtgggtcatccaaattcaaagagaaagctgaataaagacgatatatgtccagttaattggcttgggagtttaatgttaggggtcctgcacttaacagtgtagtgtggattcatggaattccctagaattctatcacatcatcaccaatcaacgtctagaacagaggattcatggaaaatttcttgctgatgacaaatttggaatatatagaagctactgaaatcatcagattttcaatgatataatgcttccactcgaaatttgacactaccctaccaattctagtattgcaaaacataagcgcacttatttagtagcataagattgcattctcatatttagtttgctaccaatgtggagccaaattatgatattatagtgtagaatgttctaaattgataccaaatctactataggcaataccaatagcctttaatccaaagaattataagtatcatacaagctaaaaaaaataaatagtacggtacattttggtagcaaaccaaaatggccctaagtcaacatttagttgttaagtctagagaatttgatcaaattttcactcaattatgcatgcgaaccctaatattctcctccattcctgtatattctaaccctatatagacattttagtattttttatataaatatccatagggaccacccctattattttttgtcaaaaaaattagatgggagatcgaaggttgtcaatattttttatttaacactatgaagaagatataccagtatggtcgataagtagatcaaatatatatttatatatacatgatatgtttaagattagtatctgcatgtttaggcaacacaaattgatccaattatttattgatatgaatgtggttacgaataatatcttcataatatattttgttaatgtatacacatctagttgttcttgtactcccttcggtcataagtatttcatgttagatactactatacgtaaataatgatgtctcgagatactctcaactaaaggctctaggaatgaccacaactaacctaattttcatgataactaaataatgtaagcaaaggctaaaaagaacctatataaacaaacatttacctgaggaagagtattgatcatattgatattcataggaataagatatttttctgggtatctactgttgggatacgcgtaggctacaatagtataaatcaaaattttctatcgcgtaaaccagaaaccatgcaagtattagatcatatattgttaccactcgacgcgctgcgcagcggaaaaaggcgctaagaagtcgaaggaattctcgcgaagtagcgcgcgtcgatgtagaggaagtagttgatcgcaccggctcgaccttctcctcttcgtgtgttctcctcgctgtactcccacgccgatcagcaccgcaaaccagcggcgcctctaccagtatccacatgtacagggacagaacgccacgcgcagatgtgctagcacccacgcgtggctagagttttgctcggggagggaagtgacggctagagtttctcacgtgatgcaattactccgccggtcacacccctcacgaatatataggatccatcacttgggcctccaaggcccgtaggactcctattcggatccctattcgaattaagctcatattggatctccatccaatccccttattctggtccattaagcatgcgaccctgtaggttcatgtacactcggctgtaacccgaaaactccttttcggttcacgcgtcaacagcggcccctagcagaacgtattgacccaccgggcatacataaagatcatatcgactgaacctctactgtatacttgtaagaacccctttgcctcacgatatcgattaagctcaatgctagatatgtgtcatcctcaaatagctcaatcattcactcgaacttgttgatagattatataacttgtgattgactcctcaatcacctttggtatggccatacactttcataatctacaacatcaaggggcccagagatatctctccataggaggggcaaatcccatcttgattattcatatctcactacatgttttgattcatagcatacccgaaaactacttttataactacccaattacggagtagcgtttagcagtccctaagtaagctactacacatgttgggaaccatgataatctcaggtctaaggattcaacaccaacactaaatgagatcactgatgacacaacacatatggctcttgcagtgtcttatgttgcatgttcactaacatgtgtccacattattaatttggtatctctataccatgatccatgggacatgatcatcaattaatacatgtgctgatcatctaattatatttgttccacgtatgatatttgaacaggaatcctttagaaatagtaacaaacaacataaagagtctcatcaaaaaatcacatattcattaaccaataatgttttatctatttcgaggaacaatgtcggagaaatatataaacatagtatgtgatacaatcatctctatgattacctctagggcatatcactaacatctaccaacatcaagaaatttaatcaagcaatatatcatgatgctcatgtatatcagaagtactaaattatgttactgtaaccaagcaacgtaaaatatgttatttagttaattatgaaactttgttaatagcagtccggctattacacattactctattagcattgctactcaaatagtattatttcataatgatcaattatactgagcaactcattgaggcttagttaatttatgcgcattcagcatcatatcattataaaaacaaatgaaaacccacaaaacatatataagaagtagaacatttactaccacgaaggaatgaaccatatcttcagggctcaccacacacgtccatcatccatatgtagtgcccgatataatttttcaacaaagacaaatctaccggtcatatattagctaagttttgcaggatttaattaaatttctgcttgcaaaagcatctggatttaatgatatggttttcatttttcagttttgagtgggccggccgagtggcgtgtcgtcacttattagaatgaatttgaactccaaggattgataccagaaaagcgaaattaattaacgtggagaagcatatcatcgaacttttacagtatgaagttatcatcagatctctaatatggaaaaggaaaaggattgtacccctctgtttggtaattgtggttccaactttcgtaagaacaattatgtaatccttgattatggtacttaattaagaagatactaataggtatcatagtccatattatagaaatttactctgaggtaccacacaaacgtttaatttctagctaatgcaaatttgtgaaacctctcaatactttcttaagtatcataaaaacaccctaatttggtacattcaggtaacatactctctctattttaaatgtcgttgactttttaagatacatttgaccatttgtcttattcaatatatatatatatataattattatttattttattgtgatttgatttattatcaaatgttctttaagcatgattcaaatatttttatatttacataaaaaattaaataatacaaatgatcaaacgttgataaaaaaatcaacggtatcataaattaaaaaacggaggtaataatacttataaaagatgtggtccatctaaattattttacactaaaaagtgatgacacctatcaataccatgttcctatttgtgtgttcatttctactctacatgacttcagccggataaattagcagctatcagtgatttcggattggggtgtaattgagattttgaaaagccggtattttcagtaaaaaaaaaaagcacacctgtatgatttgacgtttaatactacattgctttagtttgtggagtacgtcctataaagaaaaccgtagaagatttcccaggaaagaaatggaatcgaagcttaggttaatttagtttagctaagcttgctcgtacaacttgatccattacttaagcaccaaacagtgatctacctctgcatatataaaccatggcagccctggcatttccagctgcagtgcagatcaacacatctctcatctcacttaattagcgagttatcttaacaactaaattaggtcaccattagcattagcaagctagacatataatccaaatattgttgctgtgt

SEQ ID NO: 8418 - DNA, 2209 bp, Oryza sativa
tgttgttgccgggttggcaaggatgggtgacatggtgacagcgcgggctgtgtttgacaggatgccttctaggaatgccgtttcttggaatttgatgatttcgggttatgcgatgagtggtgatgtggaggctgcacgttccgtgtttgatcggatggaccaaaaggatgtggtttcgtggactgctatggtttctgcttatgccaagattggggatctagatacagtgaatgagttgttcgatcatatgcctgtgaagaacctggtttcatggaatgcaatgataactggatacaatcacaactcgcgatacgatgaggcattgcgcacatttcagctgatgatgcttgaaggacggttcagacctgatgaggcgacattagtgagtgttgtctcggcatgtgctcaattgggcagtgttgaatactgcaactggatcagttctttcattggtaaaagcaacatccatctcactgttgcactaggaaatgctctcatagacatgtttgcaaagtgtggggatgtaggaagggcagagtcaattttttataaaatggaaacaagatgtatcattacatggacaacaatgatttctggctttgcttttaatggtctttgtagagacgctcttttggtctacaataatatgtgcagagaaggagttcaactggatgacacagtttttattgctgcactcgctgcttgcgctcatggaggtttgttgcaagaaggttggagtatatttaatgaaatggttgagcgatataacattcaaccaagaatggagcactatgggtgcatggtggatttacttggtcgagcaggtaacttacaggaggcgattttatttattgaaagcatgcctcttgaacctagtgttgtcatatgggtcacgttgctttgttcttgtgttgcacatggtaatgcagagcttatagaatatgtcagtaagaagataactgaactagaaccatttaattctagttatcaagtcctggtttctaattgtagtgctttggaaggaaggtgggatggtgtgatcgatgcacgcacaagcatgcgtaattggggaattgagaaagtgcctggaagtagctcaatccaggtaggcagtgaggttcatgagtttttggctaaagatacaaggcataagaggaggaaagagatatatgaaacagttgacggtttaatggccctcatgagacatacagagcaagcacattgggtaagataatgtagaacactgcagcatcagaagtgcttagttgagtgttgctcgtcctacatgtgcaaaataaatactagattaccatttgaacaggatggactggtaagttgtatagcagagagagagagagagagagagagagagagagagatcagcagttgatgatttgattgaatgcatgaatcatagaggacaccccctttgattgcttaaagaaattgcacaccgcttaactattgaagatcttgcctgcttgtctgtcttgtgcagctcatgtgtaaaggttgagagttgggaccctaggaccttatgtccttgagtccttgtggcaggacctttttgtggctaggtactggggctattcaatgcttgatagggcaacaactgtgtaagatacagctagtttttgctgacattgcttcactgtgattatgggagaagttaatcgctggagtgctcttttacagccgttttccaagtgtaactgaaaaagtctaattcagttcatcaggtgttgtgaataatctgcagtaacatgggtaaaggggatcttcctattgttctacaactgtatcaggtttgctaataatcttctttctggatcaaactggagagcatcacttttggtaaatagaaggcagagagttttgctgcaattggcatgaaccaagctctggttctgtcaccactcaccaggagcaaatagctgcgtactatctcagatataagtagacgtcacttattctctgggcagttgagtcttctttactatcaatgcatatttgaggaagctgctttagctagcagcagaagtgctccatacggtctttttgggtgatcaccccaacccattgcattttgattaatctggtgaatcatattgagatcctgtcttcaaactactgaaatcacaaattgggagcacacgacttatctgtttctttgactagcatggcatatttgttacaaatagtaagtata

SEQ ID NO: 8419 - DNA, 1820 bp, Oryza sativa
  unsure (1)..(1820): unsure at all n locations
ctgcaattggcatgaaccaagctctggttctgtcaccactcaccaggagcaaatagctgcgtactatctcagatataagtagacgtcacttattctctgggcagttgagtcttctttactatcaatgcatatttgaggaagctgctttagctagcagcagaagtgctccatacggtctttttgggtgatcaccccaacccattgcattttgattaatctggtgaatcatattgagatcctgtcttcaaactactgaaatcacaaattgggagcacacgacttatctgtttctttgactagcatggcatatttgttacaaatagtaagtatagaaatttctttcccagttttatgtgttgtacattattctcaaacatcttatttgaaagaagaacacttttcaatattagtacactggtaagtgcaactggttttaggcctttacatagttttctgatcttacttcaattttagcttctagcaatcttgactttggctgaggaacatagctgcaagcaacttgcagctaggaaactaggatgggattgggttgatacttgatagaaatccattagccacttcgatttattttgttaaaatttgagtttttgttattctcttgttggcgctatacggttcaaaatcgctgaatcatgttccatctattgcctggctatttcaaggtgcattggcctttacaccacatgtcatcatgacagcaacaaccagttaataaatgccctactggcagtttatagttctggaccatgctgattacatagctgccagtctgtgaccttcatctagatcaatagtcgtatatgttcaatcctcttccatctattatgaatttatgatatggtaaattttttttcaccaagcttgtttacaaggtaaaatttttctgctcttattttgttacaagcatgaatgtaaaattaatagtgaactaccatccatttaaagaagaaatttctttttcaagaaacaaaacctccactgagaatttgcattgcaggcagaagttgctgtgctcatgtcaagatgtagttttacagtgacaactcataccaggatgaacttcacatttgattgtggtgtgttccgcttcttcctcagtacagacatactgtctgactgtctcctgggtcattagagctataggaacatacattttttcttaatgatatatgggtactttgtgttgtctgatttctcatattttcactgtggaaatttatctttagttttggctggattattcagcaaattttatgcttgagtactcattgtcgacttgaacactatttatgattgaattaaattaagacaacaaattacctggatttacagtagtgattctcttctgtaatacatttaggagatatttgttgtggagaataaaaaaagagcagggacacgaatgttaagtgcaaaatcttataataatttccatgtgaatataagacaacattggagtgataaattgattgaattttttatatatgctactgaaagttgtcattagcaaagagaatatttgttgtttatttatgtctgaggttaagcagcattacccaaagagatgatattgatatggaaaatcacaaaatagatgaagataatatgacatagaaagctgatggacactctggactctatttctcaggaatttccctgatttagggaattgaactttttcctgtaaaattcgtttaatgccgtgtgctccatttcatcatttttnnnnnnnnnnnnnnnnnnnnnnnnnnnnnnnnnnnnnnnnnnnnnnnnnnnnnnnnnnnnnnnnnnnnnnnnnn

SEQ ID NO: 8420 - DNA, 3327 bp, Oryza sativa
  unsure (1)..(3327): unsure at all n locations
tcaatcctgttccatctattatgaatttatgatatggtaaattttttttcaccaagcttgtttacaaggtaaaatttttctgctcttattttgttacaagcatgaatgtaaaattaatagtgaactaccatccatttaaagaagaaatttctttttcaagaaacaaaacctccactgagaatttgcattgcaggcagaagttgctgtgctcatgtcaagatgtagttttacagtgacaactcataccaggatgaacttcacatttgattgtggtgtgttccgcttcttcctcagtacagacatactgtctgactgtctcctgggtcattagagctataggaacatacattttttcttaatgatatatgggtactttgtgttgtctgatttctcatattttcactgtggaaatttatctttagttttggctggattattcagcaaattttatgcttgagtactcattgtcgacttgaacactatttatgattgaattaaattaagacaacaaattacctggatttacagtagtgattctcttctgtaatacatttaggagatatttgttgtggagaataaaaaaagagcagggacacgaatgttaagtgcaaaatcttataataatttccatgtgaatataagacaacattggagtgataaattgattgaattttttatatatgctactgaaagttgtcattagcaaagagaatatttgttgtttatttatgtctgaggttaagcagcattacccaaagagatgatattgatatggaaaatcacaaaatagatgaagataatatgacatagaaagctgatggacactctggactctatttctcaggaatttccctgatttagggaattgaactttttcctgtaaaattcgtttaatgccgtgtgctccatttcatcatttttcctatctttacctttttattaccctaatgtttacagtgtcaaggttattctttaacaaaaaggacacctaatgctaagagatgactaagtgaccaattaatttatgaagtactagtagaagtctaaccgatctaattttgaatcttcatgttgtccgatgaggctttcctgacattttaattcacattctgtaagactgtgacatgcttttgcattctttgaacttttgtaaggaagggtgtgaacaaattttgaaacatcagttcaggacttcttttttcaaggctaatctcaagatattgttgctttagtttatagagactagaagatctgattggcttatattgtaacttttctgttttccatcattcaggaagatcatcgaagttttgatcaccaggtcattctgactctccagcccttctttcctttttacctttgtcactccaatcatgactcatgataagttattttaatttgctttcaggctgctgtccgaggattaaaactaatcagtccttcaaattcgtgccagcggtaattttgtgcttcctgactcctgagttggatgatttcacatatctagtacttttttttttatgattttaaagatctccaggtcgatagcatcacattactgaaacacaaggaaatcataggtttaggcatatcaaaaacctaggtactacagcataacttggagtctagtttggtccaaaagaatattatttatttgcattttttgcatacattagattctcctctgtggaagccttatctgcatcacatttatctgacatgcaatttgatgccatctattatgcttcccgtacaaaacttttactactttaagaatacccgatgttgtatcagtggacaaactattgtgaggaaatcgatcgcataactggtccttctctttactatctagtaggagtatttgcaacttacaccttatctgctagtaaagtgaatgctcagtgttccagttgattttgatattcccaactgaaataagcagtcctattgttgtcgatattttcattcaatagtaataataatataattattgccccttgaaccataaatactggtaaaatacatgctggaacttggaagtatcgcacagagctcaattattcgtagtactacagtactgggttctcaactaattgactactttctcatgctcttcatgtgcagctgggagcaaggacaaccattggacaaattggtggtcacaactcacaagagccatcatcatcctggggtttatagaaaccagagatctccacacaaagcattgatcagaagtatactggcctactgggataccagaaacacatggaaccattttcaccttgtgcattcagagaccgtgagttattctgccacgcaatcgcaagcgaaaaatgggcgattcttccatgtgagcattcatggccctgccaggggttctaggacaccaagaggacgttccttgttcatcttttgctcagcatggactaatgcaatttcattttctgttccagtgtcccgccctgtctcccctgctccccaaagctggagcagggggaatgaagctgggcgattgttgcttggaggggccgaggattcgctggtggctcaattatcctggagttcattctgaaatctgaacttataagatgagatagctgtttctgaattcgcagaagagaaggcatctaatgcgatttgaatacttggttactctctctggtaaaaaaaaatgatgtttgatggacaaaaaattaaattgttgtgtattaataatgccaatattccttaaatgtaatgtgaggtattgcaagtttggtaaaacctactgttgacaagtggctagtcagggtggaggccacagggactaggccatggctctggtgtgtcatctctaacaagataaattcaatgcggattaaaaataaaaggcaagaccagttcatggcttaaacccagaagaacgtgttccgtcctgcaaagccaagagataaacatagggaataaatatattgcatagttgcacgggttgcagtgtatgtactgtatcgccccataggtgaattagagctgaatcttttgttatttaatttttttaaaaaagcattttttttaacaacgaacaatgtcaaactttttttttaacctgaaccttttgaccatgccaatattctttgacattaccaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8421 - DNA, 533 bp, Oryza sativa
gcataacctgttttgcttcatatgtcgtctcgggcaatgtgttctcctgagaaagcatgtccttcagtattcccaaaagttctataaaactcttgtctgtccatccactactagccttcaacttcattaggtctaatgtggctgacaatttggtgtgctttggcttgcatccggcgtatagaggagtctccaagtcactgaccaacctgctgaacttcatggaatctctctcgttcatagctgggtcatcagcgtcacgtaacatgtcttgcagcagatcagggtccacatcaaccatttcaccgcccaatagagatgggacaaacatgccatgctcttcttcatctccttcttcatgattgtctgcaccatttccatctacagttgcaccatcagtatccgaatcttgctctccatacttcacccaacatgtgtaactctccatgaatccccggcatatcaagtgagcgtgtacttcctttcatcttcccaccaaatctcattcctgcaatcactacatggacaacacatgc

SEQ ID NO: 8422 - DNA, 1355 bp, Oryza sativa
cgagtacatttacaacggagtatttttaagcctgattgagataacttcgttctgacggcccaagaagtctaggcatatgttcgctcgtcacagagggccggatctgtactagtgacaattagtttaagttagctgcattcaatattttatatgaggaagtaccattttattgagaacatcacaaagtgtcaaacagcaaaaatatgacctatttatacaagtgaacgaaatacagcttcgtcggaatattcataactatatataccgcatattcttctctctatctattattttcatgtgttctgttgctttgctataacgaagagtttcgtcctttgataaatcggagagggaaaaaatggataagtgttttcgaaaaagaaaaacagagaaatgttgcatcgccgtttgcaaaatgccaagtcaacagcagcatacagaattttgagtcaactgcaataaatgcatagccccatagtatcgcttatgctagccgaattttaaatttaaaacttaatttttttgattttgtagtttttttatcgaagtttattttacacatcggacactagaaacatgtatatacaagtcttacccataaatttcttttttgttgttaatatgcggttcggattaacatatgcataagcaaaataagtccactttgactctctctccaatctaattcgtatctctcaaccagaatactaatatcttagccctagctattcaaaccggtgcaatttaactgctaagacagtacaacccctgtccggcatcgatggttaccaccgccgcccgccgcctcaggccactgccaccgctccttcctcaccactgctgatgggggagaaggtaggaagagagacagagaggaagtgagtatgacaagtgggccacagtatttttttctctctagtcacttacatttggcccacttctacgttgtgactggagctgctacgtcagcaagggttgaacaaggtaacaagccacgtcagaaaaaaactgctctcaaaaccgttgaggaagtcaaattacaatatatctggtgttgcagttaaggggtaagattggagcagtacgtgagggagttaaagtggacttacacctaaacggaaaaatggggccgtgcctctatgacatcggttttgataattagcgcgtacgcgcgacttctctaagtcacgcacgtaccacgtggcaggccctcgtcaccgtgtggatctgagtcccatgagcttttcttttttttccagaattttctttccggagacgcgttcatctaaactaactaatccggttagtgttagataatgacgataattaaggtaagatttatgttttttttgaag

SEQ ID NO: 8423 - DNA, 2136 bp, Oryza sativa
  unsure (1)..(2136): unsure at all n locations
caatttgaaaaactttcaacttttcatgtcaaattggaaaaattttcaactcaaatttaaaacttttaacccagatttgaaaactttcaacccagatttaaaaactttcaactcaaatttgaaaactttcaagtcaagattaaaaacttacaaatctacatttgtaaagaggtgtgcgaaagattgaaaaaaaaatcagaaagaaacggaaaaaaaaaaagagtccgaaggcgccaaaatcggaaaaaaaagtatgaaaaaaaaggcgcgcggggatgggctgggccgatccgtacatgcaaccgtcccggtccagctttgcgagccaagaccaccattgtcgacaactaccatctgggccgcagtggactaggcccaaaccgggcccacctacgaatcgccgagcttacccggagcgctgcctcctgccgccgcacgccacgctggtgcaccgtcgtgctccgccgaggccgcgagctctcctccctccgcgcgccatggatgggtcgatggggtatgagaggaagaacatcgcgcgggttattagttattactccgcttctgtaagaaccctagcccccaaatttttacccccccccccccccccatttcttaattttaacccgtccccgatgtgctgcattgctttcgcattggatttgatttgatgttacttcttactcctgtgttgggttagagatgatgtagattagtttacgggcaggccaacttgcgtcattggtttgtatccatggattgtagtggttagccttggagatatgagattggagattcttctgttattactgatgcattgtgacgattagagcgtgttaatttttttaaaagataatcgtatatgttatctcttgtttattgctaccagaagacgttagaggatttgtttacctctagggaccggttaattcatgctcaaccattttttgtgagggttcttgatgtagcttaggctattgtttttgttcaagaaaagaatttgatgaatcttttatgtgcttttgataaattgactatggaatgtggagtagcaagctttcattgctcaagaaaatggtaaacagtctacatctcaccacgctataatatatttttctagcagtattgtattttataatttgtcaagtctattttgcattgtctcaaagggtgccaattgctgtcaagtgttgtacgacttcatgcatgctgtattctctgcacataggaagccagagcattaaacctggcagataaactatttgaaggaaaattgagtttattggagaaagagttacataacacaatagatctgcttcaatagctagtagccttctggcctccataggtacaaaagaagtcgtcaggggtccaattgcttttataccatcctgttttggcagatcgcatccaccttccatgttgtttgatcaaacattcagcatccatatttcctcattttccctattttccccttccaaattgtggggatgttggcgtcataaaccctctggaatattttgatatcagttagatcagaagaattgcattttggaccacttaatttccatctttctttggatttagctattgaagtgtttttttttttcaaattcttctgcaaattgagaagtaataatactcggattggagtctatgatgttgcctagagctgcagcattatcatgcatgggtttgatgaaaaattaaaggggtattgatctgattcaaatgtaaagggtgactagccttaatcaattgttagtaaatcagctatttttacacaacgtcagcgaacaaccaagaaaaccgggaggttggcttgctacggttattagtggtggagaggtgaatggaccacaaccaacactctgttgtttattaatagtaaagataaaaggttgagaaaatggcaaatgaacaaaatgccccttgcgctttccatctctctctttcatcatccctcgcctctactctctccatcttcatctcttttttttctggtctgcagatctggcggtacaacagccttctccccagcctatgctcctcaccggaggaggctaaatatattgtatnnnnnnnnnnnnnnnnnnnnnnnnnnnnnnnnnnnnnnnnnnnnnnnnnnnnnnnnnnnnn

SEQ ID NO: 8424 - DNA, 498 bp, Oryza sativa
gaaagtgaaaagggagcccataaattggacaagatgttagaggacgacagaacttcgttgtacccaggttgcgagcaggggcacaaaaagttggataccactctgaagttcttgcaatggaaggcaaaaaatggggttagtgacaaggcatttggcgatttattgaaactcgtcaagaacattcttccggagggaaacaaattgccggagacaacgtacgaggctaagaagatagtctgcccgctaggactggaagttcagaagattcacacgtgtccgaatgattgtatcctatatcgcggtgaggagtatgagaacttagaagcatgccctgtttgcaaagcactacgattcaagattagacgagatgatccaggagaagttgacgggaagctaacaaagaagagaattgttgttaaggtgatgtggtatttccctataataccatggataaggcgtttgttcaggaacaaggggaatgctagaatgatgcgatgg

SEQ ID NO: 8425 - DNA, 689 bp, Oryza sativa
aatggaaggatatagtgattctaactggatctctgatgtggatgagatcaaagccactagtggatatgtcttcacactaggtggtggtgctgtctcatggaggtcttgcaaacagaccattttgacgaggtcaaccatggaagcagagttgacggcactggatactgctaatgttgaggcagaatggctgcgtgatctattaatggatctccctattgttgaaaaaccagtgccggctatccttatgaacagtgacaatcaaacggtaattgtcaaagtgaatagttctaaggataatatgaaatcgtctagacatgtgaaaagacgattgaagtctgtcaggaaattgagaaactccggagttataacattgggttacatccaaacagctagaaacctggcagatcccttcacgaagggactatcatgaaatgtgatagacaatgcatcgaaggagatgggtttgacacccatgtgaattatactatggtggtaacccagtctatgtgatcgaagatcccgtgaattagaacctgggaagaacaaactattagtaaactataagagagtaccgagatataccctctctaagtgaagatgcatgtactctcgtgagctgcaaggcaagttggctatgccttaatgagttctgttggctttaattagcgaagatgctgtcctgcagagca

SEQ ID NO: 8426 - DNA, 855 bp, Oryza sativa
  unsure (1)..(855): unsure at all n locations
tataagggttagggtttgcagtaaacagcattaaaagacccttcgttgctcaaagctattttgtaaatacgatcctagagctatacaatattattaatcaaggccgtgaacccacacgaacctgccttaacccaaggcctacgatgattcggaccgaactagcaacccgaccctgggtcccagctcgtcccaagccaacccaggccaaccattccacattttagttgttaagcaggttttaagaattaaaacactaacttgggtacattgctcggcttggccataaccgagggcgcggctattcgaatagcttatactctgatcagaggtgtacatctttacccacaagacacatcttcctcacgtgtaaccacgtgccacataccaccacggtatacggacggaagacgtcacatagtttccaacccatcctagccatagacaagagtaccgacccaaccccacctacggccgaaacctccgggacaggtaggcaggactgagcccctaacagcaggacaccggccctgtgccatgacatctcgactaccgggccgcagctcgtgtagccttcatttgccctagagatgtccatcgagccccgacttcatccatctccatccgtgtactatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccaagcccagnnnnnnnnnnnnnnnnnnnnnnnnnnnnnnnnnnnnnnnnnnnnnnnnnnnnnnnnnnnnnnnnn

SEQ ID NO: 8427 - DNA, 2101 bp, Oryza sativa
cggcccaagagaggggggaactttaaggtttttctttttataaaatcattttaactttgtttatttcttaacaattattatttatgctctgaaaattccacgaaaatttatttacaaattttaggcttttaggaaatattcaaaaatcctctaagccttgtttgacttttactttgcacattttaatttttggaggctttcacacggattttaattattctaggcataatttagaggatatattttagggtcgttttgggacgtgacaatttatacccgagaattacaagatatgtccataccggacacgatcactatctctaacaaactctaagataccgtaagtctttgtggcagacttttgcccaaacatatctctaaggaagttgcataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacttagacccagcagatcctaatcgtagccgatctggacttcagccgattcttgttctgttctcgaatcaatctctgccttcgactccacctcgatctagtctcctcttccgatgctgatattaccaaatttggttattaacaatagtcccattcccagcaaccccattcccagcatcacagcattcacaaccaattcacagcatcatagcatttatattcccagcatcgcagcatttatattccatcacaacacatgcattcacagccaattcacaactcattcacatttatattccatcacaacacatgcattcacatcacatatatgtcattcacatctatttttctctccaaaccgccgacatgcatcaaaacctgcaaactaagttataaattggaaagattttatatgtaattagaaatgcaagtatatacagagatgagctacctaggactttactctaaagaatttaattgtattacaaagaatatttacaaaaatcaaatgtttgtcgcatatgcattgcaaatgttctgccattccgagacgagctacctagaacttcactctaaacatccctttcggtgacaagagatcatctagtatgaattgtgctatctcctctctaatgatatcgaagttgatttccggaatcgttgaaattttttcctgcatgttcggcgccaagttagtctacatacttgtaaaattgtcgtcctatgtgtgtataaacaattgaaggacacacctcagggtcgagcaatgtcaccttgtctgcgaagctcctcatgttatggcagacatggaacccgcactggtcgccaacttgttgacgtattgggaagtcttttgtgtgaccgagtttcggatgcccatccttatgcctcccgccacttgccacgtattggtcccatgcctcgttcaaggcagatttgatggccgaccaatcgtatatttttggattgatattggagttaaggtagtgtaccaaactccacttcggcattattaccagaagaatccaatgacgcctgcgaaattaataaattgccagttacaaactacagttgtacgcatcacgcatttgagtataagtatggtacacgcttactgttgattgtaggcacacataatgaagtccttgtcttgacgggcaaataagcagtccttgatatagtccaccatgttggctcagtcattttttagcgttatctcattgacgacagctggatcgagtaaaacaacatggggtgctttatgatggacatgcttccaggttaacctacgagcaagacaaaagtcagggtaagcgtaatttatggatagttactaccatatcgcgtacccagaaatacttaaaaggaatagcacttaaggaggttggtgtcgatcgctcgcaccctgtagaggtcccatagatctttgaagtctacggcgatgaaggtagaaggcccgaggaacggctgactattgtgctagcccaacatggaggtctctctattcttcctccttgcattggacttctccatgtagtacctgtgcaactcattgcatgcagggccctt

SEQ ID NO: 8428 - DNA, 2244 bp, Oryza sativa
  unsure (1)..(2244): unsure at all n locations
nnnnnnnnnnnnnnnnnnnnnnnnnnnnnnnnnnnnnnnnnnnnnnnnnnnnnnnnnccctcttgctccttttggcaggaggggggaggtgcggcctgctgtcgacctccataccgtcgaccccaaaatctgtatcatactgtaattggagatcttcatatctttattcaatggcaggagggagagatacaacagttggatggggacgcatcggcggcggacgagaacttggcgctggccttggagttatattgatctcaatgctgtgcttgggccattgaataaaggtcccacatgcagccccaagggtcagaatctcgtcattaggtgggtgggggatagtgtagccaacccaatcgggcttcactaagtccacctgaactttggcattgccggctagcagctgcgctccatgcacttgggtgtccggggtaggcttgaacgcttgaccctctgcagcaggaattgcaaatcctggtgtcaccctaacgactagggtacacgatgtgggttcctgcgatagattcattagtgtccttagaatatgttgcaatgtattgtggtgctaatacaatatatgcctttttaagttgtttttaccgttatgtggtccaccgcagcggggcctttaggctattctgccggagcctcagttgatgcgcagctgctacgcctctgcgtggggctcacttgtactatgggaccgggagtggcatcggtcgacctatccctgatgcgtgcctccacccgagcctccatacctaagagctcggtagtgagctcttctctaagctcttctttaagctccacccgaagttggtccttaaggcgtgcagttttctacgcctttgaaagcttgtgcttcttgtactgccacgcgtattggggaaacccaaacttccatggaacattggagccaatgccccttgttcgtccacggtgttcttcgtttccaaacgctttcgtgaggatgtcatcctcgcgtctttgtgagcagacctcttgggaggcatgtctctcagcattcagttcgacctggggtacggttaggatgagttagatgaagaataagatacgacataatgaaatttattctatgtgttcaacttacgattttctggtacaccgcttgatctttgggatttgggaacaaaagagttccatcactattcttcttcacccttgcccttgcgcagttccatgcccgctggaccgggatatcagtaagcacttgcggggtgttagattccgctgcagcttcatcctccttgtcccattcttcctgtttccccgtgtaggctccggtgccaagccggtgcgggtgaaggttccttgcctgcagatcccggtaggcctggctttttgcccgagactctttcgttgatttggcggcatggaactcatcccacacggttcgggtgatgaatgggtatttcccaaatggttctggttgggctgggttgaggacgtactccgtgaccagcgttgtcttgaaatttttccaacaattccccatcttgcggatagcctgccgcttgagtcctgcctcggcctctaaagggtattggaagctttccttgaactgcctccaggcctcttctttttcttcttgagggaccagatagatgtggtccttcagaatagtgaagttccgcctccctaggactctgcatatcgtagggaactttttgacagctttcgtcagagccgtcggatatccaacattgtccacctctgttatggtgtagacttccttaggaatctaattctgggtcctaggattccggctcaaagtagtcctagtagtagtcgtcgacattggttcgccttgctgcgacatgtcctatgtgactgttgcacgggaagaaagtactttttaaaaagtaaattgcatctagacacattctctgatggtttgatatacctctatctcctacctgcgcccgccccgtcgaaggatgtcacgtcccaaaacgactctaaaatatatcctttaaattatgcctagaataattaaaatccgtgtgtgaaagcctccaaaaattaaaatgtgcaaagtaaaagtcaaataaggcttggaggatttttgtatatttcctaaaagcctaaaatgtgtaaataaattttagtggaattttcagagcacaaataattttagtggaagttaaaaaggttttataaaaagaaaaaccctaaaagtcccccttccctcccttgggccggcccagcccatctctcctctcc

SEQ ID NO: 8429 - DNA, 1366 bp, Oryza sativa
ccgccgccgaatccgccgcatcccatcgtccccgcgtgaaataaataggggggaattattccccgtgattccctctcccttttcccccaattttccctccctctctcccttggattcgtttggaaaccctcccctaatcccgccggcgccattgatggagcccgagaacgcccgtgccggtttccttcccctctggccgccctctcccccttccaaccctatttaaatcctccccgcacctccctcgtccgtttccgcctctcgccgccctttctccccgccggattcgagctcgcgacgtcgctctctctctccaccgtcgccgccgagctccggtccgccaccgtcgtcgccccggaccgcctcccacctcggggccgcctccttcggcttcgccgcatcctcgccgacctcgtccacctctctgtttcggtcgccgaccgccggaacgccgtcgaccccgtcgacccgagccgcgccaccgccttcctccgctccggccgcctttttcgtcgtcgccgtcgacctagggtgaaccgtggaccgccgcctcttttcccccttcccttcccctctgtcggccgccgctccgccgtgcctatggccgccgccggcgaccataggggcgcgggcgccacctcccgccggccgcgccgagtggccgccgcgtggggcccggccgtcagccacccgtgccctcgggtgcggctgaccgtgcggcccacggcgccgaccggtgcgagcccgggtgcgcccggtccaccgtggactgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccattcaagtctctaatttttccttaagaagtcaagaacccatttttgtgctttgttcctgcttgttatatggagtttattagagtaaaagccttttcttttccgttggtcgtgtagacgcggcagcttcggaagatccgctcttcgtgaaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatacctatttacctttgttatgaccttattattgttattgttattatttccttgttcaccctagaataaacaaaaccccaactagtgaacactctactcatggtaccactagtatgatttt

SEQ ID NO: 8430 - DNA, 1816 bp, Oryza sativa
  unsure (1)..(1816): unsure at all n locations
ctcggtacccccttttcttttccgttggtcgtgtagacgcggcagcttcggaagatccgctcttcgtgaaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatacctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagtctttgggaattttctcatcacctggacactatggaatggatggattattgtggaattggattcacacctccccctctattcaaaaccctcaaaatggttttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccgggcgtaggtgtggttgggtcggtactcttgtctatggctaggatgggttggaaactatgtcatgtcttccgtccgtataccgtggtggtatgtggcacgtggttacacgtgaggaagatgtgtcttgtgggtaaagatgtacacctctaatcagagtataacctattcgaatagccgtgccctcggttatgggcaagccgagcaatgtacccaagttggttggcttgggacgagctgggacccagggtcgggttgccagttcggtctgaatcatcgtaggccttgggttaaggtaggttcgtgtgggttcacggccttgattaataatattgtatagctctagaatcgtgtttacaaaatagctttgagcaactaagtgtcttttaatgctgtttactgcaaaccctaaccctttatattataacccccttgtactcccttgcatttactctgcacttatgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcaccgcccatgtaataaagtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatttctcggatttttcggagctcaattcctatttttttaatcttacaaagagcatttcagtgattaatttaattggaaaagtatttaaaatcacctttaccccttcgggccgaattaggnnnnnnnnnnnnnnnnnnnnnnnnnnnnnnnnnnnnnnnnnnnnnnnnnnnnnnnnnnt

SEQ ID NO: 8431 - DNA, 2533 bp, Oryza sativa
aagagcatttcagtgattaatttaattggaaaagtatttaaaatcacctttaccttttcgggccgaattaggaaaagtcctctcactctcggcccagtctcctctcagcctgcagcccttttcctctctttcccgaagtctgcttttgtccctcctttaatcagtctttggaagtagaagcccagcagaaagtctactttccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttaccccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgtcgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgaacccgagccgtgccgccgctagacctcgtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgaagtgcgtcggaagtgatcaagaagattacttgaagaccgattattgcaaggcaagtcacacagatcctaaaccaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttgattaattacttgccaactaaaacttgataatggtgggttgtgagcacatggttttgagagtcgtgctcatgacaattaaggaccagttcacgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttaggttgtgcaaggggtattgtcacaactcctttccgaggtaccgtggtggtattgaggcacatggtgacatgatgaggggttgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgc

SEQ ID NO: 8432 - DNA, 4212 bp, Oryza sativa
acaaaggaacacgagcatccatgctcaacaaggctggagcagctgggaactcgacctcgacatcagtatcccactcgaacttgctatcaatgtcactaccataagatagtggcaacagtagcaagttccagtgggatacggatgtcgaggtcgagatcccatattctccggccttgaggaacatggatgttacatatctgctgacgaggaggacacagatagaacacacaggcaaccaaaacccttcctatccttagattgcatccaagatccctaacgttatcgtcagcaaactcctagattgcgtccaagatcatttcgttagggaaccctttcccatagatacaacaaccagctttggatactgaatttatgggaatggggttccctaaagaaatgaccttgaaagcaatctaggatattggtaatgataacagatttctagacatgtcttatttgaacgaaatgttctgtttaccaatttgtcttggtcggtaccgtgcaggcagtaacccgaccaaactagatttggcaaccggaacacttcgtattctcctaaatgccataatttcactaacttcatttaataacaggcctatgcatatccatcccatttccctcaaaatcacccaaaacagcccatagtacacaagtcatgacatgtaataagtttggcctcagttttgctcattttctttcctaaaaaaaacaacaagtgtagatggtctgttcttgttgaaaaaacccaaaaagaacaagtgtagatggtatgttgttatgcgttaaaaccccacatttaaacctaaacaagaaccagagtgaggctggcccaaaaatgcatccatttttgcaaaacatcccttactgccactcctcccaaaaaaatgaacaagagtagatggtctgttcttattgacaaaacccaaaactcacaagtgtatagggtctgttcttatgcattaaaaacccacatttaaacctaaacaagaacaagagtgaggccagcccaaaaatgcatcaatttttgtaaaacatccaatactaccactcctcccaaaaaaaatgaacaagtgtagatggtctgttcttattgacaaaacccaaaaatcacaagtgtatacggtctgttcttatgcattaaaaacccacatttaaacataaacaagaacaagagtgaggccggcccaaaaatgcatccattttgcaaaacatcccatactaccactcccccccctaaaaaaatgaacaagtgtctgttcttattgaaaaaacccaaaaatcaggagtgtatagggtctgttcttgagcaatcatcattggccattcatcacaaatacatccatcacagcccccacagcatcccaacatggcatttcccccaaaaatcacaaattaattccatcacagcccactgcatcccaacatggcattttccccaaaaatcacaaattaattccatcacagcccactgcatcccaacatggcatcacagcccactacatcacaatatctacacacatggcatttcaaaggagaagagggaagacatgcattccagggagaagaagaggcaacgtcggtgttgacgacgacggctgggctcggggtcgacgtggcctctggatcttgtaggtggcggtgtgcagacttggtgtagaggaagccggcggacttggagaggacttggcatcgatcttgaggacttggcggagaggaagccggcggcggcggacttggagcggaggccggtggcggcggtcttgggcatggaggacgcggacttggagaggaggccggcggcagtggtcttgggcatggaggaggcgctagcggtcagggaggccggatccacaagggctcatggacgacgaggaaggaggaggccacggtcagtgaatcgagagggcgacggcggtgtccaagaagaagaggccgccgccggccgtccaggagaaaaaggcggtggcggcggtggatctgagagagtgagaaagtgagagagagtaagaggcacccgcggccgaagagagtaaggacctgtggatgaggattgactaagtaaaccctagtcaatcctcatttctatcgggcaaagtactatacctgatgcggatgacactcatccgtaacgggcgctatttgtaagcccgatacggatgacactcatctgtgatgggcattagtactaagcccgattgagatgattacatctctatcgggcatggtactaaagcccgtcacagataacttattaaaatagttttaaaatgatgttaaaattataaaattaatatttaagtaatacaataatttataatcacgtataattaaaaatgtcttatttacatagtttaaaattcctattaattttttaaaattcatataattaacaaatgccttcctcacatataatttaaaattcatataattaacaaataccttcctcgcatatagtttaaaattcctattatttttaacaaatgtcttatttacatagtttaaaattcctattaatttttaaaaatcatataattgacaattagttttctcacatctagtttaaaattcctaacaattttttaaaaccacataattaacaaatccatttcttcaaagagttttaaatcgtaattaactggaatggcatgaaacatatgcaattcattcattaaggctccaatacaaattaaatacatcattactgataccaatttggaaattgcattactacaaagacttcatttatagtgatatgcattccgaatggtctgaacgaacgtacgccacttcatcttcgagatcatcgtcaaggtcgatctaaggtctcacatgaagattcttgttgtattcttcttcatcgacgacgttgtccacccccacaattcttcacttgccatccctaatgacgtgcatcttcttgtttgcggggtcttttatgtagaaaatctgttcgacctgcttcgctagtacgaatggttcgtctgcgtatccaaccttagccaggtccactaaggtgaatccttcacccaactgcaatgaaacaacgggactttgaagttcaggtagttcagctcccatatctgctctatgcgaccgtagtatgtgcttgatctagcctgatcctgatatgcatctatacggactccactgttttgcactgtgcttttctcatcttgtgtgacggtgtaaaatgtgtatccattgatatcgtacccctgccatgtgtcaacatcccaagatggaccccttgccaacctttgtaatatctcacttgcgccatcggtcgaccatgctacacgatccttgaaccattcattgaagcaagaaccatgttctctgttgatccaaatatctgatcgaccaatattgtcccgtcggaccttcgctaaatgctcatcaaagtatggggttacttcaaccatatgttgcagcactgcgaaacgagcctgcacgtacgaagcttgattggaaacaattctttttctgccagttgtgccgacacctgcaaccttccttcgtggcgagacgcaggaactccgataggatcaatctcggccatgtaatcgatacagaactcaatggcctcctcggtcgtgtaaccttcaatgatgctcccctctggttttgctctgttccgaacatacgacttcagaattcccatgtacctctcgaacggccacatttttctcataaaagctggcccatatatttttgtttgcttcactgggtgaacagtgagatgaaccatgatattgaacaaagctagtggaaaatacatctccaagtgacatagggtactgacaatatcggcttgcaacccatctaagtcttctggatctataatcttctgaccgattacattgaagaaggcacaaagccgttggatcgtgtgacggacttgtggtggtagaatgcctctgatagcaactggcaatatctttgtgattagcatgtggtaatcgtgagacttcattccaaccagttttagatcctccaatttaacgtacgtacttattctcacacaatagcctgaaggaactttaatatatgccagacatgatagcattgctatcttctcatcattcgacaatgtgtggcaagctggtgggaggtacactcttcctgtcttctcatccgtaacaggctgaagttcactacgaatgttcatctcctgtagatcaagacgcgcattcaacccgtcctttgtcttgc

SEQ ID NO: 8433 - DNA, 187 bp, Oryza sativa
  unsure (1)..(187): unsure at all n locations
nnnnnnnnnnnnnnnnnnnnnnnnnnnnnnnnnnnnnnnnnnnnnnnnnnnnnnncctctcgcggccgccatgtcgccgccgccgtcggccgtgacaacggcggcggcggcggcacgcggcggcggccgcgtgctgcaggaaggaggaggggaaggaggaggagatggaggtgaggcgggggtggga

SEQ ID NO: 8434 - DNA, 639 bp, Oryza sativa
  unsure (1)..(639): unsure at all n locations
ccttgccgatatgctgagtgggtttctagcatagttcctgtcatcaagaagaacggcaaggtgagggtatgcattgattttagagatctgaataaatctacaccaaaagatgaatatccaatgccagtagccgatcagctggttgatgctgcgtcagggaacaaaattttgagttttatggatggaaacgcagggtataatcaaattttaattgctgaagtagatatccataagacagcttttagatgacctggtgcaatcggcttatttgaatgggttgttatgactttcggcttgaagagtgctggagctacatatcaatgggccatgaattatatttatcatgatctaatcggctggctggttgaggtctatattgatgatgtggttgttaaatctaaggaaataaaagaccacatagccgatttaataaaagttttcgagaggacttggaaatatggcttgaagatgaatccgacaaaatgtacttttggtgtatcggctggccagttcttaggatttcttgtccatgagaggggaattgagataacttagagaagtatcaatgcgataaaaaaagataaggcccccgaaaacaagaccgaattgcaggagatgatncgcaagattaattttttt

SEQ ID NO: 8435 - DNA, 463 bp, Oryza sativa
tccttagatttaacaaccacatcatcaatatagacctcaaccagccagccgattagatcatgataaatataattcatggcccattgatatgtagctccagcactcttcaagccgaaagtcataacaacccattcaaataagccgattgcaccaggtcatctaaaagctgtcttatggatatctacttcagcaattaaaatttgattataccctgcgtttccatccataaaactcaaaattttgttccctgacgcagcatcaaccagctgatcggctactggcattggatattcatcttttggtgtagatttattcagatctataaaatcaatgcataccctcagcttgccggtcttcttgatgacaggaactatgctagaaacctactcagcatataggcaaggacgaataaaaccagcatcatataaactcttaatctcagccttgacaggttcaagcatat

SEQ ID NO: 8436 - DNA, 582 bp, Oryza sativa
atattcatctgatcataccctggttggaatggtttctttttggaaaaaaggcgaaacaccccattagctttacctgaactattaaatcagataggtatagtaagcccctacttgttcattggtccaaatgatctctgagcggtttcacctctatggtgtcactggtggagaaaccctttgtagtcccggttcgtaacccccctttagtcccggtttccagaccgggactaccaatccgggactaaagatcgatctttagtcccggttatttcacccgggactaaagatagcgatctttagtcccggattggtagtcccggtttggaaaccgggactaaaggggggttacgaaccgggactacaaagggtttctccaccagtgacaccatagaggtgaaaccgctcagagatcatttggaccaaatgaacaagttaggggcttactatacctatctgatttaatagttcaggtaaagctaatggggtgtttcgccttttttccaaaaagaaaaccattccaaacaaggtatgatcagatgaatatattctcagcaggggacaaaaacatgaaagctacaagag

SEQ ID NO: 8437 - DNA, 1038 bp, Oryza sativa
  unsure (1)..(1038): unsure at all n locations
nnnnnnnnnnnnnnnnnnnnnnnnnnnnnnnnnnnnnnnnnnnnnnnnnnnnnnnnnnnnnnnnnaatgtataacatacattcatccacatatcccgtagcaaagcatggggtatcaactagtatgtactctctccgttcgtggatataagggattttgacttttgcttgcaccatttgaccattcgtcttattcaaaaaattttggaattattattatttttatttgtgacttactttattatccaaagtactttaagcacaactttttgttttttatatttacacaaattttttgaataagacgagtggtcaaaccgttacacgtgaatagtgaaaatcccttatattctcggacagagggagtataaataagtataactgttctgccaccaaaatggaagggagcaaataacatcccacctgttgcttaaaaatgctaagtttgttgctagcgtagcgaggagccaacacacaatggacaccagaatgcctgaaaaacttccgagcttcctcgtcatgtgtatgcatgagtccatcctgcattcaacctacatcatttccatcagactactctttcctaaagaaaacagcattcaaacaaatgcatttgcagtaagaattttgttcatcaagatttatctcataaacaattttatataagttgagctacaatacaaccgaaacataaaggagtactttggatatttagcttctcagcagtcctaccaaagctcccatgacaccagtaccaagagggaagatattacctaccatttatttttcccacccttttcagtttatattttcagcactcaccacctttttattattaatgtagtagcatgtagagatattagataagcacttttagctttataatcattgtccctttgtcaaaagcatgtattctactagcataataaccaaaaatggaaggtcacaacacttcaaaacgcagagtaaatttcatatatagccattnnnnnnnnnnnnnnnnnnnnnnnnnnnnnnnnnnnnnnnnnnnnnnnnnnnnnnn

SEQ ID NO: 8438 - DNA, 504 bp, Oryza sativa
gatctccctattgttgaaaaaccagtgccggctatccttatgaacagtgacaatcaaacggtaattgtcaaagtgaatagttctaaggataatatgaaatcgtctagacatgtgaaaaacgattgaagtctgtcaagaaattgataaactccggagttataacattgggttacatccaaacagctagaaacctggcagatcccttcacgaagggactatcatgaaatgtgatagacaatgcatcgaacgagatgggtttgacacccatgtgaattatactatggtggtaacccagtctatgtgatcgaagatcccgtgaattagaacctgggaagaacaaactattaataaactataagagactaccgagatataccctctctaagtgaaaatgcatgtactctcgtgagctgcaaagcacgttggctatgccttaatgagttctgttggctttaattagcgaacatgctttcctgcatagcattcttgaaagaactcaccttt

SEQ ID NO: 8439 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnnnagtcgccaccaatataaacttatgccctttacttgatggtgggtttatcataccgatcatatcaattcccaaacctttgaatggccacggtttaataataggattcatagccgacgccggcgctcgttgaattgccccaaacttctggcaatcttgacaccccttataatatctgaagcaatcctccagcattgtcggccaaaaataccctgcacaccgaagtaaccacttcatcttatgggccgattggtgagtgccacaaattccttcatgaacttcgccgattgcaactttagcctgatcggcactcaaacacttaagtaacactccattaatcgttcgataataaagctcatcatccaatagagtgtacttcaacgccttatatcttaatttcctagaagccgattgagatggattatgtaaatattgatgcacatcatacctccaatcatcggctgttattgctgcaatttaaaccttaacatctttgatcatcagtttataccccgatgccccttgggccaaatcattagcttcaatattttgttctcgagatacatgctttaaagtaaccagccgaaattccttcatcagttcttggcacttctcattataaaccattaatatatcattcttgcactcatactcccctgccaattgactgattaccagca

SEQ ID NO: 8440 - DNA, 3276 bp, Oryza sativa
  unsure (1)..(3276): unsure at all n locations
tttatgttcaggttgcccattctgttagcagagttgagtttcacgtaaaagacaatgatgtttttggagcagaacttataggcgtggttcataccagttgaaaacatcacaccaggtgataccgtcagtggttggtttccaatatctggtcagtatagtaatcctatgaaggcatctcctgaacttcatttgtctatccagtacaagccaattgagcagaatccattgtacaaagatggagttggttctgacggttgtcagagtattggtgtgccaaatgcttattttcctcttcgaaagggtggtatggtcactctatatcaagatgcccatattcctgatgacttttgtcctaaaattgaaattgatggtggaagagtatacgaacaaaataaatgttgggaagacatttgccatgcaattgctgaggctcatcaccttatttatataattggttggtcgtgtatcaccctgtcaagctggtaagggaatcaacaaaacctgtgcccaatggaagcccaccaacccttggagggcttttgaaaaccaaggttcaggagggggtccgtgttattgtgtttctttgggatgacaaaacatcacatgacaaatttctcttgaaaacggtaggctgcattccgaattatctattttacccctttatcatcttgatttcctcatgctatgaaaatggctatatatgaaatttactctgcgttttgaagtgttgtgaccttccatttttggttattatgctagtagaatacatgctttgacaaagggacaatgattataaagctaaaagtgcttatctaatatctctacatgctactacattaataataaaaaggtggtgagtgctgaaaatataaactgaaaagggtgggaaaaataaatggtaggtaatatcttccctcttggtactggtgtcatgggagctttggtaggactgctgagaagctaaatatccaaagtactcctttatgtttcggttgttattgtagctcaacttatataaaattgtttatgagataaatcttgatgaacaaaattcttactgcaaatgcatttgtttgaatgctgttttctttaggaaagagtagtctgatggaaatgatgtaggttgaatgcaggatggactcatgcatacacatgacgaggaagctcggaagtttttcaggcattctggtgtccattgtgtgtgggctcctcgctacgctagcaacaaacttagcatttttaagcaacaggtgggatgtatttgctcccttccattttggtggcagaacagttatacttatttatactccctctgtccgagaatataagggattttcactattcacgtgtaacggtttgaccactcgtcttattcaaaaaatttgtgtaaatataaaaaacaaaaagttgtgcttaaagtactttggataataaagtaagtcacaaataaaaataataataattccaaaattttttgaataagacgaatggtcaaatggtgcaagcaaaaagtcaaaatcccttatatccacgaacggagagagtacatactagttgataccccatgctttgctacgggatatgtggatgaatgtatgttatacattacaaaaatgatagacgtatatgtttaaatcatgtgaagatggtgatttgacattgcttacgtgctaagttctaaaaatacaacctaattacaaatgatatatcatgtttgcgagagatctaaaatactctagataataattgctagtgggtgatgatgtggcacacttgcatcttgagctttaggagttagtgggtaccaactatatagaaagtatagattgagtaatcgttcttgttctcttgatttttgctccttgtctatatctcctagcttcttaagtatcatcttttggaaacttaaaaatgtgtacatgcctatacatagagaatgtttgctgtcatacttgacaagattctaatgaatttaattcatgcacatgatgtaatattcctttttttgaccgaaaatgatgcaaaatattcctttcatgtataatgatgttcttcttttcttatttgatattgaaaggagataattagtaatttttcatttgtaaattacttgaaaaaaaattgctagtgttatttataattcagaaatatttatattaggagaaaaacctaattttaggtgtgttgtaaacattaaagcctattactaccccttatgccaactgccatgctcttcattaaacttctgtcgaataaattagcaattctcctcatatttctgattgtctggaaaagtccaggtgaactattgacttatataagagcatgctgcatttgtacttctaatacattctatccgttgaatttgatgcagtgaacaataattacaatgaagttactggttaataaagctttcatggatgcaactaagtttctaacaatgcttagttgcttaatgtactgcatctcaccaaattttcttttccaggttgtaggaactttgtttacgcaccatcagaaatgtgtcattgttgacacccaagtcatagggaacaatagaaaaataactgcttttattggtggcctagacttatgtgatggcagatatgatacacctgaacacaggctcttcaaggatcttgacaccgtcttcaaggatgatttccataatcccacattccaagtaaattctctaacactgtagttttccttctagagattctcctacattatttctaaaggggaatgtccaccatcggccctttaactgtgggcaaagtccatttaaaccttgaactcaagaatcgtctcatcccaaacttctaacgttgggccaaatatcaccctggccagagctaacctcacaattcccatcaactatagtattttccataaaaaccaacacctcttctgagtgctcaaggacacatcatgatcatacagtcatactatctgcagttctgcactattgtggtttctccttgtggactattttttagtttaggggcagaaagtgaaggcttttttcctttctaaaactataaatgagacatgaacctgctaaaatttagaacatcattctttcattcgcaggttaataagtctgggcctagacaaccatggcatgatttacattgcaagattgagggtccagctgcctatgatatacttacaaactttgaacagagatggagaaaatctgcaaaatggaaagtcagcgttagaagagctgtaagnnnnnnnnnnnnnnnnnnnnnnnnnnnnnnnnnnnnnnnn

SEQ ID NO: 8441 - DNA, 5189 bp, Oryza sativa
tcagtaaaagggttccctaaacttgttcaggaggctgagtcacaggtactgcctgtttcccaggttcaaaataacaatgcattacaattttacatgtgaacttcctgggatttctttcaacattaaaaatgtaagttttctatcaaaaggtgtgtccttggctcctagcaatgaggtgattgtatttgtgcagaatcttgtctgcgcgaaaaatctgcagatagacaagagcatacataatgcatatgtgaaagctatcagatctgcacaacactatatctacattgaaaatcaatattttattggatcttcatactactggtcttcaaatagaagtgcaggtaacaagttgactatcagccatgctattgttttcttttcttattgctatgtgcactgcctcccatataaaacaaactttatatttgcctcacaataccttgtacactagaacatgcatttggattttgtagtaaagcatgctcctgatttccatactggaaacttggtttatttttcatatctactgtagcaattactgggcaatgagaaatgaaaaacaaacatgactatagctggaaacaggtgataaagattaaagaaagctacctcgttagtatctagcatgtgatttattccttaaatcgtggatacaaccatgaatcccgcttttgaataatcttgtatttacaggtgcagagaatttgataccgatcgaattggccataaagattgcaagaaagattaaagctagggaaagatttgcagcttacattgttataccaatgtggcccgagggtaatccaacaactgctgctatgcaggagatcctcttttggcaggtttgttccacatcattatatatcatggcttcatcttgagatattttgggaaatgcatcacacattttgattttaagatattgaatgaatcatgattgattatgcattctaccttatgttttgctgcttctgtttaatctcatctagggacaaacaatgtccatgatgtacaagattgtcgcagaagcactacagaaggaggggttagatgatacgcatccacaggattaccttaacttctactgtcttggtaagcgtgaagtctcaaatgacgtatctacaacaagccaatccaatgagaattccccacaggtagtaatattttcttctttctccgataagcatatcaagctaagcacattcgatgtgctttgctggaaaataaacaattactccctccgtttcatatcgtaagactttctagcattgtctatattcatatagatgttaatgaatctagacacatatatatgcctagattcattaacatctatatgaatgtgggcaatactagaaagtcttgcattatgaaacggagaaagtaattcctttcttttactctctagcgcctggtccaaaagttcaagcgattcatgatctacgtgcactccaaggggatgattgtcgatgatgagtatgtgctcataggatcagccaacataaatcagaggtccatggatggctcaagggacaccgagatcgctatgggcgcctaccagcctcactacagctgggcaggacgcaagaaagctccacgaggacaggcatgctactgttcattttcctcaccaattaaacctttacataatacctacaagcacctttatagtgatctctattggtagtattctactgcctgtattatcactattagtagtatgatcaccagtattagtattacccccagtattatttcttttgtcttcctcttctgttttgtttcacctccttcctatcattctagtctcggccccttttggctttatatgttcttcacccacaattaatacaatggttaaaaggtagagtctgtaacttttgcataaaaaaacaactagtagtagtgatatcaagttttgaatcattgatttattagttttactatcattagaaaaaaaatctactactaatagttgaggtggtagtggtagtactcgctccgtaccatagtataagggattttaccccttctactcgtcccacaatataagggattttggtatgctcacatccatcaactccaattcaaatttctacctattttaacctccaactacctacccacaaccaaaatcacatttaatagaatacctacccacaaccaaaatcacatttaataggggtattctagtctttttattctattcttaatcttacccaaaatggaatgatcccttatattatgggacggaaggaatatataaatagatatgatccattggattggaaatgatgcatggttttgattaattctaccaccattaaagaccatttttaaaagacttcaatatttaattacctgctgctccagcttgtaacctcgcacttcaaaactgttcatttttcaggtgtacgggtacaggatgtcgctgtgggcggagcacctgggtacagtggaggagtgcttccgttggcctcattccgtggagtgcgtccggcaggtgaatgaaatggcagaagagaactgggcgcgctacgtatcaccggagatggtgaacatgcgggggcacctcatgaggtaccccatcaatgttgaacgggatggtagggttggtccggtgcatgggtacgagtgcttcccggatgtcggtggcaaggtgctcggcacacactcttctcttccaaatgcattgacaacttgaattggctggagcatgaacgagctagatgtggcaactaccactaatactttgaaaagaatcattttggggcgtgaagctttttgtttgtacatgaaagagagactgcttgataccagttccacacattgctgttatagagtactgcagttcgactgctgcatatgcagtatgtataataggatttcaattataatcatctctggctggatgcaaatacatctgttcttgcatttagtttgttgtaaaaggcaccttccctttattcagacagtcggttagccttaaaaacaaaattcttggtggcacatgattcaagaatttattggaatgcctcagaagcattacattactttctctcaaaatgtacgagaaaaattatctcttcaaggctgtttggtattgagcaatataaccaaaccttttggcgcgatgtcatgtgaccataattttttagcacataggcaagagagttgcacatttttagtgaacacattatgaccataattgggtggcatctatctactgcaaagttctgtcgagtaactcaaaattgattttcattctagttatcccccaaacattttcagaacacattcacaaacgactgacagttgttaaaaatgacctgacaacattcttttatgagcaattttatggtccttgaggaggtaccattttttctattgtaaatttggtacctctgggtacttaggtattatgaggagtaccaagaggtaccaaattttacaccaaatttttaagtacattatggtacctactgcaactgcacctaatccgaattcaccttactaatactatgatgtatgcatatctcttaagaccatctccagtgtgagtaaaatggaactgtactctaaaagaccgaagacaacatattgcgacaatcaactgatatgtctcagagcaaaaaatcgacaaaaaatatgagtcgaacttagcgactaaaaaatggatgcatgtgattgagagaattttttttatgtgggccatacaatcgaagtgaaacattgtagctactgaaccaaacttttgttcaaccacaatagtcgaatcaagtctgcaggtaccctaaggacatagaaaaagcttcaaccggtttaattcttttacttctcaaacagtaagtaggtacaaggacaggagaaaaatcgcttattacagataagaattctaagcataatatattcatggcattccttggcctaccaaaaaaatatttgtacagttaaaaagattgagggctagtttggtttggttccaaatagccctaccaattcattggcaattttcaatagtgtttctagttgtttagattggtgccaaattttaacaacatatctctttagatagaaaatttttgaccatctaaatttggtagtgccaaaagttacccaaactttggcactactaaaattaaaattttggtatggtaccaaaccaaactggccctgattgtataatcagagtattgcataatagatgtgatatgcatagtagagatgtaagctagccatatattatgctcgctgcaacaaaacagcagcagcgccaaccacactacactgttaaaccataatagaacagggtgtagataaaaaagtcttccggccatgagaccagaaattggttcaaatgcggtcgtcgtgattgaatatcgtttgatcgaaatatagaattgttaatttgatcactgtgtacttgtttatattttttatcactgtgtagtgatataatttcgtttgatcactgtgtacttgtttatatcgttttctttttctccaacgtgtaggagagttacgcactagagaagactcgtccaagcccttcaggaccatgcatggtaaacataacaaacaaagactagaagaaaggaaaacaataacctgcgaaacaaacttatggataaaaattaagaggacctttgctccaccaaacaccataatttgtcccatccctaatattctgcataagttcattggtattaggtaaggtctcctcttgatcataaagcgggcaactgatcaacactccagcatctatctagtgaggccaaccaaacagagaaatgacaacaacgcacgtagaatttttctttcacactgaagaaacaaatatttttgttttatggaaataagaaagatggaagatcttttttttttcatttcactgtgtattctccattatccagactccagagaaacaattttttactctatttttgtttcgtggaaatggggaagatccattaggcaggaaaacatggaaaaactcgaatgcctagttgcatgcagccaagcaaaccccctacaaagaagcaaaggcagaatgcctcaaaattgcatagagccgttgtagacttgtgatataatctatagattcatatggtagcacttgggacatttaaaccagcagaacgtaaagagtggttttgtatgcatggtagacagcgtctaaccagcggacg

SEQ ID NO: 8442 - DNA, 7392 bp, Oryza sativa
  unsure (1)..(7392): unsure at all n locations
nnnnnnnnnnnnnnnnnnnnnnnnnnnnnnnnnnnnnnnnnnnnnnnnnnnnnnnnnnnnnacaaatggaagcagtggggaggagaactcgatagccctcatctttaattttcacccgtgggtgttgtgttagccataataatgggttattgtacttgtgtgcattatcccattgttgcacaaataccagttacatccatcagtttttctttttccggccaagatgagacaccagcacacaacataacactatccacgccattcatgtctagttttgcaactctcaagttgaacagcccccacaacgttaagaatcagctccacaaggcctcaactgcatctatttcccttaaaaattacattataaattagctatcataaatctactatgtgaaattagctatcataaatctactatgtgtgtgcttccatacttctagtagtagagagcatggctcacctcaatccccatgttcaaccttcaatttaagggggaaaaacatctatattccagcacatgacaatgcaatacgctcttcatgggtgccatttgatgctgcacccgacactataggaacaagaagcaaatgcaagtaaatgataaagtgaagtgacatacatggtgattaaagcaacacagattctctaggaactaaaggaaacctgggttttggcacaaaaggtagctcttgtccactaagtgcacaatcaatcgcacgacttaaatccctacaaataagataccaaataagcacaggggagggtgaactgaaaattttgttcaagatgttaaaaaacataccttccggtaactggcacgttgttactcggtcttgaatcgtcaaactgcccatggtaaaaaagctcaaatggccttcgtccatcctggcaccgggaaaccaaaatgattagatagaataatagtagattacgctcgtagtgtgcaaatttgtgaggttagtgtaattcagtacaacttgcaagatgagaaccgacataacttgggcagcatatggaccagcacaatagtccacattagctaattagagtgtttcagtcctgaataggaaacccaagtcacaaggctgcagggggtaggctaggctgctagatttcttttccagaaaaatgcttcctgattttattttcccattgaagtccctgagttgctgcatgatgtatttcaatggtgatctgctcactgtcaggagctacaaatgcagtaaacaatttgtatcataaaaacagaacaacaatcaaatgatacctcgttgtacccttgctcagttggtgtcccagtcagtgctgagacactctaattagctaacatggattgtctagccgtggttagcatgcaacttgcaagttattgcagcagttcaagtattttgcatggcgttgcattaaatttctttcaggaacaacgtgttagcatcctagacattggacatagcagcatcatgaattcatgattctaggcataagcatagatgatgttacctttttgaacaagtaaaactctggcgtgcagacggctcgaaaagctttagcaacttcttgagactgcaggttgcagtaggacaaatgagttaaatagagaaagcatggccgctgtgtctggacaaatagccatacaattgaagggaataatgtggtcaaacctcatcatatagatacgggaaagagtatttatacaattttgcttcctcagctatgtaatcaggaccatcctacaaaatcagatgaacttgtgttaaaatggaaaaatctgacaagtatcacatagatcacatggaacagaagaacataaaacaactagtttccatatccatggatcactgataggaaggaattgttgcctaatcctatactacagtaactcaagaagtatttttctcatacaccaagagaaactcatgacatcttatcggatagcctataagcttgtcagcttacatataatataaccagcagctaaatggctatctaattatctatagccattgtattttataccctgcaggacaaatcctaaaattcgatgcttctccagcatacatatctgtgttaaggtacaacttaaaacgaaaattccaccaaacaggcagagatgggaaatgttttctttgccagacttggttgggcgtgtggctaaaagcaatagttactcagacgacggttgatttcctaaaaaaattagatagggtaacaatttgaattaaatctgctatttaaaagttttaaacaatttttagtagcttctatattactatagagtatgtggtttaaatttcatgatcatctgtatctttataatttttttgtattttatttcgtttcaatataatttcaggacttccacaactgctactacattcaaataaaatattttataacaaaatccattaagctctcaacaagagaacttctggttacttaagattcataagcatgcagaagaccaaaataaaaggtatacagttcattggttgtaactcaacctgtgggtgtgtcacaattgagttcgaggatatggcaacagcagcaagccctttctgcattgtatcgagatgtcaatacaaacacacaagttaaagggaaaagctcactacccattctagagtccatacctccatgtagaatgaggtgagcttcgcaatatcttttttgagatgctttacgaatggacagtgattacatacaaacataacctgaaaggaggaaaataatcatataagatgtagataatctatgcagtggctgatcgattgctcaattgcctacatcccctcctttctcttcttaaatacagactacgagtttcccaacaaaacaaaatcaatatgtcaagagctgatagctacttcttgaagagataaagatacatgctgacataaatatcattcagcacttattaagacttgcaatttggcaaagaaattcagagggaactcaaggactaatttgacaaaatggagataataaactggtaatgttcttccatcaaagtcataagccacatcttgaatttttgatctgtttcattcataaagaggctgtaatacctacaagacctaacagtttttccacataaatgactagatagacggctcataactaatccaagcacaaagccactactattgaccaggtgtgggacaatccaaacagttgtaagtgtaagcgtatagctaatgggaaaatgagaaagcatattagcatttcaatatttcattgagtttcatggggaaatgggagtggcaaaatcgacgaaatgtagttaagcatatagcatggataaactcatttctattcagttctccagtttagagtgaaattaactgaacctggtttttttctttcctaaaaaataaataaatgcagaattgaattcaagcacgaagcaacctagaaccaatcactgaccagcagcgcggggttgccttcgaagtcatccaatgtccagagcttccccgtcagtggctccgggagctgcacgccaagaaaaaacctcgaaatcaatcaacgcccacgcccaaatcccgtccgatgaaaccttccccgagacaaacttaaaactccggcggagggaagcacctcgaactggggcgcgcggaacccgacggagacgcccgtggactccgtccttgccgcgcgcacctggaggagcggacgacgacgacgccgccttgccgcggcggcggcggcggcgagagatccatgcgggcggcggtggcgggcggcggcgacggcgagcaggggccgcgacgaggacgccgcggcggcggaggaggaggagcggacgaacggttgcgctccggcggcggcggtggcgagtgacatggcgcgggtggggctgtgtggctgaaagatgcaccgtgttggctctcgttttcttttcttttcttttcttttctttttaaatatggaaaaagggatttggtttttggtttttggcggagtaaattctagaaaaatctcagttgcactgtcacgttgagaagattgctgaggtggaatatttagtaattaggagtgaggaatacctaaataaacaagatttaattggatcatgccatttttgctagttttgaaaaatatcgttgttattccttaattcgtaaccataccaatataatactctcaaatttagatccatgccatgctctacaattaacatacattttgaatcgttttaggtgtactatattttttatagactaaaatacctatgccgattctcttttaccttatgccggagtgctgagcacaacggcacgatgggccgcaacgtcggggatggttagtccagcagtgacgtgcgacccgatagcggtggagaaatcggcggtagcgatgatggggtggtatgctacgggcgcagtacaaggacagatggtccagcggcagctgcgacgctgcccatggcggtgccatctgttgcgagctcaacacgaggagatctagtggtgacggcggcaaggtctaggtgttctgtagatctagcagcggcgatgttgggtctggcgtccgctaggtctagcgggcagcaatgagctgagctgcgtcatgcggtccaacaacggcgacgttgggtctggcgtatctagaggtgggcaatgagctgagttacgacgtgcggttttggtggcgatgacaagcttagctgcgacgttgcccgtgctgatgacgaaggagacgagctggccagctcgggcggtcgtcgtggatggcaacggcaaccaccccaccaccatttctttatttttattcttcatattttacttttctaaaattgttatacttttttttcatgtgtatgtataaattttttttaccgaaatttaaccggtgcttgagttctaggaggggtacttaggtcaatacggaaatatagtacacataaaacgattaagaatgtatatcaagtgcacaacatggcatggatctaatttcaaaagtgttgcagtggcatggttgtaaataaagaagtagtaatgttatttttcaacactagcaaactgtataatttaattaacccaaaactatgaaacgttagacttgggccctgatcgagagtgagggacgaggaataatccctccggcacgaaaaacagagcaggccattagcgcgtgattaattaagtattagctaatcttttttttaaaaaaatggatcaatatgaatttttaagcaacttttatatataattttttttaaaaaatacaccgtttaacagtttgggaagcatgcgcgtgaaaaacgaggtgacaggagcggtcgcccgcgggaacgagcgcacccttaaaaaggccagcgatagctgttatgtaaaaggagataatttattattagcatattagctgctacaaacatggaaaataagtttatttgatttattatgaaacttttatatacaaatttataaagaaaacatattaatttgtagttcgggaagcatggaagatgatcaagttgccaagtggcccttaggtttgttacaattaaaatgagtttttttttttgcactggttaggttttccttgtcgttgtatgtatggcaatttgttatctatcgtacaaatgctacaccaatactccctttgttttatattataagtcgctttgttttatattataagtcgcttgatattttttcctaatcaaatttatttaagtttgattaagcttataaagatatataatagtatttttaatataaaacaaatatattatcaaaatatattcaatgttagatttaacgaaactaatttgatattttagatgttactaattttttttttaaattttgttaaacttaaccaagtttgattagttaagccacgtcattaagaaattgttagccattggattaaatcctaattatataattgtagccgtttgatcatccaattcacagcaaatcagcaatgttggaacgtacgcaagcaccaagcagtacctgggcccagcttcttcgttgagccatattgcgcagcccatcagagagagacaaggcctcaaccttatccatgaacgcggccgatagctcgctgctcgctgcccctcccacgcctccctcgcgcggacagtataggtgagcatttttttccatagctcaattttgatcgctggataggccaatggagggggaaacaaaacccaagtttttggttttttcagcatctgtctaggactcttcctatgctacagttgacaacaactccgtttttcagatggtgtgttgaatgggaattgttcgcttctgctaaacatccaattattttttacccccatttttgccattaaacttctttgtgtggctgatgccatggacgcttgttctcccttatcccagaataaaaccttctttggaatgaatggaggaattttcagtgtttgttctgtgagaatcgaactaatgtcgatgaaaatcctatgaaattttacactattttctcatgaattaattcaatctttgtaaaaaaaatcctcccgaaattcatcaaatccaaaggctgcatgtgttgctgaattattaataaaaacctgatggagatgattggctttcttcccgatattgagaccctgaccctagaaattatgttgcaagggcatgcctttggatcatgtgtattttatctgctcaagatgtgtgtacaagaataagtaggctggagttggcaataagtggtgacccggaggtaaatttgtttttcctaatatgaggtttccccaaggatgacgaaaccattctgcattttttgttcataagtttaatggtcaaattatactctagcaatttatctctaactcacatttctacttctcttaatctttcatttcggcctgaccgccatttcaacctagtctttacatattatcctcatttcaggctaagattattgattgcccatttgattgcatctgtggagaactgaagatatccagctgaattttcttgtggacataacaatcaaaagcatgagaggaatcgaacaaagattgaatttgtgtttttgagaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgannnnnnnnnnnnnnnnnnnnnnnnnnnnnnnnnnnnnnnnnnnnnnnnnnnnnnnnnnnnn

SEQ ID NO: 8443 - DNA, 2323 bp, Oryza sativa
gtgtttttgaaaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgacaatactcttgccgctttcatataaaaaaaccaccaaaattccgaataactgaaggcatggtctatcgtgttgcatgcataccagaattattcctgaaccgctgagagcatgccgtactgtgttgcagatcgatagcagtattgcgagcgcaaaataaaggccgtaaaacttgtttaattcgtgttttacttagagagatatttttttagataataaaatagaatatcctgacctttactcaacaagttacagccaattattacagagtagtacacaaaatgaaaagtttctcacacaaaaaagaagacacctaccaacccaagataaggagtacacaattattgaattctgtttgtgaatctccatccaaaattggtaaacagttgcataaccgttgcctcaagattacgacatgcaacttttaaacgctcgccctcttcatcacacttttgtagcagtacccaagacctgagccagtgcgttgccctgaaaattacatgcatatatgaaacagatggtgatttgtcaaaaatcatatcattcctactcaaccatagagcccaatatataacagaagctcctatgagaataagtttcctatttttcttgtctacccccagaagccaatcataaaaaatatgagatatgcaattaggagggtaaagaccaaaagagaactatacagctctccaaataaactttgcaaaatgacattccataaaaagatgttgaatagtttcattcttcatacagaaacaacatctcaaacttccattccagttcctccttgccaaattatctttagttaatactacccctttaagcaagtaccacacaaagatcttaatcttcagaggcatcttagacttccaaataatcttatttctctcaatataaccattgtttattaaagccagatacattgaccggacagaaaattggccattctgatgatagttccatctaaaacaatcactctgttgattcaactcaatatgtacaatagaagcccacaattcataccactttgctagattctgaccaactaaagccctcataaaagaaacatttagcggaacaggtctcgtaacattagcaactgaagaacttttccttcgaacaatagcatagagagatggatacctacctttaaacactaagttatctagccatttatcttcccagaatctaacttgttccctattattcagaatccaggaacccatgtttaagaaagtattcttaactttcataagacctaacaaaaaatgagaatcaccttgtttcctatcaacttgggtaatagactgattataaagatactttgtttttaataagtcttgccaaaccccttactcatttattaatttaaacaaccatttactcaaaaggcatttattttgtatttctaaattatggacacccaaaccaccctgatctttgggttggcaaataatatcccatcttgtaagtctgtactttttcttatgatcatccccttgccaaaagaatgttgatatataataatcaattttttgaagaaccccttttagaatctaaaaaaagatatcataaacatagctaaactagaaagaacagaattaatcaaaaccagtctacccccaatagacatatgttttcccttccaactactaagtttcttctcaattctttgttcaataactttccaatctttgttactaagctttctaaaatgcattggaataccaagatatctaactggaaaagtacctaacttacaaccaaagatagtagaatattgttcataaaagtcctttgcctggccaaaacaaaataattcacttttattaaaatttattttcaagccagacaacttttcaaacacagataaaatcaatttcagattcttggcttgttataaatgtggaattaccccattaatggtaccaacatccacacttttgtagcagtgaccaagacctaagtcagtgcgttgccctgaaaattacatgcatatatgaaa

SEQ ID NO: 8444 - DNA, 1076 bp, Oryza sativa
  unsure (1)..(1076): unsure at all n locations
nnnnnnnnnnnnnnnnnnnnnnnnnnnnnnnnnnnnnnnnnncttgcatttactctgcacttatgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcaccgcccatgtaataaagtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctatttttttaatcttacaaagagcatttcagtgattaatttaattggaaaagtatttaaaatcacctttaccttttcgggccgaattaggaaaagtcctctcactctcggcccagtctcctctcagcctgcagcccttttcctctctttcccgaagtctgcttttgtccctcctttaatcagtctttggaagtagaagcccagcagaaagtctactttccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttaccccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcggttgccacctctcccgtggtctcccgtgcctcgtagcgccggcggcacgtgcttcacc

SEQ ID NO: 8445 - DNA, 492 bp, Oryza sativa
tagtataagattattagatttgtaattagacttagcttctaagattgtgtagggttctaatatacgacagttacacttagcatacatgactgttcgtttagtcttagcatataagattatttgagttttaatataagattgttaaaacataaatgtctcatgacttagcagatgtttcctgtatgaactgatggctgatcgcgataaggaacagatattgtacgattcaatcgcggagggaagcagctagtactggaatgaagaagaggggaacgaggatccaaaccagtatttgaacgaggaagggaacatgcagagggatgcggaggggaaccatgaggggcacgtggaaagggatgtggaggggaaccacgaggaggaagctagtggaagtcaaccctccgttggacagaagagggcacgcgggcaacgaggtgacgtgaagaagcttgagggtcggcacatcataacggaagtggaagaagatggatg

SEQ ID NO: 8446 - DNA, 480 bp, Oryza sativa
  unsure (1)..(480): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgatctcggccgtccgttttggatcaagtcgatctcggccatccgttcgcgtgaaccgccgccgtgtagactatcgtgcactaaatgatgtgactatcaagaataagtatccactacccagaattgatgatttgtttgatcagcttaaaggtgctactgttttctccaagatagatcttcgatcagggtatcatcagttgagaatcaaagaggaagatatacctaagacagcttttaccactaggtatgggttgttcgaatgtactgttatgtcttt

SEQ ID NO: 8447 - DNA, 13158 bp, Oryza sativa
ctagaggatcccccatcgtttagaacatcaacacgtgcatggttccattatagttgtttcatcattacctttttttttaataaataacgcagttgacttttagacatgcttaattattcatcttattcaaaaattaagtaattataattcattttgatatgattttttatcattaaaaaatcggtggcgctaatacgcatagaatgcagtttgagcgccgcacaacgctccctccatccagttttctctttttttaccaccccacctttactcagtatcccaccattcctctagattttttctgttatctcattttagtaaaatatttaccatatggtttttctttccgagttttctgcttttcgagtgtctctcgacgtttcaaaagtaacaaatttactctactaagttttccatttgctcccaacatcccacctttgcaccttcaaaaataacaaatttactcgcatgaatgtcccatcaaaagtaacaaatttacttgcatgaatgcccctacaccattcctagatggccgtaataaaattactaccagcttacaacgctagtaattcttttaccagtaataaatattgtttagacttcgtagtatgtgagtagggttgtaaacggatggagaagagagagaagaagtaccacgatagataaacaggtactatagatagctttatatgttatctaccactcaggtaatagacgaatatcctattattgtccgtacagttacaaccattctattcttgtttatggactacaactttcttcgtacacacatgcacctccacaaatctctcttggcctaaaattatgcagcaccccttcacaccccattcctcatagccatctcctctcctcttgaccccatttcggtgcttaaccaaactcaccataatatcagttcatccacaacaatgtcggcctactgcggcaagtacaaaggtatgatccatccacaatcatccttctctcttggtgttcttctctccagtactagggtcatgcgcatggatttgtgtggtcttagatctagttttggtgataggattcgggaagagttttccattcagcatctgtaaatcgatcgtgtactttaatttatctcgccatatagtgcatgtacttattaatctaatggagattgcttttatcataaaaatacgttaagattcattttattaatacaaatggcatctctagtgataaattgtgcattattttgtgacacagttaagttgatctagatggcatgcatgcatgacttggttggattaaataagcatctatcaggcataatttacactaggcaattgggataaatcaataattaaatccacaaggagatgctgaaattgtatttgtatgctgtatatcttacagatgagctcataaagaatgctgcctacattggcaccccgggcaagggtatcctcgctgcggacgagtccactggcaccatcggcaagcgcttcgccagcatcaatgttgagaacgtcgaggataaccgccgtgccttccgcgagctccttttctgcacccctggcgcccttcagtacatcagcggcgtgatcctcttcgacgagaccctctaccagaagaccaaggatggcaagccctttttccttgtcctcaaggaggccggtgccctccccggcatcaaggtggacaagggcaccattgaggtcgccggtaccgacaaggaaaccaccacccagggccacgatgacctctgcaagcaatgcgccaagtactacgaggccggtgcccgctttgccaagtggcgtgccgttctcaagatcggacccaaccagcccttccagcttgccattgatctgaacgcccaaggccttgcttgctacgccatcatctgccaagaaaacgggcttttgccgatcgtcgagccggagatcctcgtcgatggccctcacgacatcgatcgatgcgcgtacgtttccgaggtggtcctcgccgcgtgctacaaggcgctgaacgagcaccatgtcctcctcgagggcaccctcctgaagcccaacatggtcaccccgggttccgacgccaaaaaggtggcgccggaggtcatcgcggagtacaccgtccgcaccctccagaggaccgtccctcctgctgtgccggccatcgtcttcctctccggtggacagagcgaggaggaggcgacgctgaacctgaacgccatgaacaagctcagcgccaaaaagccgtggtcgctgtccttctcctttggccgtgccctgcagcagagcacgctcaaggcctgggctggcaagacggagaacgtagagaaggccagggcggccttcctcgtcaggtgcaaggccaactccgaggctaccctgggtacttacaagggtgatgctgtcctcggcgagggcgctgctgaaagcctgcacgtcaaggactacaagtactgatctgcatcaggcgctggcctgctatggcttggctacctgatcgatttcccattctggggccgttacataatgcggttttgatatctagaggctctaacaggattcacaatttcggatcggaatttcagaatttttccctttccgatagatcgaaccctggagcacaatatatctgtggttatctaaaagccttgtcttaataatccagaacctttttttttcttgtaaaatatttgctgatgaacatcagctggcccggagtttttatttttatcaatcactttgtaactgtctgatttgcccggtgctgtgtgattttgttgaatgaaattaacttcacttctttgagtttagtcgattgagctgctctatttcaatatgaagctttgaagccttaaaattgttgaatttataagcctataacgatttaatttattccatatataaatcatgacattgcagatttaaactagcataaacgcatcattagatctacacatataaactagacaataaagcatgaacagggagcagtcgtgcgaagcgcttcccgaaaaccttattgccgccttctcctggtgctgaacgtcgaaggcggaggttccgaacttgatcaggacgcctgcacgatctccactcagcttatatagagatatcagggcgcctgcacgatctccgcttagcttatatagagatatcaggacgcttgatcaggactcctgcacgacgtacgatctccgcttagcttatatagagatatcaggacgcttgatcaggacactgttgatggtcgtctgcgatcagtttcgcccgtcaatattaccaaaataaaggagaactagttatacttgcaatgcatatttatgttaaaataataaatattctactagcactaggattactaagctcttgcagagaataaacataaaacggaggagaattgacatcaaaataggcgatcaatcaatcggatgatatcgagaatcagacttatcaataaatgagccaagaacgcagaaatgacacgattaattgggccaaaattcacaagtctgaagtgagcaatagaagaggtggccgccagccaaaaatgggctggattgggctagcccctagtttggaaacggaatctgtcgatcggattttttttcggaaacggaaacggaaacgaaaacgaattggaaacattttcttggaaacagaatcgaatatgataagggcagtttccatcggaactcaaaatcggtcggaaactttccgaaaaatttatcggaattataaaggcccataccatagtctataattcccccccaccccggccatcccaaaatttgagacttgggaattggatttgacatagtttaaaacatagtttgagggatttttgaattccgataaattttcgttaccatatcaacgccggtccgttttcgctccgttttcggcttcgacaatatttgattccatttttatatccggggtttccgattccgaaaaaaaatataaaaacgaaaacgataaatgttgtttccatccgttttcgtaccgatttcatcctacacataatactattgcactgtcatccctccctctcatctctgactcgagttctatgctattcgttcctctccagtctcctccctattttcatatactaaactactccctccttcgcaaattgatcatcacatatgtttatgcaccaaaatcaaggataatttaaatcatatcaatcaagataccatgcacacattctcccacaatatatgcatcgattaaaacaccatgccaattacatcttagcatgtgcatactcacatgctatattaattgtagtctaatgaaattcgtgttcatgcggttatatgataattaatttaagaaattttaaattccattatatgatgatcaatttgggaaggagggagtatttgcctaattataaaaataattttaagctacacttgtaattttctaatctaattgtttctttatttataattaataaagcaataattcaagatccatgtgccgatatttatttatataaaaatatgacattttggcacattccaccgtgcactttgcaggtcacccaaagagcgatggaatactaaaaagcattatcaacatatatttccttattatacatcaatctagaaatatgaatcgctaaattaaatcaatattattaaaaaaatgtaaattcatgttttaacggtgcgcaacatccctaacattttacgtgtcattcgaatttccactaaagattttggaataattcaacatcataagttgcactatcatatattattttgcaaccatacgtaactaaactaattagacattccgtacataaaaaatagctcgaacacaaatagtccaagcgactacgtagaaataaattcatagggacaatcatccgaattgccaaaaaaataaattaattcaacaaacaggttgtaagtacattgtttcgcaagcaaggtataattaaattagatatacactacataaggaaaataactatctgaaatctgatttgtataaaaaaaattggtgccttcagttagagaaaataatccgattacttcatgattacttttgcaattaatatgctcaaataatcaaaacaagtcaaatgatcttctgcctaagtgttttaaacttattttatttatcatttaatcgactttagatgatggttgctttttactataaagccaccacctgttaccccataaatactcctaggccttttaaatcgatgaactcattatttctaatggttagaaataatatttatgatacatcgcattcaaaaaatatatattgcacaactatatttcttcatccagcattattcacactaggttgcaactctatatggaacgttcacatatggattctctctcaaactaaaaaataatatttggctatataaacccatatatttagtggagcctcatatctcaccgaattcatccgtcaatgaacaatgacaacctatattcaattaaaaaacttcttacttttgactttacacttaatttggtatacatgttttattacacaaaataaatctaccttctttttagatggtgaaaaatattataaataattgcttggagggattaattaaatatgatatgttataaagctaattaatagctaggttagaaaattataaaagcaatgctaataaaaacaattatggaaaaatcgtatacatgagatgttcatacaaagtctgtaacacataacacatgttcgcgcgaatgcaaggctgtctttctagcttgtcccaaagtcatataaaaaaaatagggggagtaagtattacgtaggtgtaggtggctcaaaatagcaaaaccgtttttcttttcgagaggaaggaacactgattgcaactgtggtacccatgcactgtgcatacaccaataagatcagcatgcagccacgtggtagatgggctatcactatcagcacccacctatccttatcgtcggcaccctgtatctccacgtcgatcaatggccaccacacagctgcatcggctgctgccgctcctcctcttcctcccattcttctacctcgccggcggacgggggcacaccaccacctccccgccgcgccggcgcgacgcgccctccggtggtctccccccggtcgtgctgctgccggggagcacctgcagctagctggaggcacgcctcacggacgcctacgtgccgccgtcgccgcaatgcgccgcgcaccaccacgaggccgacggccggtggttccggctgtggaagaacaccacggagctggacgaccccgtcgtcgcgcgcgccctgcgtcgccgaccagctccgcctcgtcttcgaccacgccgccggtgactaccacggcgtccccggcgtggagactcgtgtcctggacttcggctccacccgtgggttcatcgccgacgtgcccgccaacagttcagctcgccgagactactgtctcccatgaattgcgccaacaaaaacacatcgatcgtgacgagaaatactgtggtttgtacacgcgagcagagacctctgcatgggaaggctcgtcgaggcgttggagaaagtcggctaccgcgacggcgagaccttgttcggcgcgccgtacgacttccggcaggcgccagcggcaccggggaagccgtgcagggcgttctcgcggttccggcgtcagctccgggcgcttgtcgagcacgcgagcaggacgaacggggaccaaccggtcgtcctcgtgtcgcacagccagggcggctacttcgcgctcgagttcatcaaccggagccccatggcgtggcgccggaggcacgtcaagcacttcgtcatggcgtccaccggcgccggcgggttcgtgctgggattgcagtccctggtctccggcgtcagcgacgcctccccgatgggccttgccgggaggagcctcgcctgcaagttcacgtcgctgccgtcacccaaggtgttcgaccgcgacacgccgctggtggtcacgcgggacaagaactaccggagctcctgacggcagtcggtctcccggcgtacgaggtgacgctatacaagacgagggcgctgccggtggcgatgaatttcagggcgccggcggtgccgacgacgtgcatcaacggcgtcggcgtgccgacgacggagaagctggtgtactgggacggcgacttcagccaggccccggagatcgtgtacggcgacggcgatggggtcgtcaattcggcgagcatactggctctcgacacggtgatcggcgaagatccgaggcaggggtactacaagtccgtcaagatcgccggcacgtctcacgacggcgttgtctctgatggtgccgccttggagcgtctggttagtgagattcctcgggagaattttgtgcaagcttcgaaggaggaggatagtcgggttgctcaactgtaatttatcagcactgggattcctattagttgatcacttcattctcttcaactcatcgtacacggccagacaataattccgccgtgtttagttacaaagtttttcttcaaactttcaactttttcatcatatcaaaactttgctacacacaaaaacttccaatttttccgtcacttcgttccaatttcaaccaaacttttaattttggtgtgaactaaacacagttcattagaaataattagacgggtgctcgggcgtactttcccctaatgttcggctgtggtcctttctccatcaaaagttgatgaatttttggataattgtgacgcgttttttaaactgataaatagtgtgtttcgtgcgaaaactttctatatgaatattgctctaaaatatcagattaatctattttttaagtttgtaataattaaaacttaattaatcacacgttattgccacctaatttttttataaaacacttaatttttatctttatatctgaatatagagattcaaacaccaccgtcagcatcgaactgagttggggcttggactcctgttgttactagtcgggcactcaaggcctcaactcgctgcagcctagcaagtagctgggccaagtgcaccactgtgcggaatggatccatccgccacaaaagacgctcttaaaagagcaaacactcgtgggtttactttaaataaataggcctgttaaggctgtgtttaaataaacacttgtcggtgaaaagtttcggtgtgtcacatcggatatacagattgtattaaacgtagactaataacaaacaaattgtagattccgcatgtaaactgcgagatgaatttattaagtctaattaatccatcattagcaaatatttactgtagcaccacattattaagcaaatgtttactgtaacaccacattgtcagatcatgaagcgattaggtttaaaagatttatctcgtaattttcacacgatctatgtaattattttatttatctatatttaatactccatatatgtgtctaaacatttgatgtgacaaggtgaaaaaattcaccaggaatctaaacaggccctaaatagaaatatccaaaaagaaagtccgacaaacacgcagctgcacgtggggtcgtaggatcgtacgatcgcgtgggatgttggactagcgatcgatcgtgcattagacatacgcgtgcattacccaaacggttgccctttgggatttttcaccatacgcgtcgtacagtcacgccaccattctagattaatcacgcgcctatggctaacggctacacacacccatggcccaatgcctgccgcaagagcagcccagccaacgaaccagcactttggtcagcacaaaaaaatcaaaaaaagccaatgtctgatggtttttgagctagctttgccgagaattaaaaaaaggtaaaattttgatgttttaaataaataaacaaaccatcagacaaaaaaaagcaaggatcaattaaacaacatcaaaaaaattagatcaaagcatatgaaggatatattgaagatttccccaccagcatgtaaaaacatctccctctctctacgtcacctgcattaaccattaagtattctataggctttagcacgtttatggatgaaaatattggaaaataataaattttcagttctgaaaaaacaatagtaaattcttgagaaaatgtgaaagcaatacgggcacttgataagcttaggaactgctaacatgctgatcgaccttgggtgttggccaattgagctggaagtcactacaccggatcggtcacctctgacgggtctaaaccctcacttttgacgggttcggcctggtcagagattagtggtcactgataattttgagttacctgtgatgggtgaaggctcgtcagagttaagagtcacctcaaatgggccccaattaaaacctatcactggtgaaagtcacctctgactagtcctaaccaaaacccgtcacgggtgagagtcacctctgacgggtttatattttaacacgttactgatcataattgggaacgccactggtgtgaaataaggaaaaataaaaaagagaaacaccagcctcctaacttaccatcacatttatttgtattgaatgcatctggcattcacaaataaaaaaattgtcacaattcttcttgtgtccatcgcagttgtcctaataacgaaaataaaaaataaaaatcacgggaatctcaccataggaatcaaaatacagtagcaacaatgcaacatcccccaaattgattgataagagtagactttgttaataacccttacgacagtcaggtggtggcgactggcgactggagcttgggcggggagccaacatccccgaaattgattgataagagactagagccccaaattggtggcgactggagactggagtcacatccccaaattgattgataagagaagactttgctaataaccctacgacaagccagggcccgaaaacggtacagatccatctcatacagttggcctaatactgcaactcactgcgttttttggtccgggcaaccatccttataagctgctccctctcttctcaaattggcgaggtgggactaaagctagctacagcttcacagccgctgctctctgctcgctggctgcactgccgcttctttgctgctgctcctgctgcttgctcacatgggccggccaaggcccaaggcatgctgctgctgggctactttgctgtgggctgcacgcatgggccaaggcccaaagctcatactaggaaattaacttagacctatatattaacatggggaagatccgtactgagctggtcgcctatctctaaattgctctaggccaagcacgcttaacctcagaattctttagagatcggcttccgaaaaagaagttgcaacttgttgatataagtattctattaatcctattaagccctgggtcgggatgtcacacacgtcattgcatatctctggtaagcaagctacacaattatatcaagataaatgtaaggtaaagtcggtacttaaataataagagtgaggtaaaataccgagactgaataaaaaagattatttcattaattttacaagtcttacaaaaaaaagagaaaagctactagagtcatacccgaattctcctgaagactcgaggactaagaaaactattttattttctacaccactagcactagaatactaattaaacttgagaagagcttgattcttgttgcttgagtgtgtgaagaagtgagtgaggtgagctccttttataggttcagtatgacagttatgatggttggaaaggttagaatcctggacgtccacgctaaaccctagcctgaacggctgagatgggggttcagtcgaatcttggcctggcctagaaggcccaattttttgcaggcctcctcctggttgattccttagtccagtgacgtggtgttttgggccttttgagattatttctttggatttgtaggcccatctatccacaagtctacctcttgacgacttccaattgattgttcgtttgtttttcgtcgaactgcaatcgaatagaatccaagtacaagtggaaataaattattctaaaacaaatatgaattgcaagcatagctagttctccattattttgtgtatattgacagttgaaattgctctataacgaccatcaaggaaggccgagagccccaagtgcagggtgacgagtggctttgggcagagggtgacgagtggctttgggcaggatttggcgcaaggcggcgtcgaccaaggtgatggcacggcgtggctagagcggcagctagaggtggagagagaggtagagcgtggcgacggctctagggcaaggtaaaaacttgggaaaaaggtggaaaagggagaggaggtccagggcgtgctatttataagcaaagagggaggagatcggcttggatacggtggggtttggcggcagaagagttagggttcgccggcaaaataggagatcaaaaccgttcctattcacggagataaatcacgagatttcttcgattacttgaggggaaagaaacaggaggataagggaaagaaatcccctcaaccaatttgtgaaatggaacaacgaaacggccaaattaggaggggaatcaacaccgggtcgggcactgcctcaggccggaggttgaaaaggcacggtagcaagagggatgaaaagtagactggggaaaaagacaggcccgaaaggaaggaggaaaggagggcggcccgagagagaggagatgaaggaggggcatgcgggccaagggaggggtggtagacattgggaagaaaatggcccaagaacccaagagagagattttatttgttttccatttatatttaattggtttaatgaactttgtgatattaaaattagatattgagctccgaaaattcacaggaaattctagagagtattttagagcatgaagaatattacaaaaatatttccggccatgatttttaaaggaaaatttttaattccctcaataattgacttgattaaattgctttaacttttaatataatttctagaaatgcattattattatgatttttaatcccgaatgaaaatcggggcatgacaagtattaagtattgtaatacaatgtgccatgcacttattacgcggttgataattttataatagcttaaggagtggaaatgttatactatagttgtggtagtaaatgaggcaaaatcatttatacaggtttaggctgcgtggtgcataataccctactcctgtggggttctttccgttatattttttttcagagactaaaggatggtgcaaatcctatggagtttttttgtgtttcctacaaccctttctgaagtccttggctctccccttgtagtcaatgggaaaataccacagttgtagaaccctcgcgactgaaccgtagcacagagtggttagatatgggaagtcttattgcttgtagaagagtggaccaagatgcaaaaccgccatgcacccccccctcctcctacctctagtggcaacattgggaagatgctgtgatgatctgccatgcatcctgcgcgacaaggaaaagcttggggtagaaggctggtgctctaatggccaattgttgagccccacttgttagcctcaggaggtggaacatgtagaaaggtgtaggacttgccgggaagcacattagtcaaccgtgccacttaacagcccacgcccctccccgtagggatgatgatgctgtgcaagatggctgtgcagctgctatcccgttagactggtcgcatgtaaagtgtcatatcacatttaatgcaaagcctacacacaaaagagcacagcaggacactgtgtctcaatgccattaatgcactgctattatcctcgagaagctcggtacaccgatctcggggacaaaagatgattatgccccgagctcagatcctggcttccaacctgaagggagaccccaagcttagccctgcttggggcagccaaggttcccgaccggcctccttcatggtgtatcacaggcactgtggcagactatcgattcattgggtcgtctaaataaacacacacacacacatacgtatgtatctcactgaaacaccttaacaactgctcggaaggcatacttttattaaccaattggtcacactgttatactcattcatacaaatataacttattaatgtgcatactttctatgctaaacatagttaatgaaatataattgtttccatgaat

SEQ ID NO: 8448 - DNA, 1481 bp, Oryza sativa
gtcaaccccaaaagcatgggcttgaccacatcaataaccttgataatcactacaaacaatagcctatagatgacaatcatgccacaaagtaccgcaagatccacccatcttgaatgacctgtttccacttgaaataactcaacaataactttttcaccactcactgtttcctgtcctcctaggttactttggaagactaaccctgagaactcattcttgtaaaacccctgcagtgcatacttgtgaaaggaaatgtagtacattgggtacttccatactatctttggaaggttattaggtatttggaagaatccactagtaagcatcataataccttgtataccagcacctgtgattatccccattaggaaatctggtacaatggttgctacgatcatcattagggcttcgactagcattgtgcatgcacaaagtactagcgcaaaatagacaaaatgttcaattttcccttgtaagccagtaagatagtatgcaattgcaccatgtactacagcattaaggagaaggtatggtatggatgacaatgtattggagatgacaaatgcggccacaccatagtgtccatttagtcttttcctgaagatctgagcaacatgagacatacaagagtttaaatttcattaggcaaaatttgatgcacaaacgcaaattcatttgataaatgaatgttttttctaaccagattgataaatgaatgttgtcttaaaatgaaatatttagttttggtcaggctgcagaatgttaggagctttattctaatatttttggttgtaagcttggatactttcctgtaagatatcttggtatttctatgcattttaggaaactaaacaacaagggctagaaaacaattgaggaaagaattgacaagaaactttgtagttgtctgtagggggggagattggtgttaattaattctgtgctttctagtttagccatgtttatcatatatttttttgagatttcaaaaggagttcttcaaaaaattgattattataggccacgtttcttttggcaaggtgatgagcataagaagaaatatagacttacaagataagatattatatgtcatcctaaagatcagggtggtcttggagttcataatttagaaaatcaaaattaatgtctttttagcaagttgttgtttaagctaattaatgaacagggtgtttggcaagatctatggaaaagaaaatatttgaataatcaggcttttaagtcaagttgagtggaaacaaggggattcccatttctggtcgggctttatgaaagttaagagcacatttctaaatatgggttcttggattgtgcataatggtcagcaagtgagattttgggaggataattgggtaggaaatctttttttaaaagataagtacccctcacaatatgctatagttcgaaggagaaactcttcgattgcaatattatggcttatgtttctctgaatgtttctttta

SEQ ID NO: 8449 - DNA, 9037 bp, Oryza sativa
agttcgaagaaaaaactcttcgattgccaatattatggcttatgtttctctgaatggttcctttaagagagccttagtaggtcaggatatgactaatggccatatttattgtgcttcaattgttcatattcatttgaccggggataatgatatttttagatggaattttcatcaaaagggtcaattctctgttcgttctatgtatttagttttaattaatcatggttatgttggagaggaataagtttatatgaaaacttaagatgcctcttaagattaagatttttatgtgatacctacttaaaggggttgtcttgacataggacaatttggctaggaggaactagcatggtcgtatgaaatgttgcttttgcatgaaaaatgagactattcaaacatttatttttggagtgtcattatgcaaaatttatatgctctacagttttcttgtggtttatatgctccacatagtatatctcatattttttagaattggcttgtgggagtggataaaaaaagtagtaaacttattcttgttggagcatccgctatttgttcggccatatggctacataggaatgatatgtttttggcaagtcaccttatgtaccttatatgtaggttcttttcagggcaaaatactggcatgtcgtaatattgattcaatggttaactattgttgttggagcatccgctattcttgttggagcatccgctatttgtcatgggctcaactactaatgtttgatgatgatatcaagctagtaaaaactgcatgtcgtaatattgattcaatggttatgcatcttttcgccaactttggatgaagattcacaaatagaattcaataatcatgtgttcttttaggttggtttttgtttgtgccccagttttgaaaggagtgtgtttttaagtacttgtgtgtgctcctgttttgtgaggagtgtgtttctatgtctttgttttatttagttcgagtttggttgaactggtgtaataattgtctgtacctctttaagtaaagtccgggatttaattccattatctaaaaaaagaatgttgctaatttgattatttcatatgtcataaaatgtgacctcttgtgcaaatggcaagtatttaaaatattttaataaaattatgaaaatcatcactctatatttattaataaataatttattgcttcaaaatctatatatactaattagagaggcttcaccaagaggaaccgacataaatcccaataaaagatagaaaagttagaaattccaatattgaacttgtgagttcatctatcaaacctatggccagatatcgtccaacaaataatatttggatttattaaaactcgagttagtaatgagttagtaaatacctagttgtactcacttggagttctctgttgaagtattcattttagcaatccaaatttcagaatcaataaaaattaataatttcagtttgttttttcacgatcaaataatattgaaatcagaaaatattaatcaaataatatttgttactccctccgtttcaggttataagatattttgactattgtcaaagacaaactgctttaagtctgactacgtttatagacaaatatagtaatatttacattaccaaattagttttattaaattataattaaatttgtttttacaataaatttatcttgcgtaaaaaatatattactatttttttctataaatttggtcaaacttgaagcagtttgacagttgtcagagtcaaaacatcttataacctgaaacagagggactactggttctaaaatctgatttacaatattgtaagccgatattaattttgtaaaatacgtagcatgtatggatggacacgttgatgtagttaaagcttaatggtaattcagtatactcaatccagtaaaaaatagaaatgagttagaattattttatctccctgaattttttcaggatactaagagtttttttaggtttttctatgcggaacctaaattggaaatgaatttatttttctgttctttctctcttagttaaataatgttcttccttttcctctatgtaagaaagtttgatgaaactttgtgcttcagttaaataaactttaataaaaaaaacttcaaaatcaacttcaaatttatggttcaaaattcaaattttggcagcggctgatgatgaatgggggaaacgatgggagcctcggttgcgttgatactttgttgaatcattataaagtattatgattttgcactgttgtatacacaaagtgctggtgaaatgcataatcgattccagacatcgcttctatgctcacctacaaatttatttatgttggtatatacggtcgaatttaaaaaatcatatagagaaaacacgtttgatctttctgttcataaatatacatataagttaaattcataataccttcatgtcctccacgaaggaggggaaccctccaattgccataaaggttagcagtgtggcaataaacattagcatgtgtgatctagcctgaaagaatcaaaattaattaattaatatattaatttttaattgttgatgcatactcgatcagcaatttgcgagagaacaaccaatgttttatcttcacttacttgaattgaatcgggtccatagcccacatggtaaaatatggtcccaaggcaaacagttatgcaaacgtaaatggccaaccgcaaccaataatatccaatatctctatacatattgacaaatgaacatctagtaagcacaagtgtcttagtaacaaaaccaggtcggtttcttccaatcatcgcccgatcctgaatgaaaagaatatgttaaacgtaacttgtgatatataccatgaaaatataattatgctaatgtttacatgtaattatatacgcaaaattagaatagaaaccacctcgtttacgtaacgcatttcctggttcgcaacttctgatgtattggaggatttgtatgagttcaccaaaatgtctattgcttcctcttctggcatgcacgggagtccttcttcactctcctgtatgtgtgtcagcaaattgaaagacaacaattccgaaacaaagaaattatggcatctatatatagcatagatatgttcactttgtcgtgctgaaaaccattcagttataaatgctgtcgtccaatttccaattatgctttacttccagattagagaaaatcctacggtggtgttactcgtagcctatctttttaacttctcttttactgttgggttgtatacatagtatgtgcagaggcctgaggtttaaacaatttttcattatctaaaacaaattatgatattccattaactagttatactgcgtatgaattgtgaaagagcaatgctacacgtactaaatttttcttactaaacttttactaacaatcatctcaaccgtttgatttaagtagatagaagttacaaaaaatctagatgcacttatagcatgacacatcagtgttagtaagaatttagtaagaaaaagttagtacgtatagccttttccattgtgaaatgcatgtaccctagtggttgcagtgacctgagtagcaccccaatgtctgagtcaaatctctataggagtgaatttcaaattggattatttgagggctaaatttcctatttgataggctaagttactaatttaaaaaggctgcatatatccggttggatatagaggccgggtaaaaaatacccttctctagataaaaatgaattgtattcatctaccacactatatatctaaccttatcaaaaatgaatcggagtcacagaccacactatatatatatatatatatatatatatatatatatatatatatatatatatatatatatatatatatatatatatatatatatatatatatatatatatatatatatatatatatatatatatatatatatatatatatatatatatatatatatctacccttatcaaaatctttgttcacagtcctcaagaaatgatccgatgggttcctcattggcgggcaagggtagccattcgaagcaaagaactgcaaattaaaccaattagaaggtaaagacagtaaacacgtacatacatagacagtatatatgggaaactctttaatcccagggactgatgtatcctcatttgttcaaacatcctccaaatagttactaaagattttcaatcaaaataacaacattcatacaatatacatatactctccaaaaaagtcaagccaaaaatcaacttacacaatgaaaaattaaaaagataagtccatcatattagcaattccaatgctgttcacattcatatttgtcctttttttctccatatgtagatcaaatttgaaattgatttttggtggagtggtcgctagctatatatacactacattatcaaatttaatttttcacaaccatcacgcattaaacattgaagaaaacggtacacgagaggatacctcctaagggattagaattcaattcccactatatatatcacagttagatcgactaacctcggcagcagttgaagctgggccaaagaagatggtactcccagaggcgagcaggcagagaccatggaagagctcgaagacctcgctgcacggctggtgcacgacggcgacgatggtcatgccctccctggcagcgaggctggtgattcggctcatgacatggaaggaggcagcactgtcaaggccgctggtgggctcatccaggaagagaaggcggggacaggtcaggatgtcgaggcagatgctcagccgtttctgctgcccgccgctgattcccttgctcgaccgcccgccgatccggatgtccagcgcgccagtcagccccatctccctcaccgtgtcgtcaccgcgcgccagcttctccgccgtcgacatggtgtccggcagctggatttgcgccgagtagtaaatggcctcgcgcaccgtcagcgttgtcattagcacgttgtcttgagtcacgtatgcctgatcggtccatgtgtgcataagcatatatccaatcatttacgttttacgatcgccagttgctcggttttttctctgcttaagggtgtgttcggcgatacacttttcaaacatcaaaagtttttttttcacaggcacgcttatcatatgtctaaacaacgtttttttaaagaaaagttctatagaaaagttgatttaaatatttgtgcgctgacctaccaatttgttttacgttccggaaagggttcccaactgcaaacgaacactaccctctaaaaaactccaaccgaacacaagcttaatatatggagcaatttcgtttatgccctactttgatgtctaatattaattttacccagttttcgtttttgctcctattttttttaaccgaactatcgtttttgcccctagtttggatggtgaaatcaacggtgttaagtaattggtaaaaggacatttataccctcttctttctctgttcattaattgtgtttttgccctattttatacatgtagctttgaaactttatttggttagtatatttaaaattaaatgacgcacattgattaatataacaatttagacagattctgaatttgatgaaattttgacaaaatttaagcagcattttaactggaacttgaccaaaattttgacaacatttcaacatcttacacaatcatatgaaatcatagtagccaataccaacagagataggagagtgtataaatatacttttgctaattacttaacatcgttaacttcaccgtccaaagtaggagcaaaacgataattcggtaaaaaaaagtgggggcaaaaacgaaaaccctaaaaagtaggagtaaaatcaatattaaaaatcaaaataggggaataagcgaaatacccccttaatatttctaaacaagtgttttagaaaattagattgtccagttacactatagctaaatattctagttctttatagtataattgtttatgtcgtcaactttgactaaacttcaacttattgtagacaaacttgtagtcatccatctatgtacaacgactcatattgtagtgaacatgtttgcttcttcgctcctatgtagaaagtggcatttatttgcacagtgcagctcaataaaagctgactaaaaaaatcaataatattcaacatgatgtgtgaaattttggttttatcaattaaatgcttcaacgtattttctaatttgaactcaccgaggttccaaatgcaagtttctgagatcggccataattaaaatttgtcctctcatcttcaagttcaagtccaatcttcctgcgtatatcaacatagtaaaaataaatacaaattgaaataggacgcattatgggccgaacttagatatacaccaacaatgtaatataggaaaaatttgctgctgaacattatgactcgtgactttattgttctcgtaggacactgtaaaaccaaaataaatctttgagagaaatactattaaaatacgttatttgctgatggatactgtcaccgttattttgttattgtcagcatgacaagctaagggaggacaccaacaaggtcagaaataggacgctaatgccggagaagagaagactaaccgcgcgcgagatgaactgccgaccatatcgtgcttacagacattctcttacgggacttagctcgaggtaattaacttaagagcaagtctaatataggatagcccactactaacttcaatttatctatagccaatcaaatagtcaattcatataataattgcttactatactattaagatatggtcccacctatcatacacacagtgtgtcttgaagtccgtgctgcagctggctacagatctgtagtccgctgctcttctctcatcatttatctcattaaaatatatttagagctggctaatagcctgctattgtacctgctctaatgccactactaaccaaccgatgataattaattaactccctgtcaaaatttattcggcaaattggtctgtgctgccgttcgtgtgtgctgagcagttacaagatttagtttagtatcgtacgcaagaaacatgtattgaaatttgatttgaattttacttgaacatggagcacactaaaatatagtcattaaatgcgtgcttatctggcacattaaactccttgggcaagtactatatactaatgaaaggaaggggattagacaaacaaataaaataaaggggtgtttagatctacaggcgtaaagttttggcatgtcacatcggtattatcactagtacagaaccttccatatgtgacgccctctaacatgcctggaattcactactacaaaatcaatttttcatagcgtcattctacttttttctccgacggccatatgcataaaccgccattaaaaatataatgaggctgaggggttaagtaccgccagcgaaaaggccgagttaagatagccgccagcaaaaatatgtccatttttgttggcgacccacttaatgtaccgctagcaaaaatatgtccctttttactagcggcccacttaatgtaccgccagcgaaaatatatttccttttgctggcggccaacttagtgtaccgtcagcaaaaatgaaatttcacaagcagaggttaagagcaccgcctacaaaaaaaaatccttaaaatccctcccagcctgacaccttctcctcaaccttatctgctcatctcccatccccaacccatcgctcccactcaaccacctccaccgtgcgcccttcctcctccgctcctctcccttctgccgccgccaccgcgtgcccttcctcctgcgctcctctctcacccgccaccgcgtgccctttcctcctccgctccgctcccacccgccgccgccaccgcgcgcctttcctcctgcgctccgctcccacccgccaccaccgcgcgccgtcgccgtcgacactcagcgaccacgacgacgctggcggtcgggagagtggatccaccgccaactcgggatctggaggctcctcccctccctctgtaccctctccctctaccagatctggttggaagggagtggtcggcacggaggaggtgatgacgcggtggaggaagaggatgaaggggaggcgcggtggaggaaaggttggggagtgcggatcagcgacgggggtacatgagagctccagatctgttgggcggcagcagtgctcggcagtgcgctggtggcggcggtggtcggcggtgaacggacggagagacgtgcgagcagcggagctaggttgcgtgaggcagatggcggatccggcggcgactcgttcaagtcctgcattggcaagtcctccatcggcaagccattaggcaatccggcagccccaagtccttggatcgacgacggcatggagctccttcctccgtgacgagctgccgccgtggagcttcgtcctccaccgccgtggagctccttcctccgcatcgagccgctgccgggagctcggagccttgggttcagcaaccgctgctgttattctcgtggtgaggcaatgggtgatgcatgctgggattgaaacattttttgttctgcaggatcgacagcatggttggcaaaattaattttgatttttgtgatggtgaaattgcactgtgaggtcaacatatttgaatcgatgcttgaatttgtgattttggacttgtatttgtgaatttgtgagaaaaacaggatgcacgaattcgtaattgagggcatatctgaatcggtttgaatttgtatttttgttttttttttgcatcggagaatattttcgcaggcggccctcttaacaacgcggttgctaaaattggttttcgcaggcggccctcttaatagcacgcttgtgaaaaattgaatttcgtaggcggccatcttaagaacgcccttgcgaaaatcggttttcgcagagtattatgaccgcttgtgaaaaccaatgattttctctggcctttacttactggcgagctgcttagccgccagcacaaacctctttttgccgccagcataaatgttttttagtagtgattagtgggctgtcacggatg

SEQ ID NO: 8450 - DNA, 11426 bp, Oryza sativa
gtcacagatgactcatccgtgatgggctttatactaatgtccgattgagatgacttaatattttttttccattcatcatatgaaatgtttataattgtgagatgacctaaagcaaaataattaactgtagtgtaataacttattttattattcaaaataattttttgggtagtaaagaatttctaatggaaaaattaccaacaataaagttgtataacttataaagatttacaacttttattttggtcatttttctatataactttttttaacagtttaaatttaaatttaaaaatatgataacttcaaacaacatttttaaatactaaatgatttgaaatggaaaaattatcaacaacaaagctgtataacttaccaagatttacaacttttattttggtcatttttctatataactttttttgaacaatttaaatttgaatttgaaaatatgataacttaaaaacaacattttcaaatactaaatgatttgaactaaaaaagtcatccacaacaaagttgtataacttcgtcctccactgccgtggagcaccttcctccaccaaaacattctcctatattgcatcaattgtattctgatgaaatccgtgtccatacggttatatgatgatcaatttgagaaattttaaattccattacacgataaataatttgggaaggagggagtataagcttacgtggagaagtgaggtaaaaaaaataaaaagtgttggctcttataccagtgctagcttaacacgtgttccaagataaatacattaaataatatataagtgaggaagagatatgagaaaaaattgatactaacctatagctaatatattatatatattagctttaagatagactaatagtagtaagtgagctctgctatatattatctttggtgtaatctctaaatcctgactttgtccatgaaaactaacccacaggtcctacgctaagtcaatatcctagttgttagtagtaatgaaaggtcatgatgtaaattttaaatagagtcagcatcgggaagtttcttgtctattcactgtcctaatactgttggctaatcaaagggcatgcgtggctcacctaaattcagtcagcgccgcaaaatgaattcacccttcaactgcctaaagaaatacatgacgacgttgatttctcgtatatcgttcccatcattcgttttattaaaaaaaaccatataatcttttatttattttccgtgacttattttctcgttaaagaaattgtaatgttaacttttattttaatatagttatacaatttttttaataagacgaatgatcaaacagcgaaaagtcaaacgcgtcgtatattttaggatggagttagtatcttataaaattataatactatgtgtgattaatgagtcctccttactacctcattattaatgtagtttgtcggtaagtttgattatcacggtaaccacaagtcaagggaaagatatggactccttaataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacactgaactgatcaaagagcatttattatggaaagatgattgtgtcgtggtaaatatgctctcgcaactcgtgcatgtagtcgaaagacctcttaattgcaacctctcttcggtcccccttccgcacttctcctcactgtctagcattcttctcggtgacaagtagaaagggacaggtatctcgtttttctctattactatttatcccatcaatcacaacacatttcaatttttccatattatacccctcaaccaccgttttattctcaaccataaattatttgataaagttattatagtattttatttcaaaccttattgtatgccaaactacctagaaagataagtaatttgagatggagatagtactactcactaaaggttttagaagttttatatcatagtcgattaggtttgcctttgaggacggacgtttgtataactaggattgtatatctttctcaatgtttacgttataatattatactaccaacataaaaataatacatttctggctacgcacatgtgcatatatttctttatatgaataaccagaattgcacactgtttttagacggaggtagtacttgcgtcgttgtttaatttatgtaaaagaattaactagtcgaatttatcttattatcttaaaaattccagacaatattcttctatgatctgatgagaaatttgtaatctataaaaggtataagtaccatgattagcaatattaaaattttagttgtaacttatctatactcgtgctgttaaaacaatgatattttaaattttgaacatttttaaaattttttgtcagggtcaatgctgggttgttttttattaactgccaaatttggagattcttaaacgttcgttttattttgaaagggaccagggtgattccattaattggatccaaccaaatcgctggttaccgcaaccaaactacaagcaggatcaccgtgcataccagacgtggaagaccagctaggtacgcttgaatccaaacgtggcatatgaattttacagacaattcagtggtcggggaaaaacaaattaaaattttcagattgaatcttaggccattaaataacaggacccatacgaagaccctatatagttaccaacacacaatcttaggctgagttcttctctctatgtttccaatccatctctcgtattctacaagcacgtttttcaaactgctaaatgatgcgttttttctaaaaaaagtatatacgaaagttgcttaaaaaatcatattgatccatttttaagaaaaattagctaatacttaattaatcatgcgctaatggatcgctctgttttccgtccacaacagctgtgttcccgacactttcaaacgaacacagcctaaatattttggcacgcgcgtaatattacatttctagggagttccactcagctatttgacccttatataatttacagtgtagaatatactgtaatttcaatgagataattccttatatgctactgaaaattggtctgatcccttgttgccactgaaaattggtttttttcttatatgccattgttccaaatttgcgcaccctctcatgctactcccgtctgttaactatgtgttgaccattaactctcaagtaaaaaagacatatttgcccttctaagtataggatatgcctaacaactcaaaatggcaaatacatcttttttttacttgagagttaacggttggcatgagagggtgcgtaactttggactaaaacatttagtagaagagccaattttcagtgacatataagggatcagactaattttcagtggcatataagagattttctcaatttctattgatgctcttggctagaaacaggcaaatatcctgtctacatgcaaaaagaaaaaaaaactttggatgtttggacactacgtgcaaattaaaatgatgtaacactgcacattgccatgtttatggtataagcgacctcacattaaggaaaattcagttctcaaagagatgacgccttatgcttagagttaaattttgaaatgttcaattaataatagaataaaatactaggattttatatgtgaaaatgatatcgatatatttgtcatataggaacttccgtaaagttttttcttcatatagtagttctgaggcaagtagtggagattagttctatctgtgaaagtttaactatttaaaaagactttctcatgtactatcttcgttcgttttttaatatatgtcgctattgatctttttgaaattcgttttactattcattttattcaaaatttatgtgcaaaccaaccaaaatataagtcatgcttgaagaaccttcaaggataaatcaagtcacaataaaataaataatagttacataaattctagaaataaacgtatgtcaaaataacaacagtgttatatattacaaaacggttggagtatgctacttgctactaataatagtgtggttggaggatttgatttttttttaattccaaaactgtcaaaatgatatgtaagcacatgtacagccccttgccgaattcaagatgaatgtaattaagctcagatcagctagcatgcgatccatggggagaaactaactgagcaaagtgtacgtgttgggttaccggcgagggtgtcgagcagcgtggtcttgccgcagccggagggccccatgatggccagcacctcgccggggcgcgcgcagccgccgacgccgttgaggatggcggcggcgtgccccctgctgtccaccgccgtcacccacacgtcctcccacgtcaggaacacgcccccgccatcgccgtcgtcaagccgcttctcccctcgagccgcgccgacgacgtcgatacctatactatcgaacccgctggcggcggcgtgctccgtcgtcgccgccgctgccgccggatgtagcggacgaggaggcgccgtgtcgccgcggggagcggcgcgccgaccgcggagagccgcgagcacggtgcggaatggggaacgcaggaagccacggacggcggcaccgtcaccgccgccgggagaggttcgccacagcgggagcgacgggcttggcgtcggtgcccagcgtggcagcggcgatgtcgccatgccaacagcctattagcgcttcacagttattcagtacaagtgtagaactgaaaccactaactagcgttctcttacgttttttctctcatctcctcgggttcttttctaaatgtactataatagggcttattaatatagataactccacatatgtaggcatcaactttaaatacagttggttgcggatgtctgtgtttgatgtctgcgtctggcaataacactatacccaagttcgttagcatcaggatttgctagcatatttggtgcgttcgtttctggcggttgggaactcattcactgctacacgatagatttttctggacgtcacccccatttattttcatacggtccgtaagtggaaccacacgaaaaaatagagggaccggcaccgggctgtcgcccgcacgggaaaatgcattttcccgtacgggcgtcttaagagtaccgcacggaaaagttctcattatcccatgcggtcgacttaagaggaccgctcggaaaaatcaattttcgtgtgcgagctttttaagtggaccgcacaggaaaatacctccctcttttcacttccacccacttcaaatttttcacatcctctctcttcctttttcccttttattctccctcaaccactctcctctctctctaccttatctctattctcagccactcctccccaccttcccctactccttcccctcccctcccccgtcaacggcggcggtggcccctcccctcctccccgtgagggagcagtggctcggcggaagcagtggctcagcgagagcgaccaggaggaggagaaggtggcggcgggagagggcacgggggcagcgtcggcggctctattggcagggcgcgacggctgctggcggaggtgacgcggcagctcggtgagcggaggagcggcggccgcgggacgggcggcggacggcgcggcggccgaggcatcgtgcggctcggcgaaggagcgacaggagtgggacaagcggcagacgccacggctgccacggcaccgcgcggcttggcgaaggagcgatgagcggcgagcggcgcacgaggcgacggccgggcgatgtggcagccgggctcgacggcgactttcgatttttgtgttttttttatttttggtttttttattccgtgcaggtgaaataatttgaccgcacgggataatctattaacccgtgcggtccacttaacccgaccacacgggaaaatgattatcttgtgcagttggccgcccgcacgtgaaaatatttatttttccagacgcgtgggtccagacggggaaaacctccgcacggaaaaatcaatttgaccgcacggaaaaaatagtttatgtagtggtgattctctccgcacggaaaacggagcggtctattatcacgtaattttttttaaaaatggatcaacatggtttttttaagcaacttttgtatagaaaatttgtgtaaaaaacgcatcgtttagtagtttgaaaagcgtgtacacgaaaaacgagagggtgagttgggaacaccctcttgcaaacagagccggggaccaaaatcttgtgaatttcagtaaatttcaaactatttgaccaaaaaatcacaaaaaaatgggtaacaaaatgaaatttcaggataaatagtttcgtcctgggtttgctgaaattgaaagccctattaggattgactcataatggggtcttttcataaatttaatttagtggttcgactccattccgtatcaatatcttcaactaattttgacttgggatcagatgacgatggatgaatctgttccattatatagtgtacttagaatcaagtggtcaattggcaacacaattctccgtccaaataaccctatgacgctacaaatacatacatggatgtatatgctaacctatgattctaatatacgacactattgatattttagatacgcttgaccattaatcttatttaaaaaatatatgtaattaccatttattttaatatgatttaatttattatcaaatgtttttataccacgacttaaaaatttctatatttgcaaaaaaaaatgaataagacaaatgatcaatggtaaatttaataaactaatttggtatcgtagatgttgctaattttttctataaattaggtcaaacctaaaaaattttaactaagaaaaaatgaaacgacttacaatatgaaatatgaaatagagtattaaaaatcggaggtagaatatatatataggcagatagaactatatgactattcgttctattgaaataattttataaataagttattactaaagtacatatctatgcttttataaaaattgaaattgtttccgccagaattttggtatgtcatccgtgtttgaagcaattttaattttatgtttctaccaaattttttcctttttttccaactctagagtgtctctcttacctaagacatacgcgaattaattgggcccgtggcttttcacggcgtagcacgccccttgccgcacgcagcgatcgggtccgcgcctaagtccgttttccacacgcgacattgcgcaccaccgcggttgggcccgtgacgccctcgcgcatgcgatttgcccttgccgcatgtccgattgttattgtttcgccctcccccttgatttaaaaattgaagatgtttttgtcctgagttcattttccaaatgcgacattgcgcgccaccgcagttgggcccacgacgccctcgcgcgtgcgatttacccttgccgcatgtccgattgttattgcgtcgccctcccccacgatctaaaaattgaagatgtttttgtccaaactatggtacgtcgtccgtatccgattcccatgtgcgtaacattcatcacgaagtcacgacttacgagtgaactgtgaaagagatttcgtgtgatgtggatacgaagcgaatgaaattcgcagagtccgtgtggataacatacatcgttgcccagatcatccaatctattcgtattacacgtcacgttttctgggatatgctaatatgattttaagtcagtctctacacatgctcgtatgtactattaggatactgttacaataatccacaagaatcaattttactttcggaaagaacatgccaacggaaataaaggtaaatgaatattgtgataagagtaaattaattagtcagtagcaccgcaaaaacctcataaaaatggaaagataagagtagaagaaatttatttttgaaaaatccaaagggatctgtatttcaagttcacctcaatttaccattcttcgcttatgtgcacccagtcttctactaagatcagtagcatacaatgcgacaatggtcgagaggttgacaacatcactgcacagactttcttcctcactaatggcgtcgctatgcggatctcatgcccccacacgtctccaagaaacggtaaagccgagcgtatacttcgttctattaacaatattgtgcgctcccttctgtgtcaggccagccttacaggctccttgtgggccgagaccctccacacagctatccacctcatcaaccggcatcctacaaaaatcctacaccaccactcctcctactatgccctcatcaacggatttaagattattcaaaactttattaactaggtgaaaccccgcgcattgatgcgggaatttaatataataaaaataaaaaaataacgtgtaagatagatagataacattatattaagtaaattaatgtggtttatgataatttaaatttaaaagtatgcagaatggtgattcaaacgtaaaaaagtaaggtcgtatgacttagtggaagaagaaaagtagggagatagtttggaccgtagattaatcatctaaaggctaaaaacaattgatgtgatatgacttaattaaaggaaaaaaggagaaagataatttcgaccatagattaatcttttaagcactaactaagtgagggtgaactatataagtacataggatatcataaatcataataaagatatacattaaaacattatgtgaattatgttggatgatttaacatgtttgtatttaaaaagctcttaaattataaaaactataaagatatagcatgtttgcatgatgtttaaatatgatgattgttagtggatgataatgtggcatcttattaattagtggatgatgatgtggtattttattagtggataatgatgtggcatttttgcatgttaaacttatggagttagtgggggataactttacagttagataggataagcggggggaggtggctcaggtggggcaggtggcgtatcgtctggaattttccattgtgcaccattcaccgcggggtccatgtcacacaattgcgttgagacctgctaatcgtatcactgcagctctccctcctgttaaagatgaaccagaaccgattacaaggcaggtggtgaacaacgaactgattcgtcgtggtgcagcggcaatcaagtaagtcaaggttagccggcaagggcggccggtgttgcagaggatagctgtggctagatcttgggggaactaatcccttccgtatgtaaaatatagtgactcattaacacaagattagttaagcattaactttttttttgaaaaataaattaatatgattttttaatgtaactttcccacagaaattttttacaaaaaatatactgtttagcagtttgaaaaatgtgcgaaaaaaaggagaaatgtgagttagaaaaattagggaaataactcaaccctatagctgctgtgctctccttttttcgactgatccgacttggggacaagccatctgtgatggaggggagaatgttatgcggttatgccttaggatcggcagcaaccaacgtctaaaggaaagaggcccatcagggagtcgcggcccaatgttcgctgcattgtgccagatagggtggcgtgagagggagttggtgtgcgtctataaattggcaaaggccagcattgcaacgcaatgaacgcattgcaactcaaaacatttatccccaaatcaagtcctcctccccacgtcaaatctatgttcttctccgttgactctacttttttataaactggaaaggtagcccacgcatttacgcagacatgtctcatacactaaatttgaggtatttataaaagcgatatattaaccggagaacatctgacactatttctccacaaattgtttttgttagcattaattaattatttaataatattttaacctattagccttatattataccatatataagtaatatctataagcaattatttataatcttcttcatcatttagaaagaaggtagatttattttctttagaaaacatgtcaacgaaagtaaaagtaagtgtaaaataaaagttaaggtgtttttcattgttttttgattgtataatatattatcataatctgttaaaagatgaattgggtgggaggtgaagctccacaaaatgcatgggtttatatagcataatatgattgatatattttgagaggcgattcatctataagtatttcatttagagtggatgagaggctccacgcaacctaataggactacgataacgatgaaatatcattgcacaataatattttagaaacgtcatgtaccatgtataaacacttggttttttatataagatagatctaatggttagaaataatggttctaccggtttaaaaggcataggggtatttaaaaatgtagcttaaaaattatggttatttttatccaatattattacgaagtgagcatagctcaactagttaggtttcttcttatgaaatatgtccacccatgttattaatcagaaggtttaaaatctattagattcttaagaatatttgaatcagtgaacaataggtgtagttcgtagaatatttatgactaaaattaatgaacttctttaagcctgcaggtcgactctggatcatcccctaaattttatagtaaataatctaatagtgtgcacaaataaatttattttatatgatttagattgtataattgtttaaaattttttatcataaaatatttttaacatctaactaaaagaggaaaataggagagaagaaatatgtgggggaggtgatattttttccatctaactaaaacagaaaaataggagagaaaagaaaaatatgggcgaggtaagtacacatatgcatactggcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggattaaagatcatctttagtcccggttcgaatgctgtcaggacctgtcaggcccccccgggatctttagtcccggttgg

SEQ ID NO: 8451 - DNA, 3287 bp, Oryza sativa
tgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaacatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggtcccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggctgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacatacgccacgcaatcgacgtgatgcacctcactaagaacctttgcgtaaaccttcttggcttcctaggtgtatacggaaagtcgaaagatacactggaagcacgtaatgatctggagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctactagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattaatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgacaatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtttttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcccccccctttcacggtgacgattgaccataacatcctcctatcaaatgaagacaccccttactcacgcagcgatcacaagggggat

SEQ ID NO: 8452 - DNA, 786 bp, Oryza sativa
agcaccaaccggggctaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaagattttataaaatagttgagaaggaaaactctagtgaaagttaatattaaataataaaaaacaaactaaaataaaaattaaaagaagtaaaacacattaaaattagtttaaaactttacaaatagattttaagaattatttggtgtaatattttatgatttttgtatgaataaagatatcttataattattgaatgactgccattattgtaaaaataattatttgggtgcggttttttgattcatgtaaatggatcgccaatggatgtacgttgacgggcggtccaaagagtttatggacggcgtgcactattttttaagagtg

SEQ ID NO: 8453 - DNA, 659 bp, Oryza sativa
cttcttcttgaggaacacaactcccgatggtaatgcgtctcccgaaaagcagcggtgaattcaagccaagtgataggtcagccagtagtcctgttcagacgaaagtgatcccaccatcaaaaggcagggccatgcaactgatgtgatgcaaatgaggccttctcctgatcagtgcactgaagcaaatccaccttcttgtatatggcatgcaaccaatcaccagcttcaacaggattagtggtactagagaaaataggcggcctcacacgaagaaattatgctaacttgttatgggaaggtgcacggttatttccttggttatgctggttgcgaagttgctgcatcatcatgttcattaactgagtctgttgagcaagaacttgagcaagagtgggattcccttcattgttattgttactggggccattcccattgctgagagtgttcaccatctggcatggacagggcacaagaagagacaccgggggaaactacttaggacagagaagtactttaacttttattgatcttaactgagtttcattattacaaactgaagactctcaccccactaaactcgccaacttcataacactcaaaaacaaacgaacacatgcacttacatcccaccactgatgtaaatcacatgcgagacacac

SEQ ID NO: 8454 - DNA, 301 bp, Oryza sativa
aacataggtcagatcctcttggacttctatctgttcaagattagcttcttcggtgggtaccctaacacactttttcaattgcgaaacatggaacacattatggactcctgccaaagattggggtaattccaattgataagcaacctctcctcttatactgacgatcttataaggtcccacaaaacgcggtgccaattttcctttggtatgaaaacgatgaactcctcgaaaaggcgtgacatgaagatacacataatctccttcttcaaaactcaaatctctgcggcgattggcggcataa

SEQ ID NO: 8455 - DNA, 37690 bp, Oryza sativa
  unsure (1)..(37690): unsure at all n locations
atattcctggtttggagatagaactgtgcagccgagatggttgttcagaatgggtgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagatctacaatgaggctgctggtgtggaggattaggtgtagccttggtcaagctgcctgtggagtggagctgtctgtgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggtgtgacaggttgtgtatgatattagtactgatgacgaacccagttcgaccgaccattccttagagagagagagtgattgtgggggcgaagatgtaatttatctgtaaagccattgccttttcttttacttgtacaatgttgctgggtttaaattattcgatatatttttcttcgaaatcaataaagatgtgttttatttcttttcgctatttttgcattgtcacttcgcatgctttcgttgggtcggaacgtgtcggcccctttgcgtatattagcgaaataggtttttgactttttagctttcggctttcgttttcgatccgttttattctgcgttggaggaagcactcgtgctttcgttttgatcgagtgtaacggtgttcggttagttgtttcccgaaacaagctgttgtggtttcaacgttcggcgagtgatgcttcggccgattcgtttcgcccccttggcattttcgctgatcaggcgtttgccttggggtttttcaacaaattatcaatcacacaaataaaaagaaggcggaggacacaaaaattttatactagttcgggcctccatgatggataatagccctacatccagattttttgtcttttttcattttcctcttctttttttttgcattttcgtgccgaaatgcttacatagtgccgaaaggcttacataacgatatgtacatttttacaagttggtgattcgggtgccacccattctacacatagaaacacttgagagaggcagtgttccaggaatgctcgaactcttcgccttccagtgtcgctaggcgaaaggagcccatcctagacttgtgcttgatgaggtacggtccttcccacttcgattcgagcttgccgaccgccactgggttcgctttcctccttaggacgaggtggccgggtaacagctccatcggtcgaactttttttgttataagctgccaaagtgcctgcggcatatttgcgcatgtgttctagtgcttcgactttcaccccctccaggagttcgaccgacacctcgcacccttcttcgcccccagagaatatcacccttggtgaattagcccctagctctgtcggggtcattgcctcatcgccatagaggagcatgaacgggctgaacttggttggccttatgggggtcgtccgaagggcctagagaacagatagcatctcatccggccatttgcccttcgctgcccccttaagccttttctttagtgcttctaggatcttaccatttgcgcgttcggccgccccgtttgactgcgggtgcgcgaccgacgtgaacctgatttccaggttaagcccttcgcacaactctttgaacttgctagagttgaattgcttgccgttgtctgtgatgaacttttttggcactccgaaacggcaaacaaagtttttccacacaaacttctgcactgctgctgaagtgatcgctttgaggggttcggcctcaatccatcgggagaagtattggatggccacaattgcgaacttgtacccgtttcgcaccaccgggaacggcccaatgatgtccaacccccatctggcgaagggccagattggtgcgataggttgcagctcgtattggggcgcagtttggcttcggccatggcgctgacagctttcgcacttcttgacttgctcaacacagactttcagcacggtgggccagtatactccttgtcgaaacactttggaggcaactgttcttgtggcctggtgtgcgccacatagcccctggtgtatttccttggccatttcctcgccttcggcaaaagagatacagcgaagtaaaggttggagtacgccagagcgatatagttggcctgagactattttgtatttcgcggctctgagctgtaagcactttgcttctgcttcatcttccgggaaccagccgctcttgaagtattttacgaatggggttcgccagtctactggatcttcgcccagttctgcctggtcgattgccaagacatccaggccctctgcgggcacatttggtgcgtataggacttcgaaaaagatgcccggtgaatgtgggcccccataagcagcagatttcgccaaggcgtctgcttcctcattctggcctctaggtaaatgttggaccgttatgtcggcgaagcacttttccattgaccgaatagcctccaaatacctcttcattccttcttcctttgcctcaaaggacttatcgacatgacctgccaccaacttggagtcggttcggatgagcaagcgccgaacccccaatgctttcgccttttttaggcccaaaagaatagcatcgtattctgctgcgttgttggttgtgtcgaactgcagccttgcggcatagcaaatcggcaggccccctggcgaagtgagtaccgccgcaacgctcgcccccttgtgcgaccacgagccgtcggagtacatcacccagggttgttcaacgggctcgggctcagaggcgaatgccagtgtccattcggccacgaagtcagctagcacttgagactttacagcaatgtgagcaacaaaatgcaagtcgaaaggggatagctccgccgcccacttgctgagctagccagtaacttccttgcctcggagtacttcgcccaaagggtactgcgatggcaccgtgactttgtgggcctgaaagtagtgtttaagcttgcgcaaagccatcaccagggcgtaagcaagcgtttccatttcaatgtatcttttcttcgctccttgcaatgcttcggagacgaaatagaccggtttctggcctgactttgtttcttgaaagagggcagcactgactgccactggcgaagctgctaggtatagtagcagttcgcttcctggtgctgggctgattagggcgggcgggctttgcagatattgctttagctcctcgaacgctgattggcattcgggtgtccaggagaattttcccgcgccccggagggtcttgaagaagggtaaacctctttcggctgcctttgagaggaatcgacttagtgccacaattcggcctgcgagcttttgaacttcacgtacgctcgacggaggcttcatttgctaaatggcatcgattttctcggggttcgcctcgatgcctctttcagaaacatggaaaccgaacaacttgcccgcgcgaacacgaaaaacacacttctcagtattcagtttcatacccgccacgcgtaagttgtcgaaggtctcctgtaggtcggacgcgtggtcgaaagccttgcggctttttacgacgatatcatcgacataagcttccacatttcgccccaactacttgtaaaggaccttgtacaccagcctggcgaaggttgccccggtgttcctttggccaaaaggcatcctgaggtgacaaaaggtgccaaatggtatgatgaaggctgtcttggggatgtcggccgggttcatgttgatctggtgatagccggagtatgcatctaagaagctcatgagttctcagccagctgtcgaatccacgagttagtcgatccgtggcaaggggaaatcgtccatcggacatgccttgttcaggtctgtgaaatcgacacacatgcgccacaaatacgagtttctgttcatcaaagattgggtccagtaaatcaagatcatggccaagaggacagtgtaatcaggaagaatcaatggtgcccttctggtattttcacaaagaatcagaagagaagggttcaaagattgaggaacagggagcgccttcaggagattgaacaagaaattaatcatcggctgaagaaagcaaagccaaggcaggagtgacgtgttaagaatcaggttcctatagccgatgatgttgcggccgatgaggcaaagaggttggcaaaagggaagagtgttgtgacggcactggttaacatggtctttaccctgccagccgaattcgggatcgatcaaaccgatgtcgacgaggtggaagaggaatcgatcaaaccagagcaggcggtgttcgagaagcctgaaggaacagagaatcgacatcttaaaccattgtatataaacggttatgtcaatgggaagccgatgtctaaaatgatggttgatggtggggccgcgataaatttgatgccttatgctatgttcaggaagttgggtagaaatgccgaggatctcatcaagacaaatatggtgctcaaagactttggtggtaatccatcggaaaccaaaggtgttctgaatgtagagctgacagtcggcagtaagactattcctacaacgttttttgtcatcgatgggaagggttcttacagcttgttcttggaagggcttggattcatgccaattgttgcattccttcaactatgcatcaatgtttgattcagtggcaaggcgacaagatagagatcgtgccagccgacaggtcagttaatgttgccagtgccgatttagctctttgggagatggatggccttgattgtttatctagaaaagtctgggatggagattttctaaaagtgtccgattctgatatacaaccaattgaagatggagaacccaagctattattttgagggcgtcgtggagggttcaaatgtctacactaaggatactgtagatgatctcgatgacaagtaaggtcaaggtttcatgtcggccaatgatttggaagaaatagacataggttcaggcaatcggccaaggccgatatttattagtaagaactaatttccagagtttagaaccaagctgatagagctcttaaaagagtttagagattgcttcgcttgggagtattatgagattcctggactcagccgatcgattgttgaacatcggctacctatcaaactaagggttaggccacatcaacaacctccgaggagatgcaaggccgacatgcttgaaccggtcaaggctgagattaaaagattatatgatgctggttttattcgtccttgccgatatgctgagtgggtttctagtatagttcctgttatcaagaaaaagggcaaggtcagggtatgcattgatttccgaaatttgaataaggccaccccgaaagatgaatacccaatgccagtagccgatcaactagttgatgctgcttcgggacataagatttgagttttatggacggaaacgcaggatacaatcaaatctttatggccgaagaagacattcataagacagcttttaggtgtcctggtgcaatcggctcgtttgaatgggttgtcaagacctttggcttgaagagtgctggagctacatatcagagagctatgaattacatttaccatgatctaatcggttggttagttgaagtttacattgacgatgtggttgttaagtctaaggaaatagaggaccacatagccgatttgaggaaggtttttgagagaactagaaaatataacctgaagatgaacccgacaaaatgtgcttttggtgtatcagctggccagtttttgggatttcttgttcatgagagggggatcgaggtaactcaaaggagtgttaatgcgatcaagaagattcagcctccggagaataagacagaattacaagagatgatcggcaagataacttttgttagaaggtttatttctaatttgtctggaaggttaagaaccttttacaccattgttgagattgaaagccgatcagcagtttacttggggggcagagcagcaaaaggctttggataatattaaggaatatcttagctctcctcctgttttgattcctccacagaaaggaatatttttaggttatatttatcggccggtgagaagtcaatcggcccagtcttgattcaggagttggaagggaaggaacgagttgtattctatctcagtcgtcggctcttggatgctgaaactcggtattcccctatggagaagttgtgcttgtgtttgtatttttcgtgtacaaggttgaggcattatctactatccaacgagtgtactgttatatgcaaggccgacgttgtcaagtacatgctatcggctctaatattgaaagggagggttggaaagtatatattttccttaaccgagtttgatcttcggtatgagtcgccgaaggcgattaagggacaagctatagctgattttattgtggaacatcgtgatgattcaatcggctcggtcgaaatactgccatggactttattctttgatggatcggtgtgtactcatggttgtggtatcggcctagttataatttcccctaggggggcatgtttcgagtttgcttatactattaaaccgtatgcgactaataatcaagctgagtatgaggcagtgctcaaagggttggaattactcaaggaagttgaagccgatgccattgaaatcatgggggattctttgatagtaatcagtcaattggcaggagagtatgaatgcaagaatgatacattaatggtttataatgagaagtgccaagaactaatgaaggagtttcggctggttactctaaagcatgtctctcgataacaaaatattgaagctaatgatttggcccaaggggcaacggggtataagccgatgatcaaagatgttaaggttgaaattgcagcaatgacagccgatgattggaggtatgatgtgcatcagtatttgcataatccgtctcaatcggcttctaggaaattgagatataaggcattaaagtatacactgttggatgatgagctttattatcggacgattgatggagtgttacttaagtgcttgggtgccgattaggctaaagttgcaattggcgaagttcatgtaggaatttgtggtactcatcaatcagctcataagatgaagtggttacttcggcgtgcagggtatttttggccgacaatgctggaggattgttttagatattataaggggtgtcaagattgtcagaagtttggggcaattcagcgagcgccggcgtcggctatgaatcctattattaagccatggccattcagaggttggggaattgatatgatcggtatgataaacccaccattgagtaaaggacataaatttatattggtggcaactgattatttcaccaagtgggtggaggcgattgctttgaagaaagttgattctggggatgcgactcaattcgttcaagaatatataatctaccgatttggtattcctcgaactattacaactgatcaggggtcaatcttcgtgtctgacgagtttgttcagtttgccgatagcatgggtatcaaattattgaattcttcaccttattatgcacaagataatgggcaagccgaggcgtctaataaaagtttgatcaaattgattaagcggaaaatttctgattatcctcggcaatggcatactcggttggccgaagcattgtggtcttataggatggcttgtcatggatcgatctaagtccctccttacaaacttgtttatgggcatgaggctgttttgccgtgggaggttagaatcggctctcgaagaacggaattacaaaacgatttaacagctgatgagtattacaaccttatgaccgatgagagggaggatctggttcagtcacgattgtgagcccttgcaaaggttaccaaggataaggaacgtgttgctcggcattataataagaaagtggtaactaaagatttttcggaaggagaacttgtatggaaattgattttgccgattggtactcgtaaattcggcaagtggtcgccaaattgggaaggatcattccaaatttataaggttgtgtctaagggaccatatatgttgcaagggtttgatggtgaagtctatgggcgagcgctcaatggcatgtatttgaagaaatactacccaagtgtttgggttaacgcatgatcggctagtattgccgatgcatgacagccgatgtgtttacatcgcgttgagatggccgatattgttatatcgcccttagttgtttttcatggtgtaatcggttgtggtttgccggtgtacaacagccgatattgttatatcgcccttagttgtttttataattttatcaatgcttttgacattgtaaaattaggggggcacatatatatcaaaatgcaatgcaattttttttgaggcaaaatttttgagcgaatttcaaagtcatattaatcggcataaaggattgtcaagacagtaaagtactagagcatattagctgattacaaaaatttctaagtcctattacacaaaagttattgagacaagtatcgctgcatagccaaaatagccctttgcctaatttgttctttttcttcaatagcttgggcatgttgagcatcagttccagagatgactttcagggacttggttaggtcggcaacattcttgatagctgatttgagccttgatttttgttcttcaattgattttgggagatcggctagcttcttgtgttccatatctagctcggcattgcattcaagttgcgccaagagctcaatcttgcgagcttcgagccgatcaatattggatttgatcggaccttcagatagctgttcaagtttggttttttcttcatgcacaagctgtcgattagcttggattgtggcctcaatctctttgcgctcacggcgttcggctagtcttagcttggctttttctagcttgaactgatgttgctcaagataagcggctggaattaggacatcggccaaatcttcgggaatcagagcttgaacttcatgcagtcgtgtcctaattgacccacagtcaactaacaaactgtctaaagaagaggcttctagccgatgcgagatgtcttcaagtgtttttctcacatcatgagataggggagctagggctttgcttgaagtgtcttcttctgcctcatcaaggtaatctctgatgtcaaaagagaagagatcggctagaacctgcagagacaatttcgaaaagattaagagctgggtaaattatagccgatctaattgttgagacaaagggaaacttactgggatagcaggagcagctggttgttcttcctcctcgacgtgatgactccccacagccgatggagtctgatcacttgacgattgttgtacaggaggagaaggaagaggaggctgcgaaatagaccagtgttatatagagtcggttgagattgattaagtaaaagaattaaggacatcttactggtggagccgatttaacaattgttgctgctggttttttcttcacagcagttttcttcttctgcaaacacaaagtctatgagtaattagccgaagagggaagtaattttagaagaagtcaaagagagatacttactcttgtaaaatgaacaggggcagaaggagttggaggcgtttgcttgggtgaagccgatggtgttctttctgtgtcactcatttcggctacagcctggtcatcatcttcaccaatttcctcttcatctaaagctagttcaatagatggatccaaggcgtgcagatcatcagctggcttatcagtcggcatagttttcttgaatttgacctttttctttggagctaaggccaaggtactcacggccgatgatctggttttcctattttttgcctgcatcggctggttccctggttaggccgtgaaggagagttgaagtcttgggggcatgatagccgataacggggggagatagtccacctccattcagaattagacctggaacatattgaatgttcttgctattgttactttggtgaggaggggaggactctgttgtctgcaacacaggatcaagagattagtcaagtaatgaatcggctaactgattatgcgatttagtaatgataaagtttacatggggtatgacgtcagggaatagatctgtcatataaattgaagctgattgatgaaatagatgcagcttccattcaccccaccatctttcaaagtttttgcttctaaatcctgccaactcaatattatcaatgctgcccagagggggtcctggtaggttaagtagccgatccatcattagagtagatgtgatttgtcctcggcactgaatcttgtcgacaaagaataagccgattgggagttggcccaatccaagttgtctggccgagctcattgggtgataaaactcgtaggagacttggatgtttctcccttggtgaatgccgacagggaggatgcatgggctgattgcagctataagaacttctctggattttttgaatttttcatgattaatgtcttcaaatctaaagtctgatggaagttcaaggtttgctgagtcttcataaggaaaccagattcgtgcatctttcttaaaaccttcgtagaagctgcagaaccagtccttgagtagcttagccgatagcttcgctccagcatcggttggtgtggatgcatattctccatatgacatgcatctgcgatgggtgcgctcttctccgtcgtcttccgcaatcggctctggcagtgggaattcagcttctgtcacagagggccgattgacaaccttcatgactatcaggtttaaccaagtttgcagcagccaccatggtccacctgctccaactattgagctgacggctattttagccgatgcattgttcaacatttggtacagatagccgagaaggattttgcccacaggaaattctttctttgattcaaaggcttcggccacaaatttccagttggttgtagggccacaactggatccacaaaagaggaacttttccagccacatgaccaagaaagctacatgctctcgaggggtaacagacccttggcccatatatgccgccacatagccagaccagccacctatgcttttggtcttgaagtcaaattgattcttggcgttcatactcatagggttagccgatgaagttacatctaatccagtaatcatggtgatgtctattagacttggagtcatcggctcttggttgaataagaaagcattgatggtgttggacaagaagtaggtggcggcaaccatcagaggttcatccttagcagaattggctatggtgagagcgagcgcttggccgattccaatctcatcccagtgaactttcttactagccgatacgcattggtaccaggtggttcagctcttatcaggagtaggtttttcgagagatggccaagacttgaaggtattcttccagtgacccaggttagggttggctagtctaaaggggatccggttggtttcactgatgatgaaatcagtggggacgagattgccgattgggccaagaaaatagtggtttttgtgtgaaaggctgggaatcgcgactaggttggaaaggtgctgcaaatccaaaggaatcgggtagcagaaaacatgatgagaaaaggagaaatcgatttcatgcgaggtaaagggatctagctggtgaggacttacctcagtgtactcggccgatggcgcagtagaagggctggtggaagacgacatcgccatgggcggagatctggtcaggaacgaaatcgcctggggatcgccttatgcgtcggggagatcgtcggagagagagaacaaagttggtttcagcggtgaaaacggaggaggacggtgtgagacttctcgacggtaacggttagtatttaaagcacggcagtaacggtcgaaaaatggcaaagtgcgaaacttgctcggagtcgatttacagcaaatccgaaacattaccaaatattccggacttggggggcatgtgttaacaactaaaattggtaatatcggcatcgggaaagaagattagatcgaagcgaagtcgaaggcagagatcgagttcggaaacagagcaggaatcggctggagtccagatcagctacgattaggatcggctgagtctgagtcggactaggtaagccgatgcagccgattccgacaatacaacttgatgtatgatatcgggttgaattgaggcgcttcaaggtgattgctgcacatgatagagtcctgagaaggcaattgtatctattaattaggatgttttatgtaatttccttagagatacgcttgggcaaaagtctgccgcaaagacttatggtatcttagagtttgttagagatagtagtcgtgtctgttatggacatatcttgtaattcccgggtataaatagacccgagccctatgtaactttgaacacacacgttcaatacaatctcggcgcatcgccacctttttgctttagttttatttcgatgagttcttgctttcgggttgagctgcatcggtttcgatcttcaacaagaggtaaaacttgttatgatggattatgttctcgggattagtgcttccatctttatgatactctaatcttgtctatgtaattcatcaagttaccatatatcttacataatcttcgacaatatcgtcatctaaccaacaatcggctaacatctgtcaacagaagacagccgattaggttaaatagcgacgttgacctagattatataagatatctactattctatgaaacttccagcggcttgattgtctagatattgttcttcttttcatacttagtgctgcatcagttgagtttgatctattaagtcgtgcttagaatatcaatctctagcctgcctcctggttgccgattagaatagtatcggagtttcagccgatcttacctgatttaattatatttgctctatatgcttcaatgatacattaaatctgccctttatgtcaagatcttactgcatttaagtatattaggctcttgtttgatatattttacttgttttagtatcctgatatagagtagtatgggagtattagccgatacacgctagatctatctgatcggctatgctattaagatatataaggttgttatcaatatatatttcgatctaagtgattcatactgtctcggcatggcgactgatctatccctgtcacttgatttaagtatatatcggtataggaactatatattgttaatatctacagccgatcgaatagatttagctctttattgcctatttacaaccgccgatcgattcacctatgacatcggctcaaagataaatgatatgtcatcggcacctagccgatcggctatcatttatagatttaactgcggtttctttgcttctatttcttgttgattgcaggatcaaatcaactggcacgctcatacattcgaaggcgagctttggacctgcactggagttaagcatggtgggtaatttttcacctaataatctggaaaaagctcacctaaatgagcttatcagattataataagctgggctccagattataataagctacttcaataagttgtctgtttctttcagcttactcccaataatctgattataataatcccaagctgaaagaaacagggcctaagttgttgaaggagagcttgaagttgcgcttgcagagccgaagccccttctgccattgcttgtaacacttggccaggcggctgagagtgtgcttgggcagcgaccggctgagcttgcagctgcgcgtgaggggccggatatactaccgcaatcaaaggctgcccggcgaagcacactggcacttgcgtagcttgtggcggaaggtgctggatcggtgcttgtggatagacttgggttggacgtaacacatcgaatactggaggattgggtcgaagcggccttggcccgcctcgctgcctcgtacgcttgctgctgttcttgcatctgccgaagcatgtcctggaggcatgtcatgttctgtcgcatggcttccatgttggcttcggcctgtgtttcagggtcagggttgacttgtacagcggcgagcgcagtcgaggccgctgtcggctgcgacggggcggcttggggcaccagcagttggcttgtcgaaaggatctccgccctggactgaagtgcccttgccgccgcggctgcctttgccatgtcagccgtgttcggcacctgcccagaggcggtaggagccaaaggcggtagtgatggcgcaggtgcggaggcagacgacgctcctctatcttcggtgatgggcggcaaaggctctgctccctcttcggcggccatctcccccccggcttcgctttcctttcgccttgtaaccttctccttcacgaccctcttcggtggcattcgctcttagtggtttcgctcggaggtccccacgttcggcgccgactattgtcgaaacgacaactgcatacgtcgaaagacgtggttactcaacggtagttggaaaagaagtaaagtgtattaaattgagaatttttcttgtgatccccccgtattacatggccctatgagtctatttatagcctcattacgggttttactactagggctttggttatccaggggaatttacatggttgcccttatgaaagggacatttacatgggtatacagtgtaattaaggttcatgggctcctaatgggccgtcaggcgatcgtcggcccaataacccctaggcttgatgggccaagatggcttcttcggtcctcgcggggccgaacttgctaccgcgaaatcatctccctttggcatatactcttcgccctacatcctttcgcccaagaggcctcttgcttggcgaggtacccgcgcaattccctgccacccgcgtccttgttccatagtctttgccctgggggggctttcccctgactaacttaacgtctggggctggaatcctcactggtcgcatgggttcaacaaggtttggtcgaaggggcctcatgccataccgccaacagcgttcatgaaagcacatagctttgttattgttgcccggacattgtctggaaggataccccttgttacaactagtagcagttgtgtcatcaacacgtgacagtcatgagactttaggtttgtgaacttcttctccttcgtgcttattattcgttttatattcgtggagtatccagacggtacctttatgctctccaagtattcaaacatactttccttctctgccttgctaagaatgtagctggctgaactcaagtaatggcttcctttctcctttggttccgggtgaaggtcatcacgttgttccatatgcttcagatcattacatgcttccagtgtatctttcgactttccatatacacctaggaagcaaagaaggtttacgcaaaggttcttagtgaggtgcatcacgtcgattgcatggcggacgtccaagaattcccaataggataactctcaaaatatagagttctttttccacatcaacgcgtgaccatcttcgctctctatagggtggcttccaggcccctttccaaacactactttaagatctttaaccatagcaaacactgttttcccgctgcgatgtttaggctttgtacagtggtccgccttatgttccaagtgcttgcctttcttccgtaccgggtggtttgcagcaaggaatcgacgataaccaatgtacacaacctacctacagtgcttaagatacgtactttctgcttcatccatacagtgagtgcaagccttgtaccccttgttggactgcccgaaaaggttgctaagtgcaggccaatagttgatggttacgaatagcagcgcttgtaggttaaactcctcctatttgtccttgtcccacacggggacaccttcctttttccacaacagttttagatcttcgaccagtggtcttaggtacacatcgatgtcgttacaaggttgcttggggccttgaataataatcggcatcattatgtacttcctcttcatgcatagccaagaggggaggttgtagatatacatcgtaacaggccaagtgctatggccgctgctcatctctccaaaaggattcatgccatccatacttaaaccaaaccttatgtttcgtgcgtcctttccaaagtctttaaattttctgtcgatgtttcgccactgcaaaccatcggcgggatgtctcagcatcctgtcctgttgacgttcttcagcgtgccaacgcatcattctagcattcctcttgtttctgaacaaacgccttagccgtggtattatagggaaataccacatcaccttagcaggaattctcttctttgttggctgcccgtcaacttcacctagatcctctcgtctaatcttgtatcatagtgctttacaaacagggcatacaatcattcggacatgcgtgaatcttctgaacttccagtccctagagggcagactatcttcttagcctcgtacgttgtctcgggcaatttgttttcctccggaagaatgttcttgacaagtttcaataaatcgccaaatgccttgtcactaacactattttttgccttccattgtaagaactccagagtggtatccaactttttgtgccccttctcgtaacctgggtacaacgacgttctgtggtcctctaatatccgctccaatttatgggcctccttttcactttcacagtcctcgtttgcgtcctgcaacatctgaccaagatcatccgcagcgttgttatcgccagcaaccctgtccacctcacccgtttgatttccttcaaatccagcgtactgagcccagtcaggaatgttctcgtcctccgcttcatcttcttccttttcaaccccttgctcaccgtgggatgtccaataattatagcttggcatgaaccccgactcaaacaagtgcaaatgaatagtcctggatgcagaatactccttctggttcttacacttattgcatggacaacaaataaaacagttacgcttgttagcttcggccactctcaaaaaataatgcacgccatcgataaactctttggaccgccggtcagcgtacatccattgccgatccatctacatgaaatgaaaaaaaatcgtacataaataaattttggtacaataatgacagtcaaatagtaatgataaaataattaaaaactctttcgacaagcaattcttattaacaatttttgaagttctaaactaatattagtgttatacttctcttaattttcaatttagtttgttttctattttttaagattaattttcatcatattttaaactatgaaaataaaatttctatatattcttcttctccacacaaattttctctcttcaacttacaacaaagttttggagacaaaaaaaatgtgtgaaacatcgctccaaaagtaatataataacaaaaaaaacattggaggatgaagtgactaaccttttagacacctccgatttgtatataatcactaaaaaaattttacaagaaattttggcatgacctcccctctttctttgagaaattttgaagcttgctctcgggctggaggaggaagaaggcatatataaggggggatcttttgtcccggttggtgttaccaaccagggctaaagatcgccgtgatctttagtcccggttggtaaggggccctgacaacgtctgacatctctacaaccgttggtgatcacatatgtccgttgtagccgccaaccgtctttagtcccggttttaaatgaatccgggaccattgtagatttcggccgaccgaccaaagatggtttctccaccagtgaatcaacgcacctctctgtacgagcccacaataacacgcaagtttgctcggctcctgcatgcaatacctagagtgccacttgcatatacatatcgtctcatctcgccccaaacaaaccaaccaagctagccagctatctgcccgccacaatggacgcactgccattcctcctcctgctcctccagctctcatgtgccccgttcttccagctctcatgtgccccgtagtcaacggcagcgccctcctgccgctccacgatgccgccgtcgatctccaccccatcgtgctgctgccagggaacggctgtagccagctcgacgcggagctcaccgagcactacgagccatcgccatgggcgccggcgagctgcggcggcgctgcggccgcggggaaggggaagggacgacgacggtggttccggctatggaagaacagcactgcactgggcgaccccgcggtggcgctgtgctacgcggaccagctgcgggtggtgtacgaccgcgccgtcgccgactaccgcaacgtcgcccgcgtctggacccgcgtcgtgtcgttcggcaccacccgcggcttcggctcgacgatgatccctcggatccggaaaggtgagccgccggccatgtcgtacgtgtacaacattattattgtcatacactctgcacttttgactaattttgctacgtgatatacgtgggcgattacggtgtacgcactactagaaaactaatcttcgcaggcgggagggaggttcgcctgcatcataacgactgcgaaaatcatcgatcgattttcgcagtcggcgcaacggcccgccagagaaaatgcaaaaaaacgaacaaacaaaaatcgccgcacgcggctcaccgccgccgccctcccccggccggatctgagaggggaggggagccgccgccgtcgtcatcgtcgccgccgccgcgctccatgccattgtcgccccgcgtgtcgtcttcaccgccgtcccgcaccttcgtcaccgccgccggccccgccggcctcccccctccctcctccggccagatctgcgagggagggagggaggggagatgccgccggctgccgcgtgccgccccgcgccggcggtggaggaggagttggagaggtcgagttggcaaagggtggcgccctggaggtagaagcgagggtgggtggggcggaggacgaggtagacgatgagcgcgatgatgccgacgaggatggcaaggacgatgaggatgccccgcgccgtcgtcgccgccgtcgcccctaccggcctccctcctccctcctccggccagatctgggagggaggtgggaggggagctgctaccgtcaaccccgccggcctccccctccctcctccggccagatctaagagggaagggggaggggagccgctgccgccgcccagcccactctactgccgctccacgccgttgccgccgccgccggcctccccctccctcctctggccagatctaggagggaggggggaggggaactgctaccgccgcccggcccgcgccgccgccgcccggacttcagccgcgcctcctcgccgttgccgccctctgccgtcaccgcccgcggtcgccgctggggagagtataagtaaggggaggggagagtatgagaggagaggggaggagagaggctggtgaggaagggaggagaggtgtgaggacttagaaagaaattagggcccgcaaatctatttatattcaagtctattttcgcaggcggaccacttaagcggcgcctgcgaaaatgattttcgcaggtgccttccgcaagcgggcatcaaattttaccccgatttatatttttgtaggctgtcatttggctctaagggtcacgtccgtctgtgaaaataaggtcctcacgttaagaaaaatgctttttctagtagcgacgtactgtgatgcaaacgcatgtgatgcatgctgactatcgtaattagctgctccctctctttcagattacaagacgttttaactttggataaagttaaactactctaagtctgactaactctattgaaaaaaatagtaatatttacaacatcattaaatccataatcttctatctatctattattataaactaaaagtctattaaacttcctacaaacgctcctaaaccaccatgtggtatcctacaaacgctcataagccgccacatggcacgttcaatctcaccgtcgattttcacttaaattggtggactctatattttagatcattagattaaatatactatttaaaaaattaataccttcatgtgggtcggaaaaagaattccatatgtacgaaaggactccatacatacgaaacataagtatgattataaaattgattagagaaacataaatagtacgtacaactgaaaaaaaaaacgtataagcttacctactgctctcacaagaagaaaataacatcatgtacgtaattacgataagagcaataaaaaaaaacatacgtaacataaagaaaaataaacataagtaacatgccattgaagaaaaaaatcgatgttctataaaatataattttttatttacaagtaatatatactactataaatttacggaaatatacacagttaaaatacaatataaatataaaatatctaatcaatgctctttaaacattctatcgtgaaattattttaaaattttgttatccagttggccagaaaaaggaaagccacgtaaggacttatgataaaagcgataaagtaaaaaaaaatgttacacacgtacgtagtgccattgaaaaaaaacttatggcactatttaaaaataaaataaaatatattactataaatctacgtaaatatgcacaattaaactagatcttctatgatatataaatataaactatccgatcaatgttttttaatttgttatccagtcggattcctttaattaaaggaattaaactattggtgcctatgtttatatatacctcacaacacatatgaggccgacatataataattaatgttatctgcaatatataaatataaactatccgatcaatgttttttaatttgttatccagtcagattcctttaattaaatgaattaaactattggtgcctatgtttataaatacatcaaaacacataaggccgacatataataattaatgttatgataatattttaaataatttgcggcactctaaaaacgctctcaagctgccacataacgctctaaaaaaatagaaaaaatcttagaaattccgagaaaaaaactagccctcaattttcattttaaaacaataagtctaccttattttcaaataagatcataaataataaataattgcttgtagatattacttaaatataatataatataaactaataggttagaaattataaaacaattaatgttgatgaaaataatttatggagaaatagtggcagatgttctccgtttaatatttcactcatataagtatattaaacttagcatacgacgcatacccgcgcgaatgcgcgggttaccttcctagttgaataaattcttataatatattagttttggataaaaaatattacaacttttttctacaaatttaatcaaacttagagtagttttattttgacaaagtcaaaacattttataacctgaaacggagagggagtatttatataggtttgtcattcacgagatgccgcacagcggaagatatggtggtccaaacttaaagttaaagctattttttaagagaaaaaacatgtacgtacaggctagaaatagaatggagggggcttatcttcttttttattcctccagcggtctagcctccctactcttccttctcttcattttcttttcccctcccctctccccttctcttaatatggtacgtgcgcccatgctgaatccatccccgtgtacgtaccatcttaaatcctagatcttcatgtttataaatgggactacctatacgtttgtcgatttaaaattatacaatcgccttgcaattgtatagctatttgcatgtaactattatataattttcatatgtaagtttagaaactcacatgataacatactatttccatgaagcggtggtcacatgcccaaatcccctctcctatgcgtttttgtgattgtttccttccttgcttgcacgaatcgtgaaagaatatctaatggtttataattatacgaaagttgcatatatatatatatatatatatatatatatatatatatgttatgttgtatttacatacaagttataatgtaattacactataattattatatttgacaaatttatagaaaaatcactacaaaaatactctcttcggtacaaataatccaagcttatataagacataattaaatctataccctcctccagtacattatttcttacgtttggaaaacggtgcggtctccaaaatacacactactaaataaaccatttttccaaatgatagcatttttatccaggtgggtaggcctctcagagctaaataaaaatgacaaccgtgggcaagatcgtcgtccacctacgaaaatagattttcgcagacggatctcttaagaggtccgcctgcaaaaatatctttaggtggtcatatctttatttttgcaagcagacctcttaaacgatcaacctacgaaaatctattttcgcaggtggtaccttaagagttccgccagcaaaaagattaagcatcataaaaatgaccacctacctagtcaaaattgcctaagtccctctccttcaattcctccctgcgtcctctccttccctctcttcccgacggtcccctcccctcccacctctccttccctctgtccctgccggtggtagcaatggcagataccgcggtggtggcagcggctccatcccggtgcggcttccctcccctccctcccagatccggccaaaggggggggggagggtggtggtggtggcagctcccctgacctcctcctagatccgaccggagggtgggggagggcggcgattcgnncggcgtcaccccaccaccggcgtggcttccctcccgtcccctccctcctagatctgactgaagggggtagggggaagggcgatagcagcagcgactcccctccctcctcccgaatccggccggagcgaggggggagggtggtggcataccccaccccagcgcggctaaattctctcccctccctcccacacgacggtggtggcacagctccaagcggtggtagaggcggttcccctccctccctccctcccagatctggccggagggggagggggaagggcagtggtggtggcccatggcggcgccggcgcccctgcaacggcaagaggtgggatggctgcggcggctgcgcggacggagatgggtagggtggggggtgggggtggtggtgagtttttttttttcggccaaaatatattcgtaggcgggaggctacggtgcctgcaaatatggagatgccagcaatgacctgcctgtaaaaatcatctattttcacagacttatgcatacagacgggcctcccccgcctagaaaatgatttttggccacctggggaaataatttttctagtaatgacatcttcaattatatattattgtctattataatatatataaaagcttttaaatattttagttttattaaagaatgttttggactaatctacacatgtgtcttgaaatttaatgttctaaaagttataagctagtaatagtcaaagctacaattgtttaacttcgttcaaaacgtcaacaatattgaaccaatgtaagacaaacatgtgcatacctttttttttgttttatttagataagcatctgaaaagttactcaaagttcagttttgaaaattgacaaaatcttatgatatactccaaatgttaatgtttctgtctggaaagaaaacctttgtaaaatttcacttttcctagatttgtacatgtcgacattaatatgtcacaatctaagtggaattatcagttatatatggaataagtgacggagctaattaagagaggacagggtgaggcctggcctcgaccaacaaaaattactatgattagtgatcacaagatttgatcgaaatttatcaaaattttgtaaaaaatgtcatatggctggttggaatccaacagtaaattggaaataaaactacataattattacaacttgtaattaatgataagagactacaaaatacgagacaaaattatcaaaataaaaccaactcctgttgtagtagtgttacatcttgcctattacagtttatgtcgataaaattattaaaacatatatattattaatatgtaaaatacaccaaatgcatcaaaaattatcaaaaacactaattctttgccttccattatgctggaaataaaacgaaatatgatgtcaggacgtgcgatgccgatgcaaagacaacgaggaatatgatgatgcaaccagggaatttatggagtagtgtcttccggccttatttatgggcccaaatatcaaatcatatatgtatattgggccatcgtataatcataagtgctagttcattttctatttgctgcttgctagtatcattcctatagtagcagttgagctttgatggaacaatcaatgatgtcaccagggtctagtttaactcttcactagggtcatagcttgtaaaataagaggggtactagacatcggcaaaaaacatcaccccgatgattgcctgtaactccacccctcacaacagctagtagaaaaataggagagcaacatgcagcgttggaacaagagaatagcacgattaaaaaataaagctagtagcatgttgttgtatgtcaggttggtatgtttttggagccatcagtcggcgctgttattaaaactgttctaagtacttcctccatttcatatccatttcatattgatcgatcattatataatcaaaagtcaaaatgtttaaattgatcaccatatagacccttgtaccttatttgatatgcagcattattgtgtttatgcatgcatgtaggtttttaggagaactaaagcactcgatcgtttcttatgcatatggagagtcaaagtatgtatttttcttgattcttcctcactacatacttacattaattaaaatacatgatagtcaattcttttttggtcttggtagaaaaaaaacttatacaataatcaatatggaatgaagaaatagctagtagtaatggtaagtagtatgaaaaaaatatgagaaaatttagggttctcgagaaactacatgtgcattttttcaaacaagaagttttatgtataactgaattcatgtatgcttattttttttcatcaaatcctcagcctcaattttttttggattgaactgcaaatcctgtcaggagccattgtttcaagaagatggcagtgttagtgatatgccctaaaggcaatcatagagatgattgtatcatatactatgtttacatatttatccgacattgttccttaaaatagataactccttattggttaatgaatatgtgattctttcatgagactctttatgttgtttgttactatttctaaaggatccctgatcaaatattatatgtggaacaaatatgtttatatgatccgcacatgtattaattgataatcatatctcatggatcatggtttagagataccaaattaataatgtggacacatgttggtgaacatgttgttggatagacccaacatgagacactgcaagagccatatgtgttgtgtcatcagtgatcttattgagtgttggtgttgaatccttagacctgagattatcatggttctcaacatgtatagtagcttacttagggactgcaaaacgctactccgtaattgggtagttataaaagtagttttcgggtatgctatgaaacatgtagtgggatatgaataatcaaggtgggatttgcccctcctatagacagatatctctgtgcccctcgatgttgtagattacagaagtgcatggccatgccaaaggtgattgaggagtcaatcacaagttatataatctatcaacaagttcgagtgaatgattgagctattagaggatggcaagccttgagcttaatctatatcgtgaggcaaaggggttcatacaagtatacactagaggttcagccgatatgatctttatggatgcccggtgggtcaatacgttctgctaggggccgctgttaacgctggaccgaaaaggagtcttcgggttacagcccagtatatatgaacctacagggtcgcacgcttaatgggccagaataagggaattagatagagatacaatatgagcttaattcggattgggatccgaataggagtcctacgggccttggaggcccgagtgatggatcctatatattcgtgaggggtgtgaccggtggaggcattgcatcacgtgagaaaccttagccgtcacttccctccccgagcaaaaccctagccgcgcgtgggtgctagcacatctgcgcgtggcgttccgtccctgtacgtgtggataccggtagaggcgccgctggtttgcggtgctgaccagcgtgggagtacggcgagaagaacgcatgaggaggagaaagtcgagccggtgcgatcgactacttcctctacatcgatgcgcgctacttcgcgagagttccttcgacttctcagcatctttttccgctgcacagcgcgtcgagtggtaacgatctatgatctaatacttgcatggttcctggtttacgcggtagaaaattttgatttatgctatcgtagcctacgcgtatcccaacaggcagaggcactgggaagaatcagctacaaagaaggagagaacctcttcggcgccccctacgactcccggtacgtggcggcgccaccgggcatgcccgccatggcgttcgatgcctacaccgccgacctgaggtgtctcgtcgagcacgccagcaggaagaacggcggcaagccggtcatcccggtgacccacagcaaaggcagcctgatggccgcggagttcctcacgcggagcgcgacaccgtagtgcaggaggttcgtcaagcacctcgtcatggtctccaccggcgccggcggcatcgtcgtggcgatgcagagcctcgccgcctccgcctacgcagcgccggggtcgctggcgaggacggagcggagctacgggacggtgttcgcagcgctgccgtccccgaacgtgttcggcggcgcgccgctggtggtgacgcggcgcaggaactactcggcccacgacatctcggagttcctcccggtggtcaggttctccggcgaggaggtcaagctgtaccgcacgagggcgctgccggtgaactcggggttgagggcgccgcgcgtgacgatgaccgccgtctacggcgccagcgtgccgacgccggagcaactggtgtactgggacggcgacttcagcaaggcgccggaggtggtgtacggcgacggcgacggcgacggagcagtcaatctggagagcgtgttggcgtggaacacagtggtcggacatgatctggagcaaggtttcttcaaggccgtcaagatcatgaatgcgacatgtttacacccaaatttggtacctatggacgaaataggggaaaattgccaaagtttggaaagtatcgagtttctttcacaaggccggtcagaccgcaggtatatgggcagtctcaccggctagtagggccggtctgaccgcaggtatgtgggcgatcagaccggcagggtccgagtccgagtctgttttcgtcgggtctcgggtttccttgctcgggaaggcatgtttcgtgtttcctttagtttctatcccgagttggacatggagaagggcctgtagagggtaagaccaacccctatttaagggacaaggcctgttcattgtaaaacctccaaatacaatatacttgaatcattcttttactatgttttctattttaccctagttttagttcatctttgtcggtttgcgctgtaaaccgtccgccgccgctgcgagagtgcgacacctcttcgtaggtttgtcctggaaaccttccattttgcccacgagatggttagttatcctcatatcgatctaaatcggcctagaggctgattttgatctctaaatcggctccgctagccggtttagctgtttttctccaaaacccatcttaatttggccctttggctagatcgagatggtaggcgactccatatcaccgcaaagcgtttaggtgttgcgatcgtgtttgtcaacttgtcacgaaaagttaccaacacgatttttggcgactccgcaggggacaaatctattcggctttagaacagccgaatttgcgatctacccatctgtgtttcgtcgagacgagttccacgtctgtttcggctgtgcggccgaaatcaatccatacaattcatctactgctgttgcatatttctcattggatcaatttgattgacggcagtactgtttggtcatcaagcagaatcaatctactagttcggctgacgttatccgatttcatcgttgtctggtatttgagaccgatcgattcgatcggttagatagcagcacgctgccttttctgtcttgctgtgtacagctagagcaagaaaatcattcggattagatcgatcaaagctagtactgcacacatatatttacataaagacaaaaagccgattcatattgtttcggccgttactgtgaagcattgattttccagatttttgctgcacacaggggatcggccaatcaaggctactgatcttttgatttttggaatttttgctaggtacacacgtcagatatatctaggaaaattataagaccgtatattaatctattcggtcaaatatttcggctatgagctatgtggcccgatttaatcaaggaatttcttcatcaactatgacgagcgggaacgggttcaacaatattgctacacaatacattagaaccgatcaaggcgtcatgagaggaaacgtcccgctacctcaagttgtaatttcaccaaaggtaaccttcgattcgcccaacccgtcctttgctattcaaaacattaataatcattatgtagatgcatatgctacttctagttttgctcctatacaatatgcttataatgctacgggggggtcaatgggtgattatgcagccgattacacagaaatcggctatatgcaaaaccgagctgacagtatgaccggtcgtgacaccggtctaaccgcatcctttgccagtcagaccgcgcccaccatggccggtcagaccgtgtactacgtcggtcagaccgtgcctaccatagccggtcagaccgtgccctatcctggccagatcggacctcctgtggccggtctgaccgcaccgctgaccaccggtcagaccgggccatgggccggttagaccggttcccagggagtttctccaggttttcataccacgactagcagtactgattttaattcacctgttaatactgttagtcatgctattccacatatccctaatgcctacaatgatattaataggggatatcctcccgatactaggtatggccaatataataatattgtgccaccacaaccaccttttaggccaccaagtccaccaccaaatccaccaaagcctgaaactatggaggattggtttagaaatactatcagggagaattttgcaaagctaaggaatcgtgctagggagtaccaaaagtcgtatcctgatttttatgatattatcccatatccttgtggttataaaattcctgaatttaccaagtttagtggtgaggatagtaggaccacatgggagcatgtagatcaattttagcgcatcggtgaggctattaagaatacatgtaaattgaacttgttttctttatctttgtctggtactgcttttgcatggtttacttctttaccagcaaattctattttttcctgggctcaattagaacaaaaatttcatgattatttccacactagtgagactgagcttagattgtctgatttaacatcggttaggcacaaatacaatgaatctgtcgttgattatattgaaaggtttagagatattaaaagccgatgttttagtttgaaaataactgacaaagatttggccaacattgcatatgatggattgcttgattctattaaagagaggttgaatggccaaatatttcttaatgttgatcatgtgttgcatgaagctctggctcaggaaagccaagtggatgataatagcttaaatgctagtttagatgatagtgcaatatcatgtgtagccaaatcaagcgacggttcggattgtgttaataatttgtgcaatgatgccataacaattatagccaaaccaaatgttggttcggattgtcttgttagcgtggataataatgcaataaccattatagccgaatcaagcgatgattcggattgtgttactagtttagacaaagatggaatagtcgaaccaagtaatggctagcttagagaataatgccattgaagatatagccaaactaaatgacggttcggattgtatcacaagcgaaagtgaaatagcattatcacctaagaccgaatcacaaatcggtcatgtggatgttgggaaagatgatgacaatgtcttgcgggatagtagtgaaatagaatcgaaagtagctatgcatacataccaaaggccgtatcctgaacacgtagattcagtcccatacccgcaaggatttgaggtgcccaacttcacaaaattcacaggtgaggatgctagaacaacaatggagcatatcggccaatttgttgatcaatgtggtaaggtcggtagtaatgatttgcttaagttaaagttgtttcctctttctttgtcaaactttgcatctacatggtatagtttacttgctcctaattcaatttctacatggtcacaaatggagcatgagtttcatggttatttcaaatatgcaagcttgatggagcaaagaccgattgatacttcatcggtcacttgtgaaactatttcggttacatctatgcctaagaccggaattgttagtgatcctctccctgttagttctattgatgttggcaaaaagaaagggaaaagtgttattattggggatcctcggcccaagaataggatcaaaaatgcgaaggccgaagatcataaagttgcaaaggatgagtcatctagtttccaaaagaccaaaaaaccgaagctcacttttgacatgcttatggctaagtacaagaaaggattagccggtcaacgatttcataatcaaactagtgattcaaaaagaccaagatcatctcgtaggaagagatttggtcaaacaccaaagcaatcggagccatcaactaaaccaactccatacaaacctccgattgtgatgccatggtatccatatccaatgtcaccgtttggttatccttttatgtattacatgccgtggatgcatcaaccgcctatgctgtatcatcaaggatggaagcaatcacctaggacagtaccaagtcattctaactcaagacaagaacgtttcccacaaaggaatcggtccggtggatcaaaagtgaaaaaggtgaagaaggtgtgggtgagaaaagaagccaaagcttcggaagtcgtcactattaaggaggaatctcaagatgttcaagtacctactggagatgcggcgaaaaatatacaagcggagaagactgaagccgacgccgttgctgtcgacatcggcagtctgaccgagacagttggccggtctaactgccagactacggccgttctgaccgaccctcctgatcagtctgaccgacggcttgtgaccggtctaaccgggcccagaggccggtctgatcagggggcattggagaagagtgggaaaattgagagcaacattggagcttccatttcgaccaaaaatatgaagaatcattgcttagctcctggaaaacaaccacagccgaagtggataccttctggcttatctcgctctcaaaagaggaggctacagcgtcttcgggccataggtcaaaaagaaaaggaggccgaagatgtggagaacaagatatgcaataatttaaagcctcgaatagcacctaggcaagtgtggagacctaaagaagtaaaagttaagagaccggtgatttcccatagtagtagtgataaattcaatttgatgagagaagaatcatcggtcattagagataagtctcctccacatgatgctatgggtgttagtgcggtatccatcttgccttcgaaatcgtgcagtcaagaaagccgattttgcttggggggcaagacattaatatgctcatgaaggaatcaagagagatgaacagcgatggatacgacatcacatctttgagccgccgtttgtcagatgctaaggcaaggtatgagtttattgtgttcatcatcatatgatatgcctatgccatgttagaacattgcttactatctagcacatgtgtgtttttgcttatcgaattgatattatacatacatgttgcaaatgccagttctaagtagtggaattggtaggttggcatataatttgtttgtagtatgatttggctcatgagtctttgatatttatttaaagccaaattgtatgtgtttttatggatcaccatataagatatagattttataattattgcaccatgaaagttttgcttattagtaattcggctaatgtcaatgatcaatgtgatgatttattctagagttgttttctttagaaacattggcattgttaatattttgcattcatgctcaagccgattacttacatttgtagtttattggaattcatgtgtgtgaggcatatgactttggtgattcattattgatcatacttcaattggctaagtgttttgatgccatgatgattattgtttcaaaagccatttgaattagtattcatctagacatgttagttggatgctataatttttcatatgtctagagagaagaaattttggtccaataatttgatacaccaagcatctggctattatgtgaagagaaattatatactaaaggccgatgcttgatttcaaaagtttggacgaaattggcaaaatcatagaccaggggcggtctgaccggcattgcacggccggtctgaccggtggtaccggcggtctgaccggctctacatggccggtctgaccaggtagacagggcagtctgaccggcattgcgtggccggtctgaccgatcccagacaggaggctggggggcacgttacaattgattaaaaggccgacttaattgtgaattcggacatttgtgcccatgagttagaggtagcttggagaattcatttgattagatatttgaatgatcctacacttaaggttgatcgaaagattcggcggcaagcgctcaaatattatatcgccgaaaaacagatggagtattacttagataatgatcaatctaaagttgctaggagagtagtacatgaagggatttgtaaaattcatcaatcggcccgtaagataaattggttgcttaggagagtggggtttcattggccgaaaataattgatgattgtttcaaatgttatagagggagtgaagcttgttaacggatcggcaatgttcaattagcgcctaccgctgtgttgaatcctatcattaaactatggccattccgaggttgggctttggatttcattggtcaaatttattcttcgtcatcaaaagggcattggttcgtgctagttgcaatggattacttcactaagtgggccaaagccgtgccgctcaagaatattacttgtatggaggtaattgactttattttgaagcacattgttcatagattcagtattcctcaaatgttaaaggagcttcttttatgtccaaagaagtgagaagttttgccgaatcttatgatattaagttgttgagttcttctctttactacactcaggctaatggataagccgagtagagtaataaaacattgttgaaattgccgttttgctagttgaggtaaatcttggctctttttggtatttcaagcaagacgacttgtcggttgaagattacaagaccttgatgggaaacaattttgaagacgtcattgacaagcgtttgaagactttgaaggagatgaagacacttcaagatggtgttttcggagagcgattaatgggaaatacatgaagaaatacttcccgagcatttggcaagatgcttaggaagtcctatggccggtaattggattatcgccctgagataacatgttcacttttagattcacgtatgttcaccaaaaaggcagggggcatgtgtttacacccaaatttggcacctatggacgaaatagggaaaaattgccaaagtttggaaagtatcgggtttccttcacagggccggtcagaccgcaggtatatgggcggtctgaccggctagtagggccggtctgaccgcaggtatgtgggcagtcagaccggcagggtccgagtcctagtctgttttcgttgggtctcgggttttcttgttcgggaaggcatatttcgtggttcctttggtttctatcccgagttgggcatggagaagggcctgtagagggcaagaacaacccctatttaagggacaaggccagttcattggaaaaccccctaatacaatctacttgaatcgttcttttactatgttttctattttaccctagttttaatccatctttatcggtttgcaccggaaaccgtctgcccccactgcgagagtgcgacatctctttgtaggtttgtcctggaaatcttccattttacccacgagacaggtagttatcctcatatcgatctaaatcggtctagaggctgattttaatctctaaatcggctccgctagccggtttagctgtttttctctcaaacccatcttaatttggccctttggctagatcgaggtagttgacgactccatatcactgcaagacgtttaggtgttgcgatcgtgtttgtcaacttgtcaaaaaaaaattgccaacatgacacacggcggaatcattaccgacgagttcgccctgaagcgtgtgattagcgagatccttgaagcgaatcgtgccacctatgacaaataattacgaacgagctgagtttcgagttaaggatcagaacattgatgttaggtatgtgtcaataatattccttgcatgtgtcaaataattatgcgcgtctgacattctgagtcacgcagtgatgcacattgttgcgtaacaataattaatactccatctctccatttcatattataatctgctttaattttttaagtttgctatgtttataaaaaatagtaataattttaacaccaaacaaacataatatcaaatatatattcaatgttaggtttaatgaaaaataatttggtattatacgagtttatttttctctataaatttggaaaacatataggattttgacttagaaaaaagtcaaaacttattaaaatacgaaataggagtagtaaccaacaaatcatctcatggaccttgttgtcaataactccttatttatgtggaataagttcaatttaaatccctcatcttgaagtgctagtcgaattagaatgtgttggtcaacttgcaatacccaattactcaaggtcccactgcaattttgtgcctggttagagcaaacgtgatgagctgaccgtggtcaatatggttaaatcagcatggggcccacataggcccaaatgtcagcgggtatgtcttattcttcctcttctattcccatctccgtagtctccctatcctccccatttctcttcaagcatgtaggtggcggccgtagtgtaagtgatggagcactatgtgatgacaatggttactcggcttcggagaacatgggacgacggcaaggcgatgcctctagcacggggagccatggtgaagcagccactagggacttgcagcggcaagtggagcaacacaggactggtgaccactgtagagtgcatggtgagagcgttagtattgcagcgaacgggtgggggaggtggtccatttcgtccaacccgtgctgacgtcgcctcgcaccgctggtcccatcatcccgcgggatgctggtgaagtgggggatttgaggccggtgcgtgtggaaggcatgccttcctcagttcttactgagttccggcctacattacacgtctgtcctaccgacattatgaccactggaggtgttaaattaagttgttttttttgggtttcctccctattctctcgattcaatctttataagtcggttagaggataggataagaaaagtcccatcctatatgtactcgtgctctatccatccaatggaatcattgtgttgaggccatgtcagatttcaccgttgtacaggagtatttaattaactaggtgattccctgcacttcgctgcaggaatttatattttttccattacaatcaaggtagaggtaaaaagaaaacaaatgaaatctcagggcttatctgtattaatcatgaatcaaacaaatgaaacccacactttaatgtgaaaacatattgacaagtttgtgttaaatattataaaaatgatagataaatttgtaaaaatattgtgaaaatgatgtgaggggtaatgattggatatgtttgcatgttgatttgtataattaaatagattgtagatgatgttgcctgtttgcatgaggtgaatatgtaattattgctagtgggtgatgatgtggcatggtcgcatgttaagctttagcgttagtgggttttaactttatagaaagtatagattggcagcttatgcgcacttgtttttttcacctaatggcagtgtttagttccattcaaactttcaaaaattccgttacatcaaatgtttggacatatgcatgtagtattaaatgtggacaaaataaccaattgtatagtttgcatgtaaattatgagatgaatcttttgagcctaattacgccatgatttgataatatgatgctacagtaaacatttgctaatgacggattaattaggcttactaaattcgtctcacaatttacacacagaatctgtaatttgtcttgttattagtttccatttaatacttcaaatgtgtatccgtatacttaaaatttttttttggcaggccaacaattcggagaagcttgtctactgggacacttgagtaaggaaattgagagatggggcggtgaatgtgaccactgaccagcgtgttggcgctggatatgcacggagatgatccggaggaagattcttcaaagccgtcacgatcatcagtacgacacactcgagaataattatggcgagttcaccctcaccctctattgcattgtgtgataagctagaatttggaagcggagctatggacgaaagaaatttgttttgctacatgctagaaggtgccaagactgaacagtactccgtagtgcggagtacagtacgaggaaaaacactagctagtagtgagaatagtcagaccgatagtggacaggacatgataccgagagataaagacgtaaaagaggaatatgagaaagacatgtaaaattgttatggatttttatgtatctgttttagtatgaaaagatgtcattattaccgaaacatttattccattttaagagaggcatatcataaatgggagtgttgaatttacatcctgtattagaactacaaccctnnnnnnnnnnnnnnnnnnnnnnnnnnnnnnnn

SEQ ID NO: 8456 - DNA, 29544 bp, Oryza sativa
  unsure (1)..(29544): unsure at all n locations
gccaccacgctgacaccgcaccaccacgccactgccgcgccacgctgcagccgcgcctccacgccgccgctccgctgccgcccctgccgccccatcagtgaacgaaaagcgaacgaacgtacgtgaacgaaacgtgaacttaacgagaacgtgaacatgaacgaaacgtgaacttaacgagaacgcgaacattaacgaacgtgaacgaaatgcgaacgcgaacgaacgtgaacgaaacgtgaatgaatcatgaacaaacgtgaatgaaacgtgaacgaaacgttaacgaacgtgaatgaaacgtgaacgaacgtgaatgaaacgcgaacgaacgtgaacgaaacgtgaatgaaacgtgaacgaacatgaatgaaatgtgaacgaaacgtgaacgaacgtgaatgaacgcgaacgaatgagaacgaaacgtgaatgaaatgtgaacgaaacgtgaacggtcgccttataggacactacgtgaaatacaatatatgttactttgcatttagactaatacatttttttgtatgttgcaaaaaagatgtcgtcgtcgtcgtccctcaagccagagtggtagctagcccgcaaaggaaatcgcgcaggcaagtgatgtaaagatatgattgttagatttttaatataattaagattattagattattagacttactaaatgtgagtgttagagattattattagagttttagacttagcatatgtgagtgttagagattgttagagatttaatataagattattattagacttagcatatatgattatttgagttctaatatatgacacttagacttaacatatatgattgttagagttttaatataagattattatatttttaatataggactaataatataaggctattagatttaatatacgacacctagacttaacatatatgattatctagggttctaatgtacgacacttagacgtagcatatatgattatttgagttctaatatacgacacttagacttagcatatatgattgttagacttttaatataagattattagatttttaatataggactaataatataagactattagattattagagttttaatacaagattattacagttttaatataagattattagatttgtaattagacttagcatatatgattatctagggttctaatatacgacacttagacatagcatatatgattgttagagttttaatacaagattagtacaattttaatgattatctagggttctaatatatgacacttagacttagctgcaccgtctccacctcaggctcctgcaccaacttctccttaggctcctgcaccgactcctcctcaagctcctcgtccggcaccttccaagtcaagggccccccaagctccaccgcctgcccccacaagggcaacgaagaaggcgaaagttgacgccgccaaaaacaaggacctagggtacgactgcacgcaagaggagcttgacgcttatgtggcatcagatgtcaggagacaattgaagccttggagtccagaaaaggagattcttatagacccgagtgccagaaacttcttcaggggtatgtctgcacctgccaaggagaccataaagctatcggactatgagcgaaaacttaagaaagcatcttctggaaagtccaaaccagtccctcagcttggagagcaaccaaaccaggtgatcgagccgttggtgaccggtgaagaatttggaatacaagattttattaatgacaccgggctaactacggatcaattgctacgaggcgcaccattcggaaaggcggaagtgaaatacaagtacgaactcggtaaaccgcttgtcaagcctgagcagctgcagtccctaccgacacagatgtacaaattccatcgactgtacatggagatgagcgccaccggtagagagatgatcgaagtgaggatcagggacacggacttcttgcaaggagaagatattctctggatcaattacaagggtatctacgaactataccagctggacgccctcgacgtctctattatgagttgttggactttgtaagtatcgtccagttagatttcttattacgtttccttcaattaattaggtccttatatataagtacaccatatataatatatacttccttttatcgttgtagaatggagattaaaagggcccgacggcggggggttttcgatactggattcatcgaccctcagaaagtaaacgtcgcaatgctcgacgagtatccgcaagccacagaggacaatctcgtccatctcctgaaggcgcagcattacaagatgttcatactattgccgtacaacgcagagttagtttttactgtcttcctaccaaatttcattcccgtacgaacatgctaagtatttcatatgtaaagcatgcgatgcacattgcagattccactgggtacttttactcttcgacttggaggcctgtgtagtcaatgtatatgactcaatggataaaaaagagtctacgtttgaccaggtttttgaacttatagataggtactgtcataagttccaatgttaattacgaatcttgttataattaattgctactacgaatcatagctttaaactccatgtagggcttggtatcggttccgtcatttggtccacggcaattggagagaaagacttaggcggaagtttaaatttcctgtgagtacacatgctctacatttatattgaatctccaattcaaatacaagtgtatattaattagatctcttgccgtttgtcatgtatatatagtgcgcaaagcaagcccagggaactaacttgtgtggctactacgtgtgcgagaattgccactgccttgcagaccaaatcatcaacacaagagagctcgatgtacgtacaaataaattgaaaatttcattgcgtatgtatcgatttgttgtttactaattaatttcatacattcataggttattcgcatgagggataacctcacacaaaaggaatttatcgcagcggttcaagaacaactcatgggattcatcaacaaacaaatccttgatcccgagggtgaattctactacgacggaaatacaattcataggtcgttagcttctaagataacgactaatactacgtcgaagtcgtagctagctaggacatcataatgaattgtaattaatacatgtctattttcctatatgcatgtacacatttactttagtgtaaatatatattttggtcatatatatatgcacataaaatgttaagtgctttaatatatatagacatatgcatttgcataacatatatgtataaatacatatatattatgcatgtatatatattgaaacatatataaatataatatataaatatataatatatatatatatatatatattatgcatatatatgtattgaaacatatatatgcatggtttatatgtatgcatttatatataaaccatgcagcaacagggccttgcaaataaaaaaaagggaaaattggaaccatgccattataatattgcaaaatttgagatatgccatcctaacccacatgtcattgactcatgtgggtcctacatgtcattgagataccgatagcatatctcaaactttgcaaaataataatggcatgatttcaatttacccaaaaaaaaaagggcagctcgatctttagtcccggttatttcacccgggactaaagatagcgatctttagtcctagattggtagtcccggtttgaaaaccgggactatagggggttaccaaccgggactaataagggtttctccaccagtgattatatggtgcgccgtccccacgcatgcatcatatctccgttttttagttggttggtgagagggttgtttggttggttgacttgcattgccaagtcatattttaatcatgtcacagtttattagttatcatttatgaaaaatagttgcttaggtatgtgttaatttgtttcgctgctacaactttgtcatgcccccttttcttaatttttggattcactagaaaaatacccctacattgcaacgggtgaatgctattttaagcttattattgttatatggtttaggtatggtagaattcaccgtgggaattcatttggatttttttttagaaaatcacgagctgcaattaggagtccgacttttatctcaagttagcatgcgagttttttaaaaaaagagatttcttatacaatattttcaaaagcaaacgagtttaaaatccaactcaaatacggatatatatttccaatagcgaacaaatttaaaaaccgacttaaacaaggatgacgtaccaaaatatcggaaaaacatcttcaatttttataatagtatagataagttacactcttaaatttagagctaaccgtgctacacttttgaccaactatttcttagtcacacttataccacccatgccacaactagtcaccttatagtggaaggatagtggatgagatactgttacctaattaccaaattgttcagagttgcttgtgcaaaaattgtaatatctccccaataaaaaagaagaaacatcgctacatgcagttctgagtgggccgtctgttatactacatgccaaatagtgatattgggatatgagaaagtgagggcactgtggtcttttggttttctctatttgtaggtatgtgtcaggtaggtgaaaactaaatttatttttgtatgaagaaacagtatgtattatcattacatttgtatgtaaagataatttcatgcaatggtaataatttactccttatgtcccacattaaaaatgtcaggttatttagtatggattaagagagtccaattgattaccctaataagtcaaaaccaaatctaaaatttgaattttcaaacttaattttgacgttaattataagatattttgaacgtagtttattttttgccattggcatttaagtgactacgaacacgtatataaatttttatctataatttttttattcccaaataaaccgttttggtttattagggaatatgggcaaacgatgagcacagtgctgttcttccacagccggaaccaccgtcccttcccctttcccgtggcaccggtgcccatggcgatggcttgtagtgcttagtgagctcagcgtcgaacttgctacatccgtttcccggcaacagcacgatggggtggatatcgacgacggcgtggtggagcagacgacggcgtggtggagcggtgggagggcgctgccgtcgatgaggaagaaggggacaacagaggaggagcagcaggaggaaaggtagtatgtccattgtggcagatagctcgctagcttggttgtttggagttttagataaccacgcgagatgagacgataagtaggagtatataagtaagtggcactctagctattgcttgaaagagccgagcaaattaacttgcgttattatggtaagctcagttgccacgtttccgaaaacggaaatttgtctggacgaaagtgattttcatttaaggatccaacgacccgaatttatacatttgggctcgtacagataaggcgttgattatgtggtgctgtccctgtccccacgcaatcgcttatattctgcgggcagagtacaatcaagcgcctgatgtttgaagaaaaattggacgcttcacctatgcactttgtgttgcatacatcatatcttcttttatttattggttggttagaggatggttggttttggttgcgtcgcattgtaaagtcatactttagtcttgtcacagttttttagacatccagtatctgaaaaaatagtttcttgggcatatggtagaccctatttagattacaccctgtcacatcaaacgtttgaacacctgcatgaagtattaaatatagtcttaaaaaataactaattacacagattgggactaatttgtaagacgaatcttttgaacctaattgtttcatgatttgataatgtggtgctacagcaaacatttgctaattaccgactaattaggcttaataaattcgtctcacggtttactgacatattctgtaattagtttttttattagtgcccgaacaccccatgcgacaccctatataatattcgatgtgacacgctaaaactttacacccctggaatatttaaacacccccgtaatttgtttagttgctgcatctttgtcataccaaactttctatctagggatctacgctttcacatttagagctaaccatgtcacacttgtgaccaattatttcttagccatacttatacctcccatatcaccacttgtctaagcttgcattaacaaaatatcctaactgcaggctatattctaggctacatcccattcttatatacttatcttagcatttttttccccaaatgatttttccttctaaattatttatctaatctgcgatttggttacaccatcatatttcttttaatttagccgttacaacaagatcttaggaaactaaatttgatcttggacaaatatattttgatgagaaaaatcatgtgttattttatcgtatattgaaaattttttcatcactcgatcaaatttagttcaatttacaaaaggtttcatagagatgcaacattcaaaatatatatgatggtgaggctagcaattagttagccacaaagtttaccacacctcactttgccacaaatgtgtcatgccacataaagtgaggctagcaattagttagccacaagtgtggctaagtttggcaagaatttgagtctatgacgtgtaggtccaatgactagcaaagtgaggcattacacaattgtgacaatcaaccaaacactatactaagaaattatggcatgcctaagatttggcatggcaacctttgggagccaatcaaatagccccgtactccctcctctctagtggataatccaatatagctaaccgatgagctagtttgaaaaacaaaaatcaaaatttttttcccgcatgcatgggcaacgaaggcacatgaaattagctgatgtgcatccgtatctagtcaataattcatccatgcatttcggtatgtaagtacgagaaccaaggttgaaggagtatataccttttctttttcaggatccagtatatactgtttttttttatgatctaacatgtactagaatttttttgctggagtacatacctttttattgtaatatccagtatgtttgtacttgatttcttttaggtacagtatgtacctttttaaagttaagtatatacttttttaagttagtaatggtatatacctttttgaattagtagagcagtatatacctttttaagttagaagtagtatgtaacttttaaaaaatgtagtagcggtatgtaccattttaaattagtagagcagtatatacctttttttatgttagtaacagtatgtactgttttttaaggtgaatatcagtatatactactgtaatttcaatgagtactgatgtacttaatgattttttcctggaactgactatatactaaatttaatttcttgggacgagtatatcccgatttcttttctgaacaagtttgtactactcttctttgaacgagtgtactgatctatatactgatttctttcacaaattatattctccgatttcaggagtgaacatgaaattttaaagaatatatagaaagttatttcctcaatttagattaaattgaagcatagtccgatcccaagagaatttgcaataatccaggcagtatatggattcatacatttagccattctgaaaaagaagaaaaaatgaatgtacagtatacccaattttcgacctgcacaaactgctttggacagaattttcatactgccatatccacattttctacatctacatcagctaatccatgcaaccatgcgaatatactgcccggtgttggccaccatccatggtgtatttgtcatgcatctgtatggagcaaagcaaagaactagttaattaggagcttcatcattcttcagaagactaaataatacgctgggttatcaaataattttttttaaaatactagcaggcctactcatggaaagagggtgaatggggattacattcaagtacagatctaataagaaagggaatcctcgatctgcaggaagagaaaaatggaaagataataccttggcaggatgaataaggagtagaacagagtggttacggcctcatttccctgcacggcgcatggatttatgtgtcaaccgggcttggcgaagaaaccccgattgcatgatcggatgatcctgcacctccggccaaccgtcgttcttcgtccacaccggtggtgaggagtagtagcgtcgcgccgaggtgcagccaggccaccgctgcctccgtgtggacagcgtcaccgcacagcgcctacataggacgagacgacgaatcgatgactgatatcgtcgccgctagggcactgcctaggaacgccatgattgccatgttgctgcaaatggatctcaccgcatcccaacaaatcaccgatggatgccgccggcaccgtgcatggttgctcatcaatcgccaatggatcatgccgtccgctttgactctccggtagctagcggtcgatccgaatattgcggagagagcgagctattgccgtcgctggttaagtggttaggatggcagccggggatttatattatttgctcaggaccgattagtgtgggatagttaagcattaggtgattttttttttataaaaacgaaacgggtctgttgagtggatccggtaacaaggttgatcgtgtgcctcattactgatgaacggtggcaggtgtacgtactcccaggtgtatagaaccattttcatatatatatatatatatatatacatatatatatatacatacacatatatatatacatacatacatacatacatacatacatacatatatatatatatatatatatatatatatatatatatatatatgtatatgtatatgtatatgtatatgtatatatgtatgtatgtatgtatgtatgtatgtatgaatgttccacgtgaaatcaggaccccgcaatccatcccaaaatatccttgtttgggtaatcaagggttttgctggcgaaaacttgtgcgaattgcgattacggggtaaggcgacacctcatctatcttttagatcacaaaacggtggttcaaatgtcttgagcaagacgaatagattagacaatcaagccaatgtgcttgaaatgatgattgatgttgatccaagtggtccaagtatgtctatttgcaaagatacgatatgaaagcattgcaatatctactagcattaactactacaattataacatttaataggaaaaaaatttgcccaaatgcacaaataaaaatcaataatttttcaggacgagatgggaccgggaaattaataattaagatagtttcttcatggccgaataacatatatatgtctgaattctgatcctgagatcattgcctaccatgctatccgcctaccatgctatccgttatattttttctcagaatttttttctgcaaggaaatggtgattttataataatcagtaacaagtgctttaatgcccagagggtcatcaaacggccaaacagcacggttgttcaatctcgatcctagcacggttattcacaagagtcaccttgttaaaccctcttccaattatctagagcttcaaaatgatatagatggttaaatggcagattcataatatgttgaacgtagaaatcggagtgcctctagagcctaaggtggactcgaacttgatatgagttggacctccatcttgatttgaacgtctatgacgatcttattcatctcctagcttcttttcatgtgctccatggtctctccatagttcataatcgtgattaaatcattaggtagcaatctatcctcgcaagcacataaagaagtacttaggaacgagctcatcagtaaatttaattgtcgggcgcgagctctagtgactggaccttgcaaaacaatttgaggggtagcgtgtgtatccaaaacgatagggcatgtagcctagtggttccagtgacccaaataataccccaaggtcctgagttcaaatctccgtatgagcgaattttagactgggttatttatggggctaagttaccaatttcaatggccaattagtaacctcgactacctatcgaacagtgggtgcacgcagaaaatgaggcggacttgtgtgtccaattgggggacattgagaatttgagattgtatttgtacatgagcctgagcctatggtgcacgtacagtgtattgttgatccatccgctttgaatttggaggccctagctgagcaatagagaatttcaagcccaattatgcgtactagccatcgagtcgtgggttgcacgggatattaatattgatagcacacgctacatgtgatttagaaccaacaccatgttaagttttattttagttacgtggataaaatatgtttggtcataatttcaaaagaactatttatatatagtacatcctaattcttattaatttcaatttattaatctaatagttttaaaatgtacaaatattaagtaacgatatgtactcatgtccatgtctcaattctgtattttatcttaattaatacacatatatagaattaataggtaccgtattgtagttagtttaaagtcttcttttcatgatataatattttttaaatatataattactaaatattaagttatattcattttgaggtctgaattttagcttttttggacgatactccgtatggagtttaagttattacttattcataatttaataactttgaagttcacaatcaataactatcgagttatatttttttcagaacatcaatgttagctttggcgatttgtaatccaaaaaatcagaataaataagtaccaaactgtactcagtttggagtatcaattatagctcatgatttaatggtgcgaaaatttgtaattaataaatactgagctgtataaggtatcaaatccaacaatagtttttccatgtattaataattccaaaaaaaggaatacattgtaatatccattttagccttttcataatttgctatttctaaaattgattattaataaatgccgagtgctacttgttgatgaaaagaaaaacacacaatagcctgggagatctgcttaactccagtgcagttataagatgttgatgagatgcgggcgtgccagttagtttgatcttgcaacagacaagatatgtaaacaacagaaaaaacagccgatcggctgacaagccgatggagtaattccagccgatagccgatattagccgattccacccgatgtcgatagggttttgagcaatcggctatatatccattgtagataaatatatatagacaatcggctgatgataataaaatataacaatattataatccaatagaaatcactcggctaataataatatgataggataagtatcgatccgatagttaaaagcatacattggctaaaagttcgatgtcataaaatccaatcgatttagataaacagtgaaaccttgttgcaattggcaaaatctaacttgtaagtaatctttgtaagccgatgcaacgtctagaaaacttatcggctagcatcccgataaaacactagcatgaacctattggcttaacaagatttatattatcaacaataatttagtaggtcggacctaatcgatgcagcacgagattataaatgatagtctaatgctcgatgagccgatagatctgtctaatgtgatggatataagaaatctatttataacagcattgtgattgtagagatatatcggttaagacggaagatcagacctaaccaagacagtccgaattaaaccgatacgtctctaaatacaatgtaattagagatagaattgagatatcaggtaggcaaatatatcaaacaaaccagagcgatccaagagatcggagtgatgcagccttgaacaacaccaatatagccgatagtatcactagggccgacgaaacgcaggacttaccccttcgtcggatatggaactgaaccgatgcagccccacatcaggtaccaaattcctctggttgataagtaaaacctcagaaaagagggtggcagtgcgccgagagtagtattgatcgagagataaattacattgaccccgggtgtacatatttctacacatgggtggaactgcttatacatttgtcgggtgatttttaacaagaaatcatccagattttttctacacttagatttatatccaacagactacaaaataaaataactaatacaaatttacttattcaacatctttatcaaaattacagtacacttatatgtcatatcaattttagttatataggactgtaattttatattttaaatactcacatgtcctatcaactgaatttacaaatgtaattttagttatataggagtgtaattttatattttatagaaaataacgaatgcatatttaattacacaacatttttatcaaaattacagtacacttacatgtcatatcaactaaatttacaaatgtaattttatttatataggactgtaactttatacaattacagtataattacattgtaacttacatataactgcataactgcagtataattatagtgtaacttgtatgtaatttcaatgtaactttgtatgtaacttttaaaacactgctagtcatacgaaataaacatcacgggagatctctcacccgtattaaagtagtattatcgttcaatcactttcgttctatacagtggcaaagctaaaaaaagatgcgtacaatacctcgcttggttataagtgccttgccctaatcaggtgctaatcggtaggtttaaaaaacgtcaaattttaagtaaaaaatttgacgacagatttatagcaaaactgcccatgggtagatactagtccttgtaggacaagaaagaaactttcctaaagataaaaggaaaacataaagtccttatcggacactaaacacactttccttaagataaaaagaaactaaaacctgcccaattaatagataaactgtcatttcgcatcctccttgaactcagactcttctagataagtttcctttaattgatctttacccgaatccatcaagaatacaactgttggcgattgatagtttccatggtcgattctaggactttaaaaccgatactgactctaaacctatgattactctgggcttaacaaattttgccattaacactactatatttaaaatctcagttaatttagtaattttgaaactaatacatatcaaatcgtacttggtttggagtttcaattatagatttgagtgatttgataattgaaatttaagaattaatcactactatttgtccccatcccaatttagttttgtatttaatttactaattctgaaagttagaggttatatgtttctgagtttatatactttgatgtcttgcattagaataaagtaaaaaaaactattgactccatatgttttccttttggagtgttttacttgatacaaatttgatttgggcccgtgtgattcttttctaatttttggatgagatcatagaatcggagtatgtttcttcgtaggtgcaaggaaattatacggaatacctatgtgaatccagcagttgcaacacaatcatggatcttcttagttagatgcaaatgaacctttcttgtggattattgtgtcatcacccgaattagttagctaatttactcctggtagtgtggtttcaatgtggaacaattaatcaaattataaaccaatctgtttgataaataaaataaattaataatcttgattgtgaaaaaaatatacctgacctgcaaatttaggatctccaggttccatgcattggccaataggaattcatgaaggcatctcctgctgttttttccagagtcatgtacacatgcaaccatttgatgatgccgtgagaaatcaagattgattgacaaaacaaaaaaatatatacactcaaataccaaatagctgatcgggatggagtatgaagggcaaacctggagcatctcctgtggttttgcgcgcggtgttcaatccctattggtttctcgtattgcagatagaaaaaggtagtcgattatcgttgttttaattagatgtatctcccaaatatttgaggggcttttacatggcccacaatattagctaagcgttgttttctttcatctacggttgctatagtatgatctattaaattaacggacaaatgtttctagttaccatgagagctcgaagatagtggccaattagtatagatactagccgtcaacccgtgcgttgcacgggttactgttgttggtatcataaataccgcttagattatgtattaaatgtattttctaaaattagtgtggcttaaattttgtaaaaaaataacattgcggcttatattgcattataagaacaataacattgcctacaattcacttagggcccctttgatttggaagaaaaacaaaggaatttcggagagttttaattctgtgggaaattttctatgaaagcctttgaaacaaaggattgaatcctatcatatcctttggaatacctatggattgattaatccggtagagattttagagaaaacttagtaagagctctaacctctttagaaactttcctttgaatctgtctctatcatccgattcctgcgtttttcctgcagtccaatcaaatggtcattcctctgtttttcctatattttgcaatcaactattttgcaattgcattcttatcacaatcctgtgttctttttatattcctctatttttccattcatgcgattcaaagggacccttagaattaatattgattaatcatattaatcataaactaccaatagattaaattgtccatgattttttggatagcatatttatttaacatagaatttttatgcaatcgacggtcgagttaaatctttttgagctatccgatggctaatataatcggctagtataaaaaaaatgtttggcatcttaattggaatttcatatgaagatgtgaacaatttcatatttattaattttaaaattggaattattaaatctcaaatggtgtttttattaaatttaaattgaaatatttatttgcatatttatttgtctataaaaatataagtgatgctaagacataaataaatatcaacattatttgtgaaaggaatgtataactcttcatcaatctgtgtcatgttgagggctaataattttgttgacgttgggatttatggcatcccagagttctattacactgactttgactttccgtgtttcctttccacggttgatgcatatcacatgccactgcagttataaaaaaaaagactgttaagttatatttatcaatgtaaccatgtattaaattgaccaaaatctctactattataaaaattaaagatatttttgccagtattctggtacatcatccagttggttttaagatcgttcgtttttagaaatacagttccatgtttgagttagattttaagcttgtttgcttttgaaaatacaaaaaagagtataataagaaatctcttttaaaaaaaaactatgcatgctaacttgagataaagtcagactcctaatgcagctcatgattttttaaaaaaaatccaagcgaattcccacgtagaattttaccctaactaaaccgtataacaataataagattaaaataacattgacccattgcaatgcacgggcatttttctagtctaaacaaattaaaagaacatcaacaataagctatacgacatgacacatggaaaactacatattagttcatagagtgcatttggaaaacatagatcagtctatgttatctacacaaaatcatcattagacaactctttttttacactgggggttttgccgttgcctgttgggaacagagacctcatccaacaggcaaaaataagcacattcaatatgcaaaaaatcagctagtatttctactgtgtacgtgtagaccggacatatagacataacatttgaaaattaaattaaatatttagttcataggttgtcatcagaaaaaatatagatcatgaatcaaaatcagaaacagaacctgctaggtcgacagaatattaaatagcacattctatgggcaaaggatcaacagacaattcattaattatttcaacaaaatcataaatcgatttgtgtttaatttgattacaaaattcacaccagacttgtggggttgcacttgttgagattatgggcatataatgatttaatttattccataaataaatcatgacattacagatgaaaactagcatgaacgcatcattagatctacacatgtaaactacgcagaataacatgaacagatcaaatatgcgcaacatattgaatacgtaccgaggtgacgaaaagaccggctgcttggtcgaaacttttcgcaggtgtctacgaaggcacgaaacacgcgagcgaagaggaaggcgagccgtcgcgaacgaacagggagcagccgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatcctgcgtgaagacggcgggtcggtttatatagagaagggtcgcttgatcagggcggatttttcggaacgtttccaaaacaaaaacgaatccgaatttgcagcaaaacaaaactgcaaaaggaggctgcatctgcacaagggtgaggagccaatttttcggaccattcgacgcgtacgtcgtgcacgcgcgccgcctgccctgccctgccctgccaggcgcgaggcgaggcgagcgagcgcgcgcgtgtgtttcccctcttctctccaccacacatgcttcaagtggctaggaggacatcttcccttttaaggaggtccccctctcctagaataagcaaggtcgtactaaactccacatgcatgccatcccatgaggtgggctttttgtgattttccaaagaattaatcttcgagtgggctaaggcccattcattaattccaacagcactcgttgggatgggcctttacatgcacaccttgtggtagcggagcatgcaattggcgaggatagtccggtaccacttaccttgctctgcatctgatctagtgggaggaaaccaaatcgagctgcagcttgagtgcagcttgagatcagagtaagaaagctacatgcctctattacagatgccatgatagagaggtggaagcgaacctttcttgtgaatcatgttgatacgtatctgagttcggatgagtcctgatcggcgtcatctccgatggaaacttaatcttgatagcgaaaaaataaaacagttccagctggtcatgtatgcagcagatcccttcgatggcagattccatctcgttctcgcttgctcccatgtgttccaatgatcccatctgatcaattaattcgcatagagataaaccatcgatggtgtgcttggagatagaccgatggttgtttaatttcccctgagtgctgcagtcagtagacattgaaaagggcccacatagttaaagaggcttttcagtttggcccaggacccacgatgtggaatccttttatcacgttgaaattgttttaatctacgcttctaattatacaactaatctaatagatggccagatctttctaataaatgtgagagctcctaaacagtgcccaattagtataggtatagatagatggtgtccaattagtatatagatggatagattgtcgttgttgttgtggagtcggcgctgctgggtcgcttgggtggctagctcggcaacgataacacctcttctacaatgtgggagctgttgtgtcgcttttgtgtttagtttggcgtcgacgtccatcgttgttagttgtgtagcgatgggttttagccggtttttctgtaattaaccatacggatgtatggttttcgtgcccgatttttcttataaactgggtcaattcttttcttctaattataatagtggaacaaagttccgccttaggtttaaaaaaaagatagatagatagatggatggatggatggatggatgtaaagaaggttttgtgatatgtactcaataaataaactttctactatggacaagtattggaaggtcaactttgctgtgttcgcatatgctggttcccaacccaaatagtacgcacggaaaacggagcaatccattagcacgtgattaattaattatttactattttttttttcaaaaatggattaatatgattttttaagcaactttcatatataaactttttttaaaaaacacacaatttaacagtttgaaaagagtggcacggaaaacgaaggggtgttaggaacttggagttccaaacgttaaataggatagaaaaatgtcggtatcgaaaagcatttgggctgatatttctctcgtttgtaatcaagctgcagtgtgttcctctcttattcccgatgttgggcttaattacagtccaactcttattccgtctgtgaacaaataaagcccacatgcccaatgtgagcaaggctggcctctttttctttcttctcctcagccttcagctcaatttgctgtatctggtagaactggctgagtcctccaaacttgaccaataaaggtaaatgaagccagtgatacacgaatgaaatttattacataaacttctaaaacgtttatttagttgtataaacgtgcgtagcgcatacgaataaagaccaaaatagcacaacatggcagattttgctgactttgatatttattaggatgccacgtatataaatacttgttcagcaatccatagtgtacgtctattgtacatataaatataaatatgtctataaaaggaaatataagggacacaaatacagaaaagataaaatagaaatcctacatatagttatttttcaatagaacatgcgtaatgccccttgtcagtatgcgtgtggcgtcctaatcaatgttcacctcagcaagattagccatgcatggtgaactattttgagcttgattcatacgcacaatgtacgtaagttcatgtagcagaacgagtgttttacaagtttttcttagattacacctacttataaggtggtgtaccaccaatataacttactcacactacttaaaaaggcaaataggtgtcgccactataggtgccagcacaccaaaaaccggcacctataatgccttcccctcccatgagtccatccccacgcaccacatattcaaaaaccggcacctttatctctaaataggtgccggtttttaaataaaactgcacctaaaacctgtgtccgagaaaggtgccggttctagacccaaaaccggcacctttaattttctccctcccacactagctgtcacaccctgaaaattcaaaatatataaattgttgtttaaatggaattaataaattgttgaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccgctctcctctctcctcggcccaagtcggcccagtccgccgccgagcgcgcgcgcatccgaccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatctcctctaccttttctcttttggaatcatcggctaattctttttggaaatcattggattcgagttcgaatcggattcgtctctttcctccgaaccctaaaccttccttctcgtcgccagcagccgtgggccttcgccgtcgcctccgagcccctttaaaaggttccccggtgtctcctctacccgccgcctctctcgccttcgcctctcgtcgccggaagagttctagcgccgtgcaacatagcgtcgccgtcgccgccgtcgctccagccgtgcgccgccgccgtctcggtcgtcgtcatcgcttgggaaggccaccgtcgtgatcgccaagtcgccgccgttctcgtccgctccttcgccgccgccgaagaccgccggagcaccgtcgccgccgtcaacccgaagtttgccgccgcttcctcctcgtcgccgtcgccgtccgttgatcttccgccgctcttttggtcaccggtgagttcgccgcgtcgcgctctacccgttggtgccttccgttcgcgccgccgtgagcctgagccaccgagccgccgccgccggtggtgatgtcatcgctgacgtcatcgtcatcctctcccgtgagccggtcgtggaccgatcgatctcggccgtccgttttggatcaagtcgatctcggccgtccgttcgcgtgaaccgccgccgtgcgcccggtccaccaaaaccctagcccgctgacgcaataaatccctttttccttttccaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctactcaactattgcatttattttcgaatgtcattgggtggaattaacctattgtttgttatagccctttttgatcttgattactttattccttgataccttgggttattataatttgactagttgagctttatttatattggttcaactagatattaggtataatagcttagccctgcttagaaacattagctcactattgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataatggggtgattatgatccaggaaggtgcgctacggtggattgtgttatgcaaggggtattgtcacaactcctttccgaggtaccgtggtggtattgaggcacatggtgacatgatgtggggttgtgtcttgtgggtacagtggtacacctcttatcagagtaaaactgttcgaatagccgtgcccgcggttatgggcgggtctaacaatgtctttcatgattagtctcacccttctcaccacagtaaatgatgctataactggtaataatttgattagctcctggtttggaatggtatattcctggtttggagatagaactgtgcagccgggatggttgttcagaatggttgggcctatacaacagggtatgttgtatagcgttagattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagatctacaatgaggctaatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacactagccgttggcaggccccacacataggtgcctgttttgagacaaaggtgtcggttctcaacccaaaaccggcacctttgtttcattagtgtttttcatgtccgacggtgggccctacacaaaggtgccggttcttggtattacaagtcaaaggtgccggttctcgatccaaaaccggcacctttaatattctccctcctgcactagccgttggtgggccccacacataggtgtcggttttttgtatgacaagacaaaggtgccggtttttggtctagaaccggcacctttcttctaatagcacttttcatgccctacacaaaggtgccggttgggaatagaaaggtgccggttttaggtctagaaccggcacctttgttccaatagtgcttttcataccccacacaaaggtgccggttttttgtctataatcggcacctttcttccaatagggcttttcatgccctacataaaggtgccggtttgggaagacaaagatgccggttttgggtctagaaccggcacctttgttccgacagcagtacttatactccatcccttgctactcgagctgattgagcaagaagagagtggcgcctctccttcttgcccaatcagctcgaggaggggaggaggttttgctctattttttttggtatttggttaaagattgaagcctaaaggtaaatattcattatttctccctccgtttaactcttcgttgttgatttgaattgtcgtgtgcgtatgcatgtaaaatacgatatgggtgttatttttagggataattctttttatcttttttgtgtctattgttggatgaaatgctaaatttgtgttaatgttttcttccacctacgtcatggccgttactcaaattaatggttgtcaaactatgttaaggccacgaaaatatccattgatagcttgatttatctcaaatttatgttaggggtgcccatcgattcacacccgctcattgaattgaattgccatgtggtaatacatgtaaaatgcactagtcattaatttgtatggatccataagtcattcgtagatctattctcgggtgctatgctaaatttgaattaatggttttttcaatctatgccatcatcgttaatgtttcacattagccaaatattttttcgcattgtcgaaaaatagaattttttttatcttttcgttagccatgactatctagttaaggtgacgtgggtgtgtgcaaaaacctcaattttatcgtagggtaaaatggtcattcctcgttgtttttactctaatgtgcttgtaaattatgaaatcttcattgtttttttccttcacggtatgtaataaacaataataatcataggtacgcattggatataatggatctagaatggataactacagcggatcgtgactctgtggagtatttcaggggagtaacggctctcgttgccgcggccaccagcacaaactcagtcgatgcactagaatatatttggtgtccatgccataattgcaagaaagacagacaacttccagctcagcgggtccattcacatctccttacaaagggttttatggacaacttccttggcgaggaggagcaaggggagggaagtgccggcaactgtcacgggcatgatgcagatgtcggctacaaggaggaggaccaaacatgtgtcgatcacggtgaaccaaatctagatcagatgctgcgcgacggggagagatttgacactgatgataaggaatatcacaagttcacaaccatggtgaaggactccaaaactccaatttacaatggatgtaaggcggagcacagcaagctccaagtggtcctatcgctgcttcacctgaaggcgagcaacggatggtccgataagagcttcactgagttgctagagctcttgaaagaaattcttcctacggacaatgtcttgccagaatcgacgtaccaagccaaaaaagttatatgcccccttggtcttgacatacagaaaattcacgcttgtctaaatgattgcattttgtatcgtggtgaatttgcatatttggagcaatgcccggtatgcaaggcttcccgctataagtgtggagacggggatgatgagggtggaaataagaaaagagtgcaggtgaaggtcgtttggtattttccaatcatcccccgtttggaacgtatgtatgcaaacaaaaagcatgccaagctgatgcgttggcaccacgaagagcgtaaaaaagatggaatgatacgacacccagctgatgggtctcagtggagaaagatagataggaagtaccaaaaagagttttctcacgacatcggaaatgtgaggattgcactaagcactgatggcatgaacccgtttggtaacatgagcagtcgtcatagcacatggccagtagctgttattatctacaatctcccttcctagatctatttgaagggtaagtacatcatgatgccacttctgattcaagggcctacacaacctggcaacgatatcgatgtgtacttcaagccgctggtagaggatcttcatacactatggacggaaggcatgcggatgtgggatgcgtacaagcgagaacacttcatatgtcgggctattttgttagggaaaataacagactacccagcacttggaaacacgtcgggccaaacggtgaagggcatgaaagcatgtgtaaggtgcatggcccaaacaggaggcaagtggctgaatcactgtcggaagaccatgtacatgcgccatcggaggttcctcaggcaggatcacccataccaccgaaataaaaatgcttttgatgggacggtagaaatggatggatgtccaattttcagaaccggaagtgagatcttggcggaggtaaaggatctcagagttgtattcggtaaagggagcggaagcacatgtgcatccacatcgagcggtgagacccctctattcaaaaagaagtctgtctcttgggatttgccctattgggaagacctggatattcgtcatgcaattgatgtgatgcacgtggagaagaatgtgtgcgaaggcgtgctcggggtatcgttgaacacacctggcaagatgaaagatgtcacatcctgatttttgtttcaggatttataaattatttaataaattattattagaagttatattaaatgatctttaatttacaagtgaagttaaatgtgggaaataaaatttcctaaatataaagcatggatggatttaatttttattaaattctccatgattaagtcaactctctgaaaatattctcggatctttcggagctcaattcctaaatgatacaaagaacagttcagtaattatttgatcattaatgatctaattataattgttaagtgcttttcttgtttaaactccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaaggaagtatttttaaatggaattgcatttcataaataatttaaattgaaaaagggttttaaaagtctcttttggccttgggccgaaagtcggcccaaaacctttttcctttctctctctcccccggcccaagtcggcccagtccgagccgcggttttcctttttttttcccgctgacaggtgggccccacctgtcagggtcgtcgtcttcgttgcgccgccgccgcccgaaaccctagcgcgagccgccgccgtctcctttccaaattcgccgcgtctttccttctccggtgaaatcaatagaggggaaacaatctccaggatctcctccaccttttctcttttggaatcgtcggttaaaatcgtggggaaattcgtggattcgagttcgattcggatcggcctctttcctccgaaccccgacctttccttctcgtcgccggcagccgtgggccttcgccgccgcctcctagcccctttaaaaggacccccgatctcttctctacccgccggcaccctcgccttcacctctcgtcgtccgtagcgccctagctccgtgtgccctagcgccgccgtcgccgccgtcgctccagccgtgcgccgccgccgttccggtcgtagtcgtcactcgggaaggccaccatcgggatcgccaagtagtcgccgtccccgtccgccccttcgccgccgccgaagatcgccggagcaccgtcgccgccgtcgacccgatctccgccgccgcttcttcctcgtcgccggcgccgtccgttgcttttccgccgttgttttggtcaccggtgagttcgccgcgtcgccctctacccgttggtgccctccgttcgcgtcgccgcgctgtcattcgccggcgagcatgcgcgtccgagccgcccgagtcgccgccggtgctgacgtcatcgctgccgtcatcgctgacgtcatcgttgccgttccccgtgagccggtcgtggaccgttcgatctcggcagtccgttttggatagggttgatctcggccgtccgttcccttgaaccgccgccgtgcccctggtccaccgcaaaccctagccgctgacgcaataatcctccttttccttttcaaaaataattcattattgcgtcataattcaattaaaatccatataagtgttttaatccgatttaatctttaaaaattcataactaattcatcttagctcagtttaatgtggttcaagatgcaaaagttgtataaaataaagatctacatattaaaattatccataaattgaattaaatttatttaattctttttaaatgggctttaaatagatttaatcttgtaaaattcataataaatttatttgaagtcagaatgaggccgttcaagtctcataattcatctaacattatgatctacatgtttatttacgttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttgtttcaactgtgcatttatttttgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagtacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagtgtgggcaacggctttacctttcgtatagcatggttcattgcagagcaccagactgagaagtggtagagataagcccacgggggtcgctggggagtccatgcctctggtttttgagggggtgattatgatccaggaaaggtgcactgtggtgggttgtgttatgcgaggggtaatgtcacagctcctttccgaggtaccgtgggggtactgaggcacatggtgacatgttgtggggctgtgtcttgtgggtacagtggtacacctttggccagagtaaaactatttcgaatagccgtgccccgcggatatgggcgggttgagcaatgtttttcgtaattagtctcacacctctcacaataattttggatgttatacctggtaataatttgcttagctcctggattggagattagatctgtacagccgggtatggttgttcaggatggttgggcctgtgcagcatgggtgtgctgttcagtgttgattaaaatctctaattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaagaaggatccagaaggagaagacgtttggcttataccccagttgagctgcctgtgggagtggagccagagcttcgctagattttattttccgctgcagttttcttcatggtgaggactaagtgcctcttaagtaagtatatatcggtttagttattatgatggatttgtatattaaattgtcagtttgtgtacctcggctgattcctggatgaggattttatgcacaaataagttcggaaattactagtgaatttccgggcgtgacaaaagacactttgcaagtacggaaagatctcgaagacatgggcatcaggaaagagctgcatcctcatgacagaggaaatggccgctactacctacctccggcatgctacactcttagtgctgcagaaaaaacgagtatgttggaatgcctgcggggtgtcaaagtcccatccggttactgtgcgaacattaagagactagttagcatgaaagaaaaaaggttggttggaatgaagtcacatgactgccatgttcttatgacgcagctgctaccagtcgcaatcaggggtatccttctagaaaaggttcgagacccaatcatcaagttgtgccagttcttcaaagcgataaaccaaaaggttatcgatccggcttcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8457 - DNA, 747 bp, Oryza sativa
  unsure (1)..(747): unsure at all n locations
nnnnnnnnnnnnnnnnnnnnnnnnnnnnnnnnnnaagttggttagcggaattgtatatggcaagaattgtgtgtttgcatggcgttcctaagaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcatataacaacagttatcaagctagtcttccgatggctccttacgaagcactatatggtcggaagtgccgcactccgcttttgagggatcaaacgggagaacgtcaggttttcgggacggatatcctaagggaagcagaagaaaaggtaaaggtcattcaagaaagattgcgagtggttcagtctcgacataagagttatgccgacaatcgccgcagagatttgagttttgaagaaggagattatgtgtatcttcgtgtcacgcctcttcgaggagttcatcgttttcataccaaaggaaaattggcaccgcgttttgtgggaccttataagattgtcagtagaagaggagaggttgcttatcaattggaattacctcaatctttggcaggagtccataatgtgttccatgtttcccaattgaaaaagtgtttaggggtac

SEQ ID NO: 8458 - DNA, 757 bp, Oryza sativa
ctccgccacttctcagtctggtgccccgcaatgaaccatgctatacaaaagataaagccgttgcccacgctggcttgtggttggcacggttaatgtttcacaaccgaaactcgtgaacctgtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaatagtgagctaatgtttctaagcagggctaagctattatacctaatatctagttgaaccaatataaataaagctcacctagtcaaattataataacccaaggtatcaaggaataaagtaatcaagaacaaaagggctataacaaacaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaattttt

SEQ ID NO: 8459 - DNA, 6390 bp, Oryza sativa
tagctttaaacgggatcaacatgctcaaagggttgtttgggatctgtgtgacttaccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattacttttgaaaaggaaaaaagggatttattgcgtcagcgggctagggtttcggtggaccgggcgcacggcggcggttcacgcgaacggatggccgagatcgacttgatccaaaacggacggccgagatcgatcggtccacgaccggctcacgggagagggcgacgatgacgtcagcgatgacatcaccaccggcggcggtggctcggcggctcgggcttgcatgctcgctggcgaacgacggcacggcggcgcgaacggaaggcaccaatgggtagagcgcgacgcggcgaactcaccggtgaccaaaagagcagcggaagatcaacggacggcgacggcgacgaggaggaagcggcggcaaacttcgggttgacggcggcgacggtgctccggcggtcttcggcggcggcgaaggagcggacgagaacggcggcgacttggcgatcacgacggtggccttcccgagcgatgacgacgaccgagacggcggcggcgcacggctgaagcgacggcggcgacggcggcgctatgttgcacggcgctagaactctttcggcgacgagaggcgaaggcgagagaggcggcgggtagaggagacaccggggaaccttttaaaggggctcgcaggcgacggcgaaggcccccggtggctggcgacgagaaggaaggtttagggttcggaggaaagagacgaatccgattcgagctcgaatcaaacgatttccaaaaagaattagccgatgattccaaaacagtaaaggtagatgagatcccggagattgtttcccctctatcaattcggccggataaggaaaggatcgaccgaatttggaaaggaacggcggcggcgcgaaactagggtttcgggcggcggcggccggaggtagacgacgaccctgacaggtgggccccacctgtcagcgggcggacgcgcgcgcgcgcggcggcggactgggccgacttgggccgaggagagagagagcggttttgggccgactttcggcccaaagccaaaagaagacttttaaaacctttttcaatttaaattatttcttaaatgcaattccatttattgaaaatacttccttagctcaaataaatcccagaaaaatctaggaattatagaattaagcaaagtatttaatgaaattttatctggcccctttttatattggaatttattaattaaaattagatcttctcttctagacttttaaaataaattctaaaaattccatttaaacaataatttatatattttgaattttcagggtgtgacaaacctaccccccttaaacagaatctcatcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtttctcaacataggtcagatcctcttggacttctatctgttcaagattagcttcttcggtaggtacccttaaacactttttcaattgcgaaacatggaacacattatggactcctgccaaagattgaggtaattccaattgataagcaacctctcctcttctactgacgatcttataaggtcccacaaaacgcggtgccaattttcctttggtatgaaaacgatgaactcctcgaaaaggcgtgacatgaagatacacataatctccttcttcaaaactcaaatctctgcggcgattgtcggcataactcttatgacgagactagaccacacgcaatctttcttggatgattttcaccttttcttctgcttctcttaggatatccgtcccgaaaacttgacgttctcccgtttgatcccacaaaagcggagtgcggcacttctgaccatatagtgcttcgtaaggagccatctgtagactagcttgataactgttgttgtacgaaaattccgcatagggtagattcttatcccaacttccaccgaagtctaaagcacaagctctcaacatgtcttccaaaatctgattcaccctttcggtttgtccgtctgtctacggatgataagcagtactaaagttcagcttagaacccatctcttcctgaagtttcttccaaaaatttgaagtaaactgactgcctcgatcagacactatcttcttaggaacgccatgcaaacacacaattcttgccatatacaattccgctaaccaacttccggaataggttgtctttaccggaatgaaatgagctactttggtaagtctgtcgactatcacccaaatagagtcatggcctgatgacgttctgggtaaaccagtgataaaatccataccgatttcttcccacttccattcaggaatcttcaaaggctgcagcaaaccggcaggtttctgatgttctcccttgactcgctgacaaacatcacatactgctacgtattctgcgatttcacgcctcatacttgcccaccaaaatctttccttgagatcctggtacatcttagtactactagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatctcttgaatatcaggatcattaatttgggcttctctaacttgatcaattagagtgggcttcgcttctaaggctgcaacgaaacctatactgacaattcccaaatttaatctttcaaattccttgcataattccaatggcaactgtcgtccttccgtagcattgcaatagcctttcctgctaagagcgtatgctacaacattagcctttcccgagtgataatgaattcccatgtcatagtccttaattaattccaaccatctcctttgtctcatgttcagatccggctgagtaaagatatactttaaactcttgtgatcggtatatacctctgtacgagtaccgaaaagatgatgacgccaaattttcaacgcatgaactactgcagctaactcaagatcatgagtagggtagttcttctcatgcggacgtaactgacgagatgcataggcaaccaccttcccgtcttgcatcagaacacaacctaacccaagtttggatgcatcgcaatacacctggaaacccttctttggatcaggcaaaatcaaaataggagctgatattaagcgactttttaactcttgaaaactctgctcacattcttctgaccacttgtacttcacatctttctgaagcagtcgtgtcatgggcttagcaatcttggaaaaattctctataaacctccggtaatatcctgcgaggcctaggaaactgtgaatctctgaaactgtctttggttgtttccagttggttacggattccacattactaggatcgacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtgtaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtagcacctttaagctgatcaaacaaatcatcaattctaggtagtggatacttattcttgatagtcacatcatttagtgcacgatagtctacacacatcctctgggtatgatctttcttttccacaaaaataaccggagctccccatggagatgaacttggtctgatgtatccttactgaagcaaatcatctacttgcctcttgacttctgccaactcattggctgccattctataaggtctcttatggatcggagttgttcctggtaccaaatctattctgaactctatatcccttttaggcggcataccaggcaaatcatctgggaacacatcgggatactcccggactataggaatctcttccaaagttatctggttcagtcttgaccttaaagattcagaagacaatgcatgaacagttaccactcgaccatcattgctggtgagagttacttttctgttagcacagtctatcacacctttatgtctggctaaccagtccatccctaggatgacatctaggtctttggattctaacaggataagattggccagaaatggtactcctttaatttctattctgacagaggggctacgttgcaaagagagtgcttgattacttggggtactaaccatcaaaggacgtctaagatcttctactttcatcccatgatttcccgcaaaactcatagataagaatgaatgtgtagcaccagaatcgaaaagcactgttgcaggaactaagttaacaaggaacgtacccaaaatcacatctggagcatcttgagcttctgccgcagcgacatgattgacacgagcctttgatgctggtgcggtagagttgctctggacagggacaaccttcatgcgtcggggcttcggacacttgtcagcgtaatgtcctgggtctccacagttgaaacacaccacgggcttgctgccatgctccctcttggcaggctgttgctgtgttggagctgcaacagggcgtagagcttgattgcggatgttgttgccagcattgttgttgaagaactgacgctgcggacgaacaacagacgaagaacctccatgtggcatggactggggtcctaaagtaagacgcggcctctgattattcccctgttgtgtcttgaattgagcaatccggcgtttcttctgctccatgcggttgtatttgtcctcttgacgaatagccttatccaccaacttctggaaatcagaataatccccagtcatgagtgggtaagaaagctcatcattaagtccttctaagaacttctcctggcgctcttcatcattgcgcacatcctccggagcataacgagccagacgattgaactcgtgcaaatactccgtaacagagcgagatccctgggtgagcgacctgaattccttcttcttgagggacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgaggccttctcctgatcagtgcactgaagcaaatccaacttcttctctatggcatgcaaccaatcaccagcttcaacaggattagtggtactagagaaaataggcggcctcacacgaagaaattctgctaacttgttatggggaggtgcatggttatttccttggttctgctggttctgaagttgctgcatcatcatgttcattaactgagtctgttgagcaagaacttgagcaagagtgggattcccttcattgttattgttactggggccattcccattgctgcgagtgttcaccatctggcatggacagggcacaagaagagacaccgggggaaactacttaggacagagaattactttaacttttattgatcttaactgagtttcattattacaaactgaagactctcacaccactaaactcaccaacttcctaacactcaaaagcaaacaaacacatgcacttacatcccaccactgatgtaaatcacatgcgagacacacacaaccaaacttaaaacaagcaagctaacacaacgatctaagacaacgacttaacaagtcactctagttcttccgagcatcggaggtcgattgaaggctcattcgggtcgtcttcatcatcttgagttgctacccactca

SEQ ID NO: 8460 - DNA, 3807 bp, Oryza sativa
tatgttgcacggcgctagaactcttccggcgactagaggcaaaagcgagaaaggcgccgggtagaggagacaccggggaaccttttaaaggggctcggaggcgaccgcgaaggcccccggtggctggcgacgagaaggaaggtttagggttcggaggaaagagacgaatccgattcgaactcgaatcaaacgatttccaaaaagaattagccgatgattccaaaagagaaaaggtagatgagatcccggagattgtttcccctctatcaattcggccggataaggaaaggatcgaccgaatttggaaaggaacggcggcggcgcgaaactagggtttcgggcggcggcagccggaggtagacgacgaccctgacaggtgggccccacctgtcagcgggcggacgcgcgcgcgcgcggcggcggactgggccgacttgggccgaggagagagagagcggttttgggccgactttcggcccaaagccaaaagaagacttttaaaacctttttcaatttaaattattttttaaatgcaattccatttattaaaaaggttttaaaagtcttcttttggcttttgcaattccatttattaaaaatacttccttagctcaaataaatcccagaaaaatctaggaattatagaattaagcaaagtatttaatgaaattttatctggcccctttttatattgaaatttattaattataattagatcttctcttctaggcttttaaaataaattctaaaaattccatttaaacaacaatttatatattttgaattttcagggtgtgacacaaccctaagaggagaagggggcgaaacacagactagactgtaacgacgctgggagatcacctcctgccgatcagtcttctgatgatttcgccaaaagcgagccatatcctccaaacattttgtatgaacaagatcgtagtcttctaaggttcgcccggggtccgcctgtagccagccggcaaccttaaaaaccttatagctgtggccgtttatcaccatttcgcgataaacaggccgaaacgggcatcgcacctttggcagaattttaacgccaaaaatttctcgtttttgcttcgccaatccctagaggggggccgaaggcacaatattcggcaaacaccctgttaaatagtgcagaaagggcaaaagatgaattgtatagtaagaatgggcaaaacaagatcaaatattacataatacgaaaatgacgtaatcatatacgccaaaggcatcgaccataaaaagtggcaaagatagagtcatacattccaaatatccaaaggtcctttttcggctacaataaggagagtaaggggccgaatatacattgttcgcctttcccggcaaacgcaaaaagaagaaaattttcaaaaatctaaggaaaggacggagggcctcacacctctgggtgatcctaggcatcgcctccaacccctccggccgctgcatcctcttcttcgcaccggtctgccgcctctgcctctgccagttgctccaaaaggcgtgtcttggcggtggatccgccgtccttctgccagaactgttttcgccacgcacgaagcgcgggcgaaacgtcctgcgcactaacctcccagtcccttttcgcatagttagggaactcggcgacgtgctcacagccgaactgctgcagaaggcccatagtgaaggctgccgatacatgcgcacagcaatcaccgtacgcagtggcgcagtccgaaacggcaccactagcctgctggtctactccgagaagtcgaaggctgaggcgtcttcggcagggactcctcgcacctttacacccatgtccgaaagggcaaggcggagcgtttggcatactgttcttgcgaatcggggctttcccatctcccgcgaaactgttgcgactccttcgcagcgctcgcctcggccttgctgacctccaggcgaagagcctccatcttcggctcagtaaggttgtaataatcggtcagcgcagcagaatgggctttttctttcttcaattcggccttgaggcgatcaacctcagctcgggcctctttccccttctccaattcggccttgaggcaatcgacctcggccctagcctcttttcccttctccaattcggtttggagccgcttgttctcggccttcgcctccttgagggtgttggcgagggcctccatctccaagctcttgcggcctatttcgtcatctttggcctgaagacggttcctaaatccgtcaagacgagcccgcacggttcgctctgtcgaacaataggccgcaagaatctgaatgcaagataagagcggacgaagagaacaaatgttaattatgggacctgtaaaaaagaaggggaggaaaataaaaaagagagcgaaaaagcatacccgaaccaacaagcttttaatagtggaacacccttcatcgaactcattcaactcggtgaataggctcagggtgctggcaggtaagacaagattgcttactccctcgacgaagggaataagatccgcacgggtctcgaaatcgccaggggcgaagtggggcgccgcgagagagtactccgaggcagatgtttcgatggccgccaccttacccttgccttgacaagcggcgaaacaaccggctgacgtagagggcttccgaaaaccctcgccgcagccgtcacgatccgatcggcggacgctgaggccccggcggcggcagtaccacccgctccaccagcattgagcggaataatgggggcggtcgaaaggtctaagttgcggccagcgagcgaagtcggggcttcgtcagaagactcgtcgtcgctgaaaatgcgagcaacatcgaccatcgacgagtcctttcttttttgagatctttttaaccggacctccattcgccgccttacctgctgaaaacgcaaccaacaccttcgcccgctccaaatcctttcgatgaaggggggagctgttcgattccaccccagtctcgttgtgccctagacttggagtaggagtgtagccagggtctcgacgcggttttcgaccgcctcgtccctgcccttttcggccgcgacctccgccgtcatgctcttcgacgtcgtccttgtcgtcagtgtcagaatcagaggaagcagggacccttcgcttcctaggggccagcttcacttgtccgtgcgtccgctttcgcgaaggccctacatcgtcgtcggccttgtgggggtccgcccggggaagcaattcgccgttgtaaacccggttcgcctgggcggcagcctgtcatgtaagaagctggctatactcgacaaccaacacgttgccaatcatcttacgagcttcggcgtcagcctagtcgagagtcaacactgcgaaaataaagggtgtagccatattaagcatcgaacaatgaaaaataacgaagcgcaggagtgcatagtgaaagtgcagtcttaccgttcgtcccctaaggaagaaccaacttcggcaaaccattgacctcttcgccttggtcaaatgcgacttgacatgactgggagaggggaaagatgcgaagcatgcagaactcctccaccaagtcgcgacaactaagtcgggagcaaaccttacgcagcagggcgaaccgcgcctccatagcgccgtccacggcaatcttgggtttccggttcggtgcaattgacctacgctagcaccggagggccttcgccgactcggaactagccttaaaggggatggtgtggtaaaaccacctcgccatccaatggcggtcccactttgacatggcggcattcaccggccagagatcggagcgctcggggcg

SEQ ID NO: 8461 - DNA, 1752 bp, Oryza sativa
aaataaaaaataatataccaccatccgcaggaggtgaaaagcggcaaaccaataccaaccacatagacaccaaactttatttgcaggaacaatataggtttcggcaggagcatcggtcgaaagggagtgccacataccataccacattgtttgcacggtctcggccgaagctcctatctcacccttgcccgtgaggggcttgttggaggtatggcatgaggcccttcgaacaaacctaccgaaaccatacgactagtgaggattcaagcccgagacgtcaaggttagtcaaggcgaagcccccccatggcgaagactatggaacaaggacggcgagaggcggggaatcgcgcgggtacctcgccaagccagaggcctcttgggcaaaggatgtagggcgaagagtatatgccgaagggagacgacttcgctgtagcaagttcagccccgcgaggatcgaagaagccatcctggcccatcaagcctaggggctattgggccgacgatcgcctgacggcccattaggagcccatgaacctcaattacactgtatacccatgtaaatgtccctttcataagggcaaccatataaattcccctggataaccaaagccctagtagtaagaacctgtaatgaggctataaatagtctcatagagccatgtaatacggggggatcataagaaaaattctcaatttaatacactttacttcttttccaactactgttgagtaaccacgtctttcaacgtatgcagttgtcgtttcgataacatacgcaatttcgcagaaggtcatcgatccggatagattagaagcccttcagaatgatgtggtgcaatgtcttgtcagttttgagttgatatttccacctttatttttcaatatataatgacgtatctgctttgtcaccttgtcaaagagatcggtattctcgggcctgtgtatctacacaacatgtttcctttcgagaggtacatgggtgttctgaagaagtatgttcgtaaccgtgctcatccagaggcaagcatcgccaaggggtatggaacagaggagatcattgaattctgcgtacaatttattgaagaccttcgcccaatcgggatacctgaatcacgccatgaagggagactacggggaaaggggactctcggaaggaaagccactacaagaaaaatactttgtagagacatttttctagtactatagagacacttttcaaatgcctttacaatacaatagaggcattttaaaaaatgtctaataagtaccttatggtgaattgtctctacaaacgaagaggcattttatataatgtctataaggtggtagaggcattttctagagacattaaattgtaccacaaccatatgaaaccaatgtaaaaatgagaataaaatattttcccttgtttctgtcaatccttgaattcatgatcttttgaacaaatcattcttatgttcaaggcactaaccaactcaatcccatgtcattcattatatatgtttatgccttaagttacttatatttagccatttagtatacttttattgtaagaagtgtctctacagagtttaaagtgtctcaagcaaatgtctttacatgttagacacattttaaagtgccgaaagaatgcctctacaagataaaatctaataaaatgtgctgaaaatatttctaaagtgtctctagagtaaaaattttctatacaattttgaaagtgtctctacgctataaaactcctgatcttaga

SEQ ID NO: 8462 - DNA, 1890 bp, Oryza sativa
ttttgaaagtgtctctacgctataaaactcctgatcttagaggcaatttgccgaattctctacaaaagtgtctttatataatgtttttgttgtagtggcaataatgacgatagacaataatttattccgtaaagcccatttcacggttctgcaacaatcttcattggtggctccttacatcgaggagcacttggctctaattcgcgccagaaacatcggtaagttcgatgcatggattacacggcatcacattgatactttccccacgtggctatgacaacatctcatgggtaacgagacgattaaccaagaactggccttcctggcgaggggaccatctggctcgatcgcgacattccagggatatgagatcaataggtacacattgtacacgagagcccaagacatgaagagcacgaaccaaaatagcgttgttcgtatcgatgccatgggacacgatggaacaactggcacgtattacggtgtcatcgaggatatatgggaacttgactatggtcctctcaaggtccctctgttccggtgccaatgggttaggttgactggtggaggcgtaacgattgatgacagtgggatgacaacggttgaccttaacatggttggatactcggacgaaccttttgtccttgccaatgatgtaacgcaagtcttttacgtgaaggacatgtctagcaaaggaaagaagggcaaagggcctgacgagccgaagcgccacgtggttctcccaggcaaaagaaaaatagtcggagtagaggacaagactgacgagaattacgatcagttggatgggcaaccccctttcacggtgacgattgaccctagcatcctcctatcaaatgaagacaccccttactcacgtagagataacaaggaaggaacaatagtgaggagaaagtatgtgcggtcaaccgtcaccgctgatgtattgccgtaattattgtgtacacaatgtaaactattttggatgtattgaatatccatataaatcaattgttgtatggcatatgataattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtacttcaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactccc

SEQ ID NO: 8463 - DNA, 5039 bp, Oryza sativa
atatatatatatatatatatgtatatatatatacatgtatatatatatatatatacatgtatatatatatatatatatatatatatatatatatgttacttcgcatttatcctaatacattttttttatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttaacatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaaaacaagggcacgcggagatcatgagagctttgtcccagattctgagaaagagatgctgtggaccacaatgctcgagacattcaccctttctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcacgatgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctacagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctagaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggtttttgaacttatagacaggtaccgtcataagttcctttgttaattaagaaaatcttgttatgttaattgctactacgaatcatagctttaaactccatgtagggcttggtatcggttctgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtaaattctactacgacggaaacacaattcaccggtccttagcttctgagctagcagcgagtactactacgtcgaaaccgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatatatatatatatatataatatatatatatatatataaaccatgctgcaacaggggcatgcaaaaaaaaaaggtcagctctatttttagtccccgattggtactcccggtttggaaaccggactaaaggggggtgacgaactgggactacaaagggtttctccaccagtgtggacaggaggggaggggtatacgggctctcttttcaatttttttaatccttt

SEQ ID NO: 8464 - DNA, 10834 bp, Oryza sativa
attcctgccaggtaattgtcagcatggtctagtactctgtacccttgtcatatcaataattcaatcttgattcattctgggactgtttggttctcgaaaatgaaatttttcagtatcacatcagacgtttaatcgggtattgaaaatggtttttgaacacgaataaaaaaactaattttataactcgcctcgaaaccgcgagacgaatcttttgtgcctaattaatccgtcattagtacatgtgggttactgtagcacttgtggctaattatggactaattaggctcaaaagattcgtctcgcgatttctcccctaactgtgcaattagtttttaaatttacctatatttaatactccatgcatgtgtccaaatattcgatgtgatgtttttgggaaaaagattttgggaactgaatagggcctgatttgtaagtctgttcgaatttactctggataagaaacttactacttcctctatcctataatataaggcgtgcacacattttaatattcaactttaaaaacatttgatcaataattattataaaataaaataaattttatttgttaaaattaatattattggattgatatttaaatttactttaagatggttataaatttgttacaacaaaccttattgtatatgagaaattttaagtcaaagattagttttgaagactgtaccaagtttgactatatcttgtattatgggatgaagggagtaactattttaaggagctttctgattccgagagaatctaaagtggccaaaaaaaactcctccaatcagacattcggaaagcttgacaagcagctggacaccggggctgagacaagagcatgacgagagcatgataagagcaacaatggatttatggtcacaagagatgaagggagcagcgtctacagcggctgatgccttgtgctcctggttctatttgcccttaattttgcatccattagtgttcagcggcagcggcagcagcagcaagctacggcaactccacgggccatcacagacgcgtttgtattgttcaataaattaactgcaagacaacaaatgacttgacctgcttgttttgtttgtaccaaatggtcaatgatttagttaatccagcctgtctttgttttttttttgttctttccacaaacctgactcttccttcaatgcatgcctaacaaggttgatctcatcttgttcgctgccatttggtaattactagaattttggtaacacgacaactgctgaactcgcttcgtcttaaaatattactttctctgtcctaaaatataaatatttttacctacaaatatgggtatatgtatttctagttatgaatctggatatatatatatatatctagatttatattttttatataagatgggttaactatgaatctagatatagtcttaaattcaatatttaatattttgagacaaagagagtagatggtaaaagaaaaatcagaattaacctactagctaagactgcatttctagctatcaacgtgcaccacagtacatgtttaggttcatagctataattgaatttttcgtgggatggatgcagtactacttttttttcctctacctatgatgggtttaaccaaatcttaattaaatgattaactaatataaaaaattttgaatttgatatcagaaaaatgatattggtatatttgttgtgaaaaaaactttgatacaaaatatactattagtcatttttacacaaatatatatgggttaattttatccatgccattacaactttgctaatttagaaaaatgctattactattcgtgatatctgctgggtgtcactaaaattttgcaaaatgaaattgtggtttgacgggcatgtgtcaggctgaagttgactggcatgctgagtccgaacaatatctcctttgcccattattcggcattgcggattttatatcgaatagtgtcaaattgtgatcatgggcacattgaggtatgagtggctatttatgcgtgtatggatcccactcatccaaaattatgtggtggtcacaaattgcactggatgatataatgtttgggtgcccacagaaattgtgtcatcgctgtcacattttccgtcccttccgtcttctttcttctctccgtttcgtctccttcccgtcggccgaccgtgcctgctggtcctcaatgaactgccgccacgccttcagctccttccttcaccttccggcatgctcacaagccaatgccgccatcttcaactcctcgcgtgagctctaggaaggccggatcaacgcatgcgtgctccctagccggtgtcaccaccatcatcacaacctcctcattgcgcgagctctagggaggccggatccaagcctcctcctcgcgagagctccgaggaggccgcatccaggtgcgcgttgtctgcgagcagcgtcacctccatcttcaccacctcctcctcgtgcaagctctggggaggccggatccaagcgccggccaccatattcacctcctcctctttgcacaagctccaaggaggtcggatctaggctccgccgccatgtgctagatccaggtgctactctcatcttcacctcctactcctcaccgtggatggagaggtgatggtggtcgcagctggcgtcaattgctgctccacctccgtgttcttcatgtgcgtcggctgttgccctcatcacttgatgctccgccgtcctcaccgcgtcatccctctctgccattgacctcactccctccctgggctttggcgccggtagcctcacccgcttcgccggagcttgctagtcggcctctgacctctctcgctgactcgctccctagcctttggtgccaccagcctctctcgcttcgtgggagctcgctggttggcatccttgcagccaaccccttgatggggagaagaaggaataagatggaatggatggaaaatgtaacggcgatcgcatggtttcaattttggaaaatttcagtggcacccaaccgatatcacaaatagttctaaatcggcaaagttacaatggcatggatcaaattaacccaatacatatagttagaaggaatgaagtgcatgtgaagtgcacggatggtctctaaacttgtacagatgtgtcatatagggcttgttcagattgtagccaaaataaaccttaccaaattatggcattgccaaaattttggcaggatttcttatgtatttaccaatttggcaacaaactaaatgtagacattttttagcaactttaccaaaaaaataatatggttgataatgacatcaatctaagcagccccgtagtttcctaaacttctaaaatttatttttaggttcttgaacttatcttgggtatcatacggcatcatacagattcaaacgggctgtatgtaactcacagtgtccgctgatgttgtatgccaacctatatgtcagtcacacagaaaaaaattaaattaaaaacatattttctcctcttaggtttctcctctctatcttaaatttttttaaattttatcttttctcttctccacctaagaggagaaaagatgttattaattcatttttttccatgtgactgatacatcggtttcattgacacttatgtgcaagtatgacatgccgtgtaagcgcatggagcgggttggagactgattgaacctgtatagttttcaatgttagtttagagacccaaaaatacgttttgagatagatctagatgattcatccttataagtttttagagaccgcttgtatacttcacgcttagaaaaggtagcgatgagacatacatattggtggacatggagaacttcctccgtccgaaaataagtgacttagatacccttgtcaaatgaggttatttttacgattaagatggtggttgagagaagataagaaggaatttgaataagaggtgagtaatgacataagtagtactttaaacttgttacttattttcagataatttttaaatcaaagtggtcacttgttttggaacggaggaagtggtatcaagttttttaaaacctacgttccaaaaatgaagtgtttttttatggatggagcactaagttttgttaatgcctaggaattttggtaacaccaaatagtattttgttttattaattcggtataatcgtggtgaaagtgggtcataaaaactgaggtcaatactcagtactaagagcaagtttaatagtatagccaactactagctccaaatcatctatagccaatgtaatagccaattcatacaatagttgcttactatactattaatacttggtcccacctgtcatacacacattatgtcttagagtccgtgctgcagctggctacagatctgtagcccgctactcttctttatcttcctttatctttttaaaattgtttatagctggcttatatcctgctattttacctgttctaacacgtcgagccaaagaaaaacaaatcaattcaggtgcacattgttgctgcattaactattacgagctgctaccagtgcaaggccagtgacgcattcgcattaactattactctctgtcggcagctctcgtgctcatccagccatccagggaatacatatatcggaccaaaaccctcgcatatgcctccaagtcttttcctagctagccagcaacatcttcagatcgatccccccaccaagcctgcatttcattgcgggtgcacgcagagatcgaggagagacgatcaccaccatggccggagagatcattccagacggcggcggcggcggcgcggtgttggcggcggagagcgtgatgctgccggcgagcatggtgctggtgcagctcttctccgtcgtgctggtgctgctgtccaagctcgccctcagcaccggcatgcggccgttcgccctcctcgcctaccggaacctcgtcggcgccgtcgccgtcgcgcctctcgccttcatctttgagaggttaattattcgtcgcttattcgtcatctgcaatggcgacttggccagcttgtattattccttgctttctgcattgaacatatatggtagttcttgttggattggaatcatctgcttccaaagctaccatacctatttgtcactgactggtggacatatatggttcatcggactcatatgtcagtaacatctgataaagatacatatctttgaaggtaggggagcctaatccgttcttgtttggttcacaacgctgttgtttctctgcgcatgtacacaagtataatttgaggtttagagcatacatccttgtatgacgttggaagtacatagaaaatattactccaaatgttgtccccaacgtcatgcactagccacggggtatatttttgtctgcatgcgtgcaccattactccggcccagcccggccatctcacaaagtcttcacttgtctttctttatttgtctcaaaaactacatcttgaagatcaccaattgctttgaagttcgagaaagtgcatacaaatatattagatttttcagtcagagacaaattgactagagtttttaaaactagctagaaggcatagtcttaaggagtagtagcattgtattggtaggtgtgaggtagatcaaagtaaatgttattttaggacgaagttaattagtactcctctcagtccacgagtatatatgtagtattattttatcatacattaatcatcaattaacactggtactaccaactaacatgaataatctcgtactagtacataggccctgtttgaatcgggagggctattaaatagtccttcagaatcttgctatttaagagtattaaacgtagattactaacaaaatccattctataatccttaggctattttgcgagacgaatctaacgaggtatattaatccatgatttgctatagtgatgctacagtaatcagccgctaattatagattaatatacatcattagattcgtctcgcaaaatagcttaggggttatggaatcggttttgtcggtaatctaagtttaataatcctaaatagcaatattccggaggactatttaatagtccggaggatccaaacaagaccatagaatctcgtaccaactttaagtaggggttgactgacctttactttattggtagtggaaatataaatggacctcagcggaagcacccttgcttgtcttcttttaagatctttattgccttcctgatttttgatctttttgtatgttccaggaaaaataggaaaatcccgagcattgtggagtggtgctggatttcgcttaatgctacatttgggttggtattttttttccagattaatcaaagggactctcacttatatgtttgccagtcaaatattactctctctccgtttctaaatatttgacgccgttgacttttttaaatatgtttgaccgttcgttttattaaaaaaataactaattattaattcttttcatatcatttgatttattattaaatatacttatatggatacatatagttttacatatttcacaaaaatttttgaataagacgaacggtcaaacatgtgctaaaaagttaacggtgttaaatatttagaaacggatggagtaatatactagcatacattgtgtaacttggaagtagctataatataaaggaaaatgtatgtagctttccaaaacgcatcgggggttgttggatgtaacccctcacccatgcacgcgctttgattttttttcctttcccgcttgtatgtatgtaattacactataataaaatatactccctccgtcccataatataagggattttgacattttgcttccactgtttgaccactcatcttatttaaaaaatttgtgtaaatataaaaaacgaaaagttatgcttaaagtactttggataataaagtaagtaaaaaaattaaatataaattccaaatttttttgaataagacgaatggttaaatagtgcaagtaaaatgtcaaaatcttttatatcagaggacggatggagtatttacattgacagatgcttataggaaaatttttaattaaatactctttttactttgtaaagaaaatccacaatttttagtcacaatatgctttacaagctcaatgaatccattatctaaaaaaatatgtttcactaaaaaaaaaggaaaaaacacaatgcatcctaatatactcatatcgcttcaatgtgtacataaaaactttgaccatgttgactgctagaattttttttttgcaagaatataatatctatctagtccaactgtgatttcacaaaagtacaagaatcctaatgtagggtaatcctatcaatggggctgtactactatggactgcgaagcacctccgccacatattcagtcatatttctgaacctgattcctattgtcacgtccatcattgcaatcatattcgggtattcgcacttctcattaataagtttttacacttagttacaaaacattacaactaacaacctctctctatgtttacaaatttcatcagggcagagaagttggtgtttacagactggcctggcaagataaagctcttcggtatcataacatgtgtgggaggaacaatggtagtgagcttgtacaaagggaaactgctgcatcacccttggccttcccacctgttgaaattccacacgcagaaagcatcaggctatgcctatcatcacaatttgttagccggtacattgttcttgtgtggcagctgccttagctacgccttttggttcatcatacaggtaccaaatcaagtctttcaagttgaaacctgccaatttcaggtttatgcttgtagttacttctcagggagttgtagtgcaatgtatggttcatgcgaatcgactttctgaagcgttgctactttcagattgtaatttttttctgcaaatgcaactacaggttaggcttgcgagcgtcttcccgtacaggtattgggcaactacgctgacatgtctttctggaagcctgcaagcctttgtgattggcattctgatcagccctacaaaatctgcctggaccctcaaatgggacatgcagcttctgacagtggtttattcagtaagaacattaccatccaaacaataactatgatgttttgtgtagtctaggtactacttcatcctacctgtttggtttgaaatatgaaattatatgttgatgtgctgattctaccagggggtgttcaacactggtatctcatttgtcctgatgtcattggcggtcaagcatcgtggaccgatctacccatccatgttcaactcgttatcgctgatcgtgatggtgatcatggactcagtgttacttggtacaagtatcttcttaggaaggtgagttcctgttcttgagcagggatataaatttcactttctttggaactacatacttagttctgtagcaaatacgacaaaatgggaatgttctctgaatatattatgggactgtttactgtcatgatctgcagcattctggggacagcattcatcattgtggggctgaatgcgtttctatgggggaaaggcaaggagctgaagcaagctgtggcgcagcacaccagccacaagcagaacacagaccacaacgagcaggttggagatgagatagcatagcatatcagcactatgattgaatgaaagatgatgcttggcaaatttgcgatgatgacgataaaaatgtctagatagataagggattagcatggtagtttgtaactagtttccggtgcaaacaaaaatatggtacaaatgaagttatgaaaagtttgccaccaactcctcgtccttcttttaattgacacattacaactggataacaattttcgtttatatatctatggctgattacccaaaacaggctgtctctaagggcgtacggccggagcgcccacacaggacccccaattttcacgggtcccctaagccccaaactttaacactagatatacagcccaacaagaaaattgtagcccaactaattctaaaaattgtcattttttccacattgttttggcttcgatcgcgcgttcgcgctacttcggcctccgggctgcggcctcaccaatcgccaatcataacaaacgagaggagtaaatgaattgtatgtgtagttgatttttctccaaagttttattcccaaagagaagtgggccctgttcaaaatcttgaagtttctgaagcgacatgattgttttcccaatgcaactattgcatatagagttttgttgatcattcccctaacttttgcatcggtggaatggagtttttctaaattgaagctattgaagtcaatacttgtgatctacaatgccaccagaaagacttattggattagctataattgcacttgtgggtggtatgttggggaagaatcaatatgaagctatcatcgaagattttatatcaaaatatactaaaaaaatgtcgcttttctaaggaatattatgcacaggtatatcgttttagaacatttcacattgctatgaaatattacggagtataattttttatcatattgtaccatgagttaagtttttattctttgttacgactttgcacagggcccccaaattttaagtggcggccctgcaaaacactgtaggggtagcaccaaaacaaggtaggggaggcagccacaatgttaaagctttactaatataagattaaaacaattacaaaagataaacttaagaacaaaagactgctctctcagaaggatttaacatatgcaaaagtaaaagatcaccctttaagagtgatctccaagactatatagagtgaacaatattctaaacatttgagccattacgctgtttccatatacgccaagctccatatatgatgtctacaaaacatgaagaactttatgagttgtgatactgctgcaacatgtttccaaaagacaaggaggtaacccatgttatctacaacagattccaacatgccagagccgccaaactaaattggcattggaaaaattgatgcaaaaaagtctctcttcctcatccagaacatagaacatcgagcgcgctcatgttatctcaccatcttcaggcatacattgttttctatccaacatgtccctttttgtctgtcaattaggagcaaacacccaaagaccctaactttcatgatgcacgtgtgctattccgtatccaatttaggtgacagggaggttgaatatacttgtaaaattgatagcatatattttctgtgaaaataatgaagcattaccccatatataagaccatttatcagtttatgatgagttatacagagttatatagagtttgtactgtgattcaacttttttttttcacaaattctcactggtggagaaatcatctttggtcggtcgacccaaatccacaatagtcccgactccattaaaaaccgggactaaaaacgatttttaatcccggtttataagcgtaacaggactagatgatctttattcgcggttgaggttaccatctttagtctcggttggtaacaccaaccgggactaaagatcaggactaaagataatctttagtcccggttgtttatatgtcagaccatgtcaggcggctaggatcttaacaccaaccgggactaaagatctaactttattcccggttggagttactaaccaggaataaaaatcaacacgtactatataatccctattacttatcctcttttctcgtccacacaacgaactctttctctatctctttttttcctctctaactccctatccttatcctttcttcttccttcttccttagttcttcttccttagcccgcttggatcggagcgagagaggccagccgcttggagcgagagcgggcggggatcctctagaa

SEQ ID NO: 8465 - DNA, 712 bp, Oryza sativa
  unsure (1)..(712): unsure at all n locations
nnnnnnnnnnnnnnnnnnnnnnnnnnnnnnnnnnnctgttgttgtttttttttaagaatttgtgatttattgcagtatcatgtgatgaatttgatttgtgtgtgatgtgaacttgtgatgtatttgtgatgaattttgtagaaacttgtgatgtaatttgatttgtgtgtattttttttaggatttgtgatgtaattttttagaactttaaaatttgtaatgtggacttgggatcttacttcgatttgggatatgcataccacccatattagggagaaaataaaaaaaaggatatgcataccacccagattagggagaaaataaaaaaggaaaaaaaacctggctatcctctttagtcgcggttggtaacaacaaccgggactaaagatactctatctttagtcccggttggtccatctttagtcccagttggtaccaaccgggactaaagatgggcatctttagtcccggattgctactcccggttggaaacccgggactaaagggattcccaaccgggagtaaaaagggtttctctaccagtgtctcaacaaaacttgataaagattgggtaagttttgacgtattttagagaaaaaaatattcacttacaaactcagaactgaagttcgatatactccttaaatataaatatgcttactagttataatccagattcctaaatgaaatatgcgcacatatcgtgattaga

SEQ ID NO: 8466 - DNA, 377 bp, Oryza sativa
agcagaaaccggtgcatgggaaggctcgtcgaggcgttggaggaactcggctaccgcgacggcgagaacctcttcggcgcgccgtacgacttccggcagtcgccggtggcgctggggcagccatgtagggcgttctcgcggtacaggcagcggctccgggctctcgtcgagcacgcgagcagggcgaatggggacagaccggtcgtcctcgtgtcgcacagcgaaggcggctacttcgcgctcgagttcctcaaccggagccccttgccgtggcggcggaggcacatcaagcacttcgtcatggcctccaccggcgccggcgggttcgtgaggttcatggaggtcgtcgcgtcctgcgtcagcgacgtgtccccgct

SEQ ID NO: 8467 - DNA, 1474 bp, Oryza sativa
ctgcctgtgagtggagccgtctgcgccgtttattttattttccgctgcttaaatttttaattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccttctaaaaatattggaaaagtagaactgttctcctccctttctcttttaattaaccaaactaatggcacatgcacttcataatcttttttaatggttctcattaaaaatttattccagtgttattagtactgtacatccattactgtactaatggctcattttaccagcaaaagttttacaatgttgttttatttaatcttgctgcaataaaataaatttagcatgttgattttataactttcttttatttcttttggaacctgttattcaaaagcacaaaacttgtgaccttatttccaactgtttcaacttatcttgcaagcttggtttactttatttacttacctttttactttgatttctaaactttattcaaattaatccaaaaacttgtgctattaattggataaatgtcttaactccctcctttcacttgtctttagatgccgcgctacaagcctgagtacttgtttggtgttgagggttttgtccaagagttgcgtacgatatcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgttatagtgatcagttggccgacactgagtatcgctaccatcctcgtcaaccccagggaagtgaccgtggcagttaccttgagactgaaggaattgagaatgatgctaccacaaggcatttggtcgagatgctgtgggctatggatgaaagtcgtgcggagactgtgttagcggctcaagatcgtgaagaccggaatcgtggtaagatttgcaagttagaagacaaggtggatcgtttggagaaggaattagccgcgttgaagggagaagcaccaccgcagaaggccaggattcgtcttaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaccattccaagttgagtgggtagcaactcaagatga

SEQ ID NO: 8468 - DNA, 1011 bp, Oryza sativa
cagctgtgtggtggccattgatcgacgtgaagatacagggtgccgccgataaggataggtgggtgctgatagtgatagcccatctaccacgtggctgcatgctgatcttattggtgtatgcacagtgcatgggtaccacagttgcaatcagtgttccttcctctcgaaaagaaaaacggttttgctattttgagccacctacacctacgtaatacttactccccctattttttttatatgactttgggacaagctagaaagacagccttgcattcgcgcgaacatgtgttatgtgttacagactttgtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagct

SEQ ID NO: 8469 - DNA, 494 bp, Oryza sativa
ccaaacgtaaataaagcgtaaaatacttacagaagaggcacttagtcctcacaacgaaagagaatgacagcagcggaaaaaggcgatcctagcggggcttcagctccactccacaagcaaaactcaactggggtctgagccttggtcttctaacttcgtcttcagctcagaagcactacacttctgaaaagggggaataatagcaaggctgagtacaaccaccgtacttagcaagccacaccaacgatgcagacgtgcaaggggaacacaagaacgatttgtggctatttgcataaaggcggttgtaaaacattttattgagtaaaacagtaaaactgttgagtaattaaagtaacattaaatcttcactgatcaacgctacaccacgttgaacagggccaaccaacccacctgaactacagtgcattgagtcaatttattaaagtgggactaatcacggtgaaatttgtcgactgcccataaccgcgggcacg

SEQ ID NO: 8470 - DNA, 800 bp, Oryza sativa
gaaaactggcaccaagatatgtgggaccattccagatcatcgccaggcgaggagaagttgcatatcagctacagttaccagagaatatcgcggatgtgcacccagtcttccatgtgtctaagctaaagaaatgtttacgagtgccggaagagcaagctccgctggaagagtcacattagcaaggatctcacatatccagaacacccgatccggatattggatgaagccggcaagaggactaacagcaaagtgtggcgtatgtacaaggtacaatggagcaatcccactgaggatgaagccacctgggaaaccgaagaattcttgaggacggagtacccgcatctattcgaaaactggtaagaaatctcgggacgagatttatttaaggggggtaggtttgtaacaccctgaaaatttgaccgacaaaatcaaaactataaaaatacggattttcaaaaactttttaaactaattgcatcatgctgatcttattcgtctattttatctggatttgatctcgaagattattaatcgtgagtaaagaatagttaattaggaataaaccttaaaaacaaattggtgaaataaatacaaattaaaataaagattaggtggggatagaaataaataaaatattatcgcaaccatatttggatcaattaaatttaaatacgatggaataagaattaaccctaattaaaactcaaataaattatataggaataaaatatgagtaatattaatctagggtgattcattagttaagataacacggagtattgagtaaaatgcatatatgc

SEQ ID NO: 8471 - DNA, 790 bp, Oryza sativa
  unsure (1)..(790): unsure at all n locations
nnnnnnnnnnnnnnnnnnnnnnnnnnnnnnnnnnnnnnnnnnnnnnnttgttgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgtcgcactttctgccggaccggccttgcgcccgaccgcatggcgagacggtgctcaatcacctccctggggaccccgggcatatccgccggtctccatgcgaagacgtcagcatttgcccgcaggaaggagacgagcgcgtcttcctatttgccgtccagaagaccaccgatccgtgtggtcttggacgggccgtcgcccagggcgacctccttgaccgggacctcatcgcatgtgatcatctgctgcctcggggtggcgggggcggaggcgccaagcctctcatcgccaccctcgggcttggacgcgacgacgagatggtctgcgcgctgctccatgcaagcaagcgcgactttgaggtcaccatggacagagatgggtaccgagctcggattc

SEQ ID NO: 8472 - DNA, 19815 bp, Oryza sativa
  unsure (1)..(19815): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaaatcaacagttagcttgagtctttcagttgcatgtaaaacggagtgagtgattagtacaaaattaattaattaagtattaactattataaacttaaaaatgtatttacttgatataaaaagtctcttgtaaaatacagatcatttagcagtaaaaaagtgtgcttgataaatgcaattggacgcaacctaaagtatttatagaactttttacgattaagataaatggttaaactttatgtatttgtactccaacgccaagtatttgtgcactgcatcagttagtgcacaacctagctagttcttcaaaacaattattcaagcacgcatatataatgcatggctaatgatccaagtatgtagattaaataagagacatgagaaggtagctactccgtgcacatctttggtggaaaaactagcctgactagggtaggggatcaaagagatgataattaatttactatataatgaggtactagatgacatggaaatggaataagataggcaggatatgttccccgtttataatgtccttcctcgatcggaactgctaacatccccgtttagtataaggggatgtttagttcatactacatctttggtcccgttcgattctgtaactgggcttggatgaaaatgaagattttcatgtcacacttttcaaattgttaaacggtatgtttcgtgcgaaaattttctatataaaagttgttctaaaacatcagattaattaatttttcaaacttgtaataattaaaacttaattaatcacacgttattaccacctcgttttatatgaaacacttcatcttcaggagattcaaacaccatagggatgttagccgcttcttaggcaagtttgaaaaaaaaaagttttgaagtcatcaactcgtaggattgtgcggttgaaaaattaatgtgcctagccatgatcacaaatcatcaaccaaactcttcctaagtaacgtgtctaaactttatttgacaaatttaaggcattcaattaaacactccctaagtattttttttcagccaaaagttaatagatattttcatcttaggacgtgtttggctagtgaaaaaggcaaaaataaacatttagctaacccataaaaaacatagcttgtctttttatatgcatattttagcatcaatccaaattaaactactctctccgttccaaatgtagcaatctaaaactaaattagattttttgcactaagaatctaaacacatgttcctcaatccattttcacgctagtatcctctagctatattttataacaaagtgagcgtttaacttacacacaccaccaaaattttggtacaatatcaaaccaagccgatccttagaccagcaatctaactatgatgaacgtttacttacactacatgaagcaccatctacgtaccacacatcacatataatagctttctcagtttctctgggtaaatatagttatggggtgtttaaattcaggggtgtaaagtcttggcgtgttacatcgggtattatataggggtgtggtaaggagtgttcgggcactaataaaaaaactaattacagaatccgtccgtaaattgctagacgaatttattaagcctaattaatctgtcattagtaaatgtttactatagcaccacattgtcaaatcatagagcaattagtcttaaaagattcgtctcacaaattaatcgcaatctatgcaattagttatttttgagcctatatttaatacttcatgtaggtgttcaaacgttcgatgttacatgatgtaaaattttggggtgggatttaaacatggcctaaatatagcttttacgacgcttacgacatggttacattttgcggtaatattctgctaagaccatgagagtgtgtctccgcaccttttttttttagggtaaatttgcttgatttgatatcatactttcacaaccatgagaagagcatagtaatccggtggtaagagagctaccagtactattgactgccagcgtttgagtccccccgtactgattttcacaccatttcttctctcttcgctgttacgtaatcgaatttttcggacaaaatccccaataaattataagcggatcataactacttctatatgcaaaaatcacttcccagatcagatgtcggtctgctataataggttattctcgcaagcataccggctggatagcaagtgggtcccacgaattttaccacacctctttttctcatcctcctcttcctctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactatacgggcatatctatcgattctatagttatatgcgaaaatcttttatgtagtagtgctataatcgattctactatcagtatcccatatatcatctttcaaattaaaatggagtatttcacaactgtagcacccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtatttggaaaacttttacaaatatgataattttgatagaatattaaaattttaatatattttttccacaactttggtaaattgtgggtattttgaagaaaaaagacagaatttgggccattttcggcatggtttttacacagctaacaaaatacatgtagcaatcatcacaaaatcacacaaaatcaagcaaatccaaatcatgaagccaagctaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctttgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgatagggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttctaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcggtggaccgagtccaccgtgcgccctcccctagtcccgctgacgtgtgcggcccacctatcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagtttttcctcattttgcgtgccagtgtgtagttcccgtcgtttcggaagtccgcggtcatgaggaaaagagctcggaagatcaaagtgaagaagcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaacattgggtaataaaacgaatagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttacgggatgccctggaagaacttatcgtacttaccataagccagcatgggcaactgctgggcttgtagtgtagctttactctagccgacgcatccaggcaagggtgggcgtgatggagtttggatgggccctgcgacggcctatgcggcttccggattttcctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacgaaaatgtgtcgtggggctgtgtcttgtgggtacagttgtacacctctgatcagagtaaaactattcgaatagtcgtgcccgcggttatgggcagtcgaccaaattcaccgtgattagtccctccttaataaatcgactcaatgcactgtagttcaggtgggttggttgggcctgttcaacgtggtgtagcgttgatcagtggagatttaatgttactttaattactcaacagttttactgttttactcaataaaatgttttacaaccgcctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacgaagttagaagaccaaggctcagaccccagttgagttttgcttgtggagtggagctgaagccccgctaggatcgcctttttccgctgctgtcattctctttcgttgtgaggactaagtgcctcttctgtaagtattttacgctttatttacgtttggaactgtttattacttgttgttttgtgtaccctggctggtcctagacagagatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaaatgtctcctctcgtccttcggcatttctttgcgaaacggtttttaaaattctcctcgatgtccctccaattcttttagttgtaaaacctggaggacaaaccgtcagcttcgtgtctgttcggaagtcaagtcaagcatcaagcttcgtgcagcaaagagcgagaaggtcagttcagagtcgtcgttccgcgaaggtcaagaagagttttcccggagttacctaaacccaatctttcccggaagagtagttccgttagcttttagatcgtgtgttgtttgcttgtgtgtaggggtatggattgcatcattggtggggatgcgaccatactaggttgtttgcttaagcaacttgaatcataaaaatccattaacaacagatcagtaggcaatcggtttaagaccttatctttagtaacccctctcatctccccctccctctcttgtgcccgtagcaattggtcagtatgagggatagttgcattgggtcaggatctcaacagtttcatggatcaactcggtgcaatcctatgggcattccacgtcaacttcatgaagatcagcttcaaccttaagtcatggctaatcagactcagacagtggaagagttgttacaacagatgcgacgtcggtaccagatctatcagatgcagcaaatgcaatggcaatgtcaggagccacgtcaatgtctccaatcgcaggtgcaagtccaaatgccagcccggaacccaaatcagagtcagagtcaggagttcccaatatcggcaccgaagacccctgtcaaaatgctgtccagatccccgaagataactgtagccgagtcatcgtcagaccaaaggaaagtaagtgctacctgttatgactgtggtgagcaaggtcactatgcaaggaactgtccatggaaggtgttcaccaggtcacctgaaaaatacgagaagcagtgctcaggaagtaaccaagctccaagccagtctaccgacaagaaggatggtactttgcagcccaactatggagcgaacaggacagtaatatggaagatggataatggtaggaccatgatcatcactggtttggaatttactcctgaagacgccgcaaggatacccaagcgtcagagaagaaaaaataccttccgtggagtacgtcagctaacccgacacctcataaagtacggcccgcccagacccgaagatgatgaatcaggagagcggttctctgctgacgatgatgataatgacgatgatgatgatgatgaggatgaggcgacacttaacagtttcatggaaagaggaatggagttcaaagcatgtactagatgtgggatagtcggacacactgctagtttatgcctccccacatgtcgctgtggtgaatatacccattactcagatcatgccctttgaggaaggttacatgattcttgtgtgaaggaacagatcatgtgcctaaggactatcagttgaacacggtcatagctaagaccaagaaagaccaagggacaaccgtgcaacccattcgtcgaccaatggcagacgacaacagcagtcacaatccttctgctcttcctccaactccagctccagcggaagccaaccatggaagaagcaacatcgccagggatgttcagaaatcactgcttgttccagtttcagctgccaaagtgcacaatcagaagcctgcaccccgggaccaagcaagtcgattatgtcgcaactgtcgtaaaccaggacattgtttcagcgattgtcctcttccaagagcagcaaaggcagttcatcgttgttcacaagttaccagcactgcccacgacaccaatcgacagctgaatgtgcaacctccgcctcaatggattatcgtcaagggcaccgtcaaaggccgcattgttccaccagcaacagcttcaagccttcagcaccagcgccagcagggtaagcaatgccaggaaaccaacagctcgctacagctacaaagaggcagtatgctccttcgtcagcacccgcagcaagtgttgccagcatcaggttgcccaactattgccaatcctagcaatgcacctcgtattgctccaatccggaggcccatcggcaaatcatcactcggtaatcccatgagctagaagatcctacctgctacagctgtcaagaggattgccattccctcctcgaagatcaatgcccagagcaatgtttccgatgcaacttctgttagtaggaactaaagaaacaagtcagttaggtttaaataatggaagcaatagcagttctagacaagacttctacttttcaagttcagtcgtgaaaagggcagttctaatcagtagcagtctaccagtgtttaattttgtaatacttctccttgtacatatatgtttatggcagccatgtaatgaaaaggaaatgttgaataaaatatgagttagccagttcctctccttttatggttcatcttgagcatgcagaagcaatttattatgtgtatctgtcggtgccacaagaaaccaagagtttctcttctaactcatcgcaattttgttgagctccaaaacctgtttgctagccaatagaggaatggttaaccaacggagtgaaaatggttagacactcaacacttgacatgatgagatctctttaaaggcagcatcagtggtactcaaatgaaaagagggatggaatatttgaaagtgacatcatataaagaatcttgggaactctctaaccttggaagctgttacaggatggtaatcggcaattacgccctagtggtgtgatcatgaattcagtataagttccaggaatcatctcaatgtttctcaaaagttgaaaaaagaaattgttccatacatgagtcaggaagatacaagagtttggtccagaaatagaaatgtgtagtcaacaaggtatatggcagagaatctattttcaacaaatcatctttaccgaagatatgaaagcgaagtggttatgatcaaagagcagaaactctcagcagcatcaaagtcagtttccgatagttgttcagattgcagtattttccggaaagttgttgcaggatctatagtccgtcaacccaggaagagtcagcaaaggatggtcgaagaagtgaaatgtcatgccatggaaaggacctcttgagttggatctgttaagtgatcagtgcttgtttcaaggaatgttaactatgcaatctgtttaggcatatgacaccaaaaatcaagtcagaagcaagatagttgtaccagcagttagaactggttggggaagtagtcaagagttagtaagatcaggagcgaaatgagaatttctttatgtggagtttcctatcagcaactgagggttaagttccaaatcttgctgggatgaaagtgcgtcgtcatttctctattttgatgaatcggtgaagttcaattttcaaagtgagggcctttgtaagtaagagaagtgttggttatttttcaaggacaatagtccaattgttcccagtcaggcgaaagtaagactactccctgtaaggggggtaggtctcggagatgagttttggctcagttcgtcgctgttttagtgaaggttcaacctagtgcagcaatccgagtagcacttgaagaagcctgttgcaaggtatcagaagagctaagccgatctcagggcatccgattgaattctaaggtacacccgtgaggccagatcaacaactccgcttagagaagcagcatcagggacagttgcagttcagacgaaagattgatcaagcagcttcttagaatacttactgttcatgtcaagagcagcccaagcgaattaagggtcaatgatttacgaatgccagagataagtcttaggaacaactccatccttctctagccagcttggtgaactgtcaggttatcaaattgctagtatcaacggttcagcccaagataagagagtttcacgagcatccgcagccctagtttgggtcagttcaagcagaaccaataagttcagttttgggaagcaatgggacaacagggttgaatccagccagattgctcgtataggtttgatcagttaatcgatcgtgttgggtaccagaactccagggatctaatccaatgaggccagtcagttcagttgtttgaagcaaaagaaacgaatggtcgatgccgatcagttcaattatgcaggtttggtccatcgagcaatcaaacaatcagtcaatccgaaacagaaaaaaacagtgcagtgtctagatcagtcagatcggtcaaaccgcccgcacaaccagttttctctctagccatcccagaatctcgggacgagattcctataagggggtagatttgtaacgccccgattttcgtttgggattaaaaatcatttaataatgcactttctagaaattaaataaaagttaaagctagttaatcaagtgaaattattgagggaattaaaaatttcctttaaaaatcaaggccgggaatattttgtaatattctttgtgccctaatgtactctccggaattttccgtgaattttcggagctcaagaagtaattttaatagcacaaagttcattgaatcaattaaataaaaagaaaacaaattaaaaactccccttcctccttgggccattttcggcccaagaatcctttctctcccccgcgggccgcgcgccccttcccctctcgggcctctctcttttcccctcggcccgctcgtccttgaagtgtaaataaccccctgctccctctctctctcaggccgacaagtgggaccgcgggacccacttgtgaggttcatccccaaccttcctccatcccgggcagcaaccgcccgaagccgccatgccacccgttgccgcccacgtcgccggtgattccggccctcccactcgctccctggcgcccaaaccgcataaaatcggttcccctccacctgctctaccaaatgccccacttttacccaatttttggcgccaaatcgagcccccacttcgaccacgatgtcgcccacgtcgccggccgttgccgcatcaaatgcgccacgtccggccacaatttcaccctcccgagcctatataaaccctgcccgtgctctcctcttccgtttccccctcttttcagagcccgg

SEQ ID NO: 8473 - DNA, 6502 bp, Oryza sativa
aaggctcctgtcacggactctttccggtatgtagaggtggcatgtcggcgcacggaaacgtgtcgtggggctgtgtcttgtgggtacagttgtacacctctgatcagagtaaaactattcgaatagtcgtgcccgcggttatgggcggtcgaccagattcaccgtgattagtccctccttaataaatcgactcaatgcactgtagttcaggtgggttggttgggcctgttcaacgtggtatagcgttgatcagtggagatttaatgttactttaattactcaacagttttactattttgctcaataaaatgttttacaaccacctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactggtgtcgacgaggccggattacatagtagtagaaccttgagtaccaagtccccctacctggcgcgccactgtcgacggg

SEQ ID NO: 8474 - DNA, 12238 bp, Oryza sativa
ataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatgggggttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgttctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctttgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagcatcaacatggtagcccaatgctgatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaatttgggaatgcataagatcaaatggacagttatgcggcatatggagtctgttcataactacagcctgcagtccttatgcaaatagtgggagcacaatttccagaaaatgaaaatgaatctacttaaagttttttttttggtaggacattatgagctataataaaattgaaccacagaccatcaattgcaaaatagtaaaaggaactcatcgcgtaccatgatcgcaagcaagctagatgaaatagatggttgcaggataactttttagctcgagccattggtccctaggagttgcagatttcaaaagaaaatcagatacacaagcactcaaaacactacagatcctgtgaaaatctagaaattgtttaccctacagatggcacactcatcgtcgtatgcacagatttcatcatatgtagcatctggaagtgctccgtcgagtgaactaagtgcctttcgtaacttggcataagtttttatccgcttccaaaatgaagctataagagcctgcaaacattttcaaagaattccagtcagtacatcatacatatttatttaaagtttatcgaagttaacaagtgaatgtcacactcacgcgcaagttcaataggagaacagcgtcaaccagatgaaacgccataccacggagccagaagatcattgagtaatgaccaagtgacatcaataagcttatcaagtcaatgacaaaaccaaaatttctgactagtctgcctctccactcagaaaaagatcctgcagttacaaagcatgattggaccctggtggtaaagttgagataattcaagagacgcatgtacaagaaatgagacatggactgctcaacctgaactaaattaatgttccaacagatcatagagcaaaatttacagtattacaaacagaccagaccaacataacaaatgtcagatgagtgaatgaaacctctgttatatactccggcctgtcaggaaaaaaaaaaggttctgttttttaccattggcatggccttggaaaaaaaagatcagcaatttatataaaaccgattattgagatcaatatacatgttttttctttgtgaccaatctaaatattcatagatatgttaccagtgaaagataaaatagtttactgtatgcgttctaggattttttttttcattcactgaatctggtgtttgcattcttgtctaggttagtaataaccggttaaccacgaaactcatacagcattatcctgcatgctcagccctagagggtttactaaactgaattaaatgagtctctgagcagcgaagacacgcttatcacctgctgcttgcttataagttttttggaaatcaagatagtccacaccactgtccatttgatgtcgttgccatatgtcaaacaactgaaatccatgcaccatgattgactgctaggaaaatactatgtgagaaaaggttgaagatattcagaagtaataactgcatgcaggtaaatgctcataatatttttaacatctctagttggcatttataagcaccacctcctttgaacattaaatgcaatgcagatttctttgataatgcaagatcgttataaattaagaaaagataaggaggagaaacttcccacaatctgggttgaagtacctgcagtgtctcaaagccaatactaagtggctcaaaaaacataagccaaaatagttgagaattacacgacttgcagaacccaacacaaagctttatcctggagaagatagacatcaattaagtgtgagcttttaaaagtattacatgctacagttgtgtcaaggacaccatacaaaaggaaatgtggtagactcaagcatcgatac

SEQ ID NO: 8475 - DNA, 1693 bp, Oryza sativa
tcatttgttttcttttttaactaagcatttaagaaattattgatggtcagaattttaaaagtttgaccaaatcttgtcctaaatgacaaatattttttttagaacacgcaggagatctgcatatcatttcattaagaaaaaggagaaaaggtggacggtgttagagaaagactccgacacccgccaccaagggtacaatagaacaccacacacccaaaggaagtaaaacaaactagtgcattagcagcacagccctagtaaagagatcacgaagcctagcagctcctgctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgcccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtttagcccttccttctcattatcaggtaaaccccttactgttcttgaccaccaattggcaaacctagcagtatcttgggttggaaagctagagtagccaagccgttgcaggaccaaataaacgagatttggagtgagagatgtccctccaaactttttttaagaagaaattgtgagagtgttggggattgaacaagggatcttagggttgaaaccacacaccccttgccactgcactatcaagtgcatctctaaatgacaaataatttgaccggacagagtaagtttataacagaagttgcaagttgcaagaaattgtaagggacaataatttcatgttggaagtgagtaagtgacatcatgcatctctgacatctacaaaatcaaaataaatttaagtgtacccaacacctaagcaaagaaaaaattatgtgtaaataatatttctaaacaaaaaacagtaaaatgcagactaaccagggaatattaccatagtacatcagccgatagaaccagcaatagtgcagaatatacacgaaagtattttgatggagtcgctgatggtgaagcattgagctgttcaaggcgttctctagccaatgattgaaacatctggatgtacgagaaattttagttaatgtaagggtataatcttaactagttgaagacttgaagttctaaaacattaccttcagggaacaaagaaggcccaaccaacttgaccaaaggattatttgttgagaattaggaggcacaaccagtgggagaaaagttccctggaatacgagagagatcattggcatttcttcacatggcaggcaacaacaagaacataaataaataactgtgaattgatcatacatcctcccttagggcttgttcggtttggaaggggttgaaggggatt

SEQ ID NO: 8476 - DNA, 970 bp, Oryza sativa
tatctatgaaagatcagagtatccacgtattggacttgtgctaagattctcaaggagataggattagatctaaattagattgtacatgtattatggctgatagttattgaacaaagtgtaagactgcatattatctaatttaaaagaactcactatcaagctgctttaaattcactaaagcatatattgcaaacatcattttagagcaagtctcttgtgttgaagactacgagcttatcagcagaaagtcaggagaaaaggggagcgcatgcgcacacagagagagagatggatagagcgcttaccttgtaaagcacatagttaatgatgtgttccaacacctttctagtctcagaagaggttaattgaacaaaaaatagtgtctgcataaaagaaaaaacaacattaacgccactattgctaatatgatatgcatacgttaaatataagctaagctgcaacatcctctttactaaaaatcattaaaagaaatctggatgctcaggtaaaatggtttccgctaaatcatggattggaacaatggaggaagaacaatgccctgccttgtgccttcaaaaaggtcacctggacacctggctttgtaatagtatgaaccatcctttctctcatatataagtcactaagaatctaaactaggatagcagactagaagtttagcttcctctatgaaatagtgtttttatataacatagttatcatgtttgcaatgcaaactgtatgcatacatggaggacgagcttttccaacagacaaaatgctttgattgaactacaaaattgggtcaaactctaatgctccttttaaagattcctatggaagtaaaaataattaagtacagccagtttacgacatgaatcaagaagtggatgtatcaatacaagttcttacatgaatattaaaccacatgcacaaaaatgagtctagaaggaaatcgcaacgaagggctgca

SEQ ID NO: 8477 - DNA, 6659 bp, Oryza sativa
  unsure (1)..(6659): unsure at all n locations
tctagcatcgaacaacaaaagtaccacatccaaatatccagttcagatttcagaaccgcttaacgtaacaaaaatcctctagcatcgagcagcaaaaataccacataacagaaatcctctagcatcgagcaacaaaaatactacgtacaaatatccagttcagacttcagaatcgcggtgttcaagcctgtattcaagcatgttgttgtatagttgctattggcattgcaacttccccatatgttccaactaccatagtttagataagcatctactcaactgaaatgcaactcctgagaacatgtggttcttcgcaatcagctaaagcacaatattcctactaaatcactccattatctcacacacttgatgattccaaaaacaacatggaaacaaaatgtcattagctgatttaatgaaggaaaacacgtccattctaactaaacaaattaagtttatttctacctaaacatcaaacatatcttcagcacgcaaattaaaccaacaaattgggcagcaaatttgaatcaacaaatttgggcagaaaaaacacctccatcttcccaactatcagcttgcatatattattattgcttatattattattactgacaagtggtcaaccgacaaaagtttttttttccccaaacagcacaatctaagcgaatgaccgcgtggccctgagcagcaacaatcccaacccccatcccattcccgatcgaccgattgctcaccttgagggagaggatgaggacgaggaacacgtgcgccgccagattcgccaggagcgcgacggtcacgtgcgagcccaacaccgtgccgagccagatcccttcttcttcttcttctcccccngccagcggngtagcatccccgtcgaggagggaccccgcccaccactgcagcgccgcggagcttgtcgcggtggatgccgcggcgacgtagaggctgttcccccccgccatgcgccgcgcatcgaagacaggtcccccacccctcctccacaaccctatggcctcctcgtcgtcctcgtcgtcgccgccgccgattcgccggcgatgcgggggaatcgcggggttgcttgcggctcggggaaggtgtcgacgacggctttatttcgggggccgcgacgccgtgagaaaaggggggattgaggggaggaagaggaaggtgggggggggagccagggggacaaaattattgacgacgggatggatagattggaattaattatgttaattaaagtctagatatttgacgggtttaatacgggagaattgtgcgtttcagtcctaagggttatctgtaatattgtttctttcctaaaatagattagtactctctctttgtcctaaatgtgaaagccatataccagattagatattttatagtaatatgaatatgaacaggaaacctctgatcatattcgtctgatgctagtttctatatattggaatgaatggagtaataaattttagctatcaatttagacaaagtgcatgtatagattcgtagctaaaagttactaaaagtgcattatacattttatagtactacgaatataaatatgaaacatgattagattcgtagtattttaaaatatcaaatctgatactatatttctatatattgggatgaagggagtaataacttttagctatgaatttggacaagtgcatgtctagattcgtactaaaagttattatattttgggatggagttagtatgatgttagtattatttcttttcggagggagaactatgttatggttggatgatgccttcaacttgccaaatcccaactttaggtggttgttttgcagttgtttagttgatgccattgttatgggtagctatatttttcatcggcctatttcaaagacacaattttttgcaacactttgcctaaagcttcaccttatgtaatatgaggtttggcaatgttaatcatcaatcgaacatatctttatctatctattgacatgtttggtattgctccagcctagagaaaactcaaagctgtagagtttggacttgagctatgtttgatttggattattaggcagattactgctactgattatatacttaattatatgaataaattgaatactttaagaaacaaacttaacaaatatgcgtcctttgagtgtattttccaaagcttagagtaaataatccatttcaataatctgaaacgaaccataaaattgtttaaatatgacaatacacgcatacttaaatgtatatatttcctatgaatatagaagttggatttctagcaactattgtatttctctaaatttccctgtcaaacttacaaaccttctccatttaactgttattaccatttactgtgcacatgtctcctccctacgattgttgggggctaaaatattttttttatctctctacattaatattgtaataatccttttccagttataatagcgaagaaatttattgcaaaaagatagcggtggtgacagtgaacccgccaacccatttatcctatcgtaaattttgcaaattactcattcaaagatttaatgttaaaaatagagaaatatcgtggacaatcacatatgaaatcaagtgaatgtttccctataaaagataaggtagtaacatatttcatgaattatatagttttacttgtatttgataatagtatgatatagttcttttatcatagtaaagcataaacatttagctagtatttcgaaaaaggatgtggtgcacacacaaaagaaaaagaaaagaaaaaatggttcatccacggaatattgcaatatgctgcgaaggtaggtgcgtttgtgcaaaacggggtacgggccgcgtgcgacgcctgcctgcgcacaccaccagcagcgagagcgagagagggggcgtggggcggttggcgcgccaaggcaggtgggtcccgtgcgtcggtgagtaccggaaaagcgagagctcggtaggtgacgcgtagagcagcaagccgcgccacgagcgagtgaccgcgcgacacgaccccgacccggcccggtcggtgcggcgcggcggaggtcgcccgggtcagccgctcgccgccacgcgagacgagacgatcagacgagggctaaaataaaaaaaaatcttctttttttttccctgggcttgctaattccacgctgcccctctttaggggtggaaacgagccgagctgagctcgcaacaaactaatttggtttggcttggcttggttagggaaacaagttaaaactttagctcggctcggctcatttcttggctcgagccagttcgagctggcttgcaagcctttctattgaaacgactcttcatatatattttataaatattaaaaaaagtaaaaacaaatcattaacatgtaaaatttaaataagtttatatattcaattcttcaaaatcttaatgataaattttaagttgacaaataataacgccatataaagtaaaataatcgatataaacacacgatgcctaaggctcgcgagccaaaacaagcggctcgcaagctagctcggctcggctcatttcagcaacgagctaaaaagatggcttgggcttggctcgtttgacttacgagccgagcctagccaaccaaactcaagccaagcccgagccaagctcacgagcacgagttttttttccacccctacccctcttatccgtttgtggacacagcgaggggcattattgactttgcagaaatggagggagaaaaaaaaaagatgcactgctaaaaaattaaaattatactactcgcttcgttttcaaatactccagtagtactgccactagactgccaacattgactaggagacattcgtttttttcttgaccactaattattcctcaatagtttgattagactatgaggatggaagtgtgcttattccttaaccctaacactatgtaaagagaggattaaattttggacgtggcacgcttttcaaactgctaaacggtgtgttttgtgtgaaaattttctatatgaaagttgctctaaaatatcagattaatctattttttaagtttgtaataattaaaactcaattaatcacatattattacaacattgttttgcgtgaaacacttaatcttcatcttcatcttcatcttcaggagatttaaacaccacataagagaatggaagttttattctttgttgaacatggtcttttagttcaaaaaattccaacttattttttcaaactatttcaatattcgatcactttattcccttaagtattttttaagcttagtttatcctgaatttaattaaaatggttcactttattggttaattgcatttctcttctttgtttatctttatatgagtcatactttaagcttaaattttatagagccatagatggcatcattatcaaatttataaaaatttaataactacttgcttgaaagttaaaaccttcatgttaaaattagtttcggtgtttccaacctatgtaaacagcgataacaaaaaaaatgttgagaggtaagttataatacatatattaatgctatcaaattttatttcaaaatatgatttatacaggcataaacgaaaagcccaaatattatcatggagtaaggtgaactattgttaagagttgggtataaaatgagacgaaaagttgtctaagggttaagtgctctggtgaaaaagtttggggagtaaaattgacattttgcttttaagttactcaaaaaatggcctttttttgctttttttataaaatataaaagtttgaggatgaatgatttctattgccagctatttaaaaatgggggagtaactattttgctatgacgcagtatactaaagtgttgattgtttgcgctactttgcagctgcaggctgcatcaacagtagcagctactcaaaaattaaccgcggcagcagcagcagcagcaaggctgtgctgccacagctagcataaatgaacaacccttaattattctattcggtaattacatatttaacactgaaataagatattgtcaaacatttgaaactttgacaatcaataactctaaaattagttaatttcaaaatgcaaaagtggtatgggcaatctgcttagaaatgtactaatgtacttcataatatcttaaacttattaggttaataaacttgttctaatataaacttatgaccaaagttacacaccaaagaccttaaataacaaatatcgtattttttttactatagaaagcactgtcagacctctagcagcaggtattatacaataaaacaattaccagactgcaataaaaattaatggtttgcctcacaaagtaaatgggcacccaattaatgcacaatacaacaagaatagtacactacaattaatcttgtatattataacaattgaccccatgtagtataattattgcttgatccaactatcacaacaacaaagcaaagtgttagtctgtctactagcagagaaaacacacccttaacttgcatctattttgtagcatttttgtcatgttcctgcagcagcaagtgggttttccatatatatttcatacattgagctaaacacaaaccaggtttatcggttccgttccaatatgtgccattatattccaccacctaaagctatgaagcgagcgagcggcatattgttccaatcaaaatatcgttaatttcagttattctgattaaattctggtcggtattgatcagaattaacataccacttgtttcagtatattttaaacatgagtgatctttccgttgaatttggcttggtcgattcataaggatacatgataaattttgtaaaatatgatagtaacatgatgaataactttgaatcactctatttatattttgtaaattgcaagttctattctggagtgatctttatttcagtccaaagtggctcttgccatgcactggactttgctcgtgcaatgttcatgtattcttaataacgcggattcacctaaaggcttttttatagcattaactgcactaaaagtcagtgggtcacaattacattcaaagaaaggattatgtctagctataaactcaatcatccatgttatattgctctcattgctatcatttttagtataattatgggcacaaatttgataaaatattgcataatattccctccatcccatcataatatgagggattaaattatttaaatttgtcccaaaatataagggagtctagagcactacctgtgcaccaattgaccctcattcaattttcttcccactaaacaaccttccaaccctaatattgcctaatctagtagggaaaacatatattacaaacttcatatgtagtgtaaatctggaaactgtcgtacgatgtacaagtgaacgtttgagatttgtctatatcatcataagcaattttttttactaccagaacaaaaaattacttatgattaaatctaggagaaaaatactcaaggtgatatggatgaatctcggatgtccattcgtgtatcctacagtagtttctaggtatgcattacacacttcctcaatctattgaggggtatttgatctttttttcattttccttaatctctcaaatgcatactaaaatcacttctagtatatgatggagttagtaacatatttatactctctccatttcaaaatgtttgacaccg

SEQ ID NO: 8478 - DNA, 2025 bp, Oryza sativa
gcagccccgaacggtcaaacacgtgctaaaaagtcaacggtgtcaaacattttgaaacggagggagtattatcttattaaaccctgaaacggtacatctgtatcggttggtatgagaacttcctttctaagagccaaattggaatggcctctcgaatgaaattgacaatcttgatgcatatagggtagaaaaaaagctcgcttgcccggcttgatggctcagtccaaaattgttgcgattcatctagtttttcttttgagatacaaatttcaatctgaaaccagaagacgaagcatactaaaaaccgattggtatcttcgaaaaatagataagaaaaccaaatttgttttcgtcgaaaaatatagaaaaaaaatgttagataattggaaaaaaattgtgaaaatgccatttcctataaatttagtaatctcccattgacatacacacaatatgtaatacatattcataaaagacaatacatatcactcaccagtcaccaaccattggccaaatagaatgcctgtcacctaaatattaaagtccattacgtacatagtttagagtccaatacatatattgaagtccatttcattactacatggaatttggcccatgaaagggcttccctttttctaaataattattcttttctttcctactggacaattcaagaaatgcatggaatgcaacatttttttgaaaaaaaaaatatcctagtaggctctatgaacatcaaactatttataggatttgatttgatttttttcgttttttatcattttaaatttaaatttgaatgaaacccattgaaattctagacgactactacttttgagtcacgccaaaacttcagtgttcatcgaaattgtgaaccctctgttcactccctttagctttgtagacatacatagatcaatccaaagggcatgcttggtcactttcacacattatcacatgtgcgtttaaagcatctaggcccccgtcgttgattttggtaattaatgacaagcgctatttgtgaactaactattatcttgagttatacattttgagataggttcatatgatgtgtatgccatggatgactatcgaggattaaaatcgatggcgcaaagtaaaaggaatgaagacagtaaactagtggttttattttaattgatcgaggagtttgggcgatcaaaatttgctatatttatttatagctttgtcatactatcaaaaggggtaatgacctaaacaaaaagatgatcaaaatgctacattaggtcatttgtatttagacttggttctctgttagaattgaattgcatcttcggtccagggccggtctgaccgaggacattatgccggtctgaccgatgatcccaagtcggcctgaccagcgggttgaatgcctatggttggcctcgcgattggcgacccagagccgccagagccgcagccatggccggtctgtccggccaccctatggcggtctgaccgacccccgtgtgttaatacattaaatgcactgtaacggctagttttccaaccgttacaatgtagtccggtctgatcggccaccccatggcagtctgaccagtagagcacggagttggggatttcgaccctcaatggctagtctttgtgtgtgtgtgggggggtataaatactcccccaccaacaacagggggactctcttggcacttgcttcacttgcatataccccttgcaactactctcacactctctagtgtttgtgttcatccattttgtgtgattgagggttgattagtcaagagtcaagtgtattgcttcattgtagagctagtgcggcacttgatcatcttcgagccgggtcatcgcttgttactcttagaggttgccatctcctagatggcttgtggaggtgtttccctgtgacctctccaaggagattatgaagaaggcccgacgccagttgtgagtggtttggagtttaccacctttggagttaaggaagaactacctttagtgatcgaggctttgacatcctggccgagggct

SEQ ID NO: 8479 - DNA, 1850 bp, Oryza sativa
tgtagtgggctcggcctggaaaagccggaccgttacaaaatggtattagagccgactctcgcggtttcacgggcgcgcgtcgcagttgcataggcatgtgcgcatgcctggtgtggactcttgcggtttcccgggcgcgtgtgtcccagttgcgtaggcatggtgcgcatggctggtgtgtacttggagtggtcacacagcatggcacatgcgctggcattggacacacggacgtggccaagagggaacgttcctagcttgacaagttgcaacttcttttccagaagccgagctctaaagaactccgaggtctcgcggttttacgggcgcgtgtgtcgcagttgcgcagacatggtgtgcatggcttgtgtggatatggagtggtcaaacagcatggcacatgcgctggcattggacacatggacgtggccaagagggaacgttcatggcttgacaagttgcaacttcttttccagaagccaatctctaaagaactctgaggttaagcatgcttagcctggagcaatttagggatggatgactgatcgagaaattcttcccgagtgcgcacgagtaaggacaaagtgtgcagaaaagactaattttggtctatgagggcagtatatgacctatgaaagctgccagatgtaagtgggcctggcctgggagaggcgggacgcttgacgaagggggcatgcggtggatagaaagctgccagatgtaagtgggcctggcctgggagaggcgggacgcttgacgaagggggcttgcggtggatagaaagctgccagatgtaagtgggcctggcctgggagaggcgggatagtccacttcgtgggccggctcccacctcgcccaccccttgacgaagggggcttgcggtggatagaaagctgccagatgtaagtgggcctggcctgggagaggcgggatagtccacttcatgggccggctcccaccttgcccaccctatgacgaagggggtttgcggtggatagaaagctgccagatgtaagtgggcctggcctgggagaggcgggatgttacagaggcttgggtagtccacttcgtgggccggctcccaccttgccaccccttgatgaagggggcttgcggtggcttcgtggttttgagcggtgaagttgggttcgcctcaacggggattaggaaccggcgagtttccgaacctcgggtgaaaaattccttgtctcttgcctcatttacttattgcattttcatctgtgcaatttactttcatagagacatatctgagcccatatcaccctaggatttcaaaacataacttagttgcaatttactttcatagagacatattttaagcccacatcactctaggattgtaaaatataacttagttgcttagttaagtttatccctcaccaagcctagcaacttaggttagttttgattaggtgtgatttaattttaatcgcctatatattcaccccttgtaatcgacatctcgatcctacaacgtctaataatttgctagtcactggtgcatgggaagcgtgggaagaggggaagggcaatttcccttttactgtagtaaagatatgcttcctccgttttcaaaataaataaacctagtatgtgatgtgacatgttttactgctatgagattattaatactaactcatagtactaggatgtgtcacattccgtattagatttgtttattttgagacatgaataatatgggattgtggtgggaagagaacgtcgtggttttttataaataggattggggcgagaagaaaagggaagaaagacgattgtgctacatagtactagcaaattagccatgctatgccatgggatacaaaatg

SEQ ID NO: 8480 - DNA, 2575 bp, Oryza sativa
aaagactacaaatctggatatacagctatccaaatttataatcctaggtcatatcctatcctagatacatttatattgggactgtggagattatgggtaccccatacacacacggcatggttatccgactagttataggggataacttatatctatgaaatatgtaacagatcatgacttgggtattacgtttccttgtatattatggaacggcctaaggtcctggtttaatgatattgtaaagtagatttaggaaactgataccgtattggttaaggtttctattttgtaatcctgccctccatcctatataaggtgggcagtaggccctctagggggcagatgagacaactagatcgtcagatctataatacactcggcggattcaaatccccaaacagaagtagggtattacctctcattgagagggcttgaacctgtctaaatcattgtctccgcatccatccacttttaggtctcgtgcgctaccccttttattattgccgaattcttgtttcgacaaggacatagggaatattaacggatttcggtgattttttttgagagagagcattagagcaagtttaatagaagtatagccaactgttaggtataaaagctattccgttcatctaatttaatagcctaccatacaatagtttcatataaatatataatacactattaatacttagcccatctatcacgaaacctctaatgggcgatcgatcgcccagccgatggggtagcgatcgggtagcctcccccctccctccacctagtttccttttttgacaccgtattactttcctattttagtaagtttatacacagtttacacatctaaagtttagagaccaaaagtttataagtcaaaagtttatatatccgattcaaatttgaatttgaattcaaatattttttatatatagtatttctatacatctaaagtttatacacctaaagtttatagacccaaagtttataagtcaaaagtttatatacccgtttcaaatttgaattttaattatatccgatttgaatttgaattcaaatattttttatatatagtatttctatacatctaaagtttatacacctaaagttcatacacccaaagtttataagtcaaaagtttatatacccatttcaaatttgaatttgaattatatccgatttaaatttgaatttgaattcaaatatcttctatatatagtatttctatacctctaaagtttacacacctaaagtttagatccaaagtttataagttaaaagtttacatagccgattcaaatttgaatttgaattcaaattttttatatatagtatttctatacataaatttttttaacttttgttttttttttaaaaaaaaatttgtggtgtagaaggaggggaggaggaagggggagaggagggaggagtgtattgagtataggggagggggaggacgggacccgcccattaggcgtgccccatctatcacacacacgtactccttcgttaaaaaaaaactcaccatcgaagacaataaatctgaacaatctcatgtctagattcgttgtcaagttattctttgttttagtggagggattaatatcttaaaactcgtgctgcagttcaacataaatctgtactccgtttttcttttatctccttttctctttcttcgcatatgttttttatgggtgaggattctctaccataatgtcactattacgtgaatcccacccttctattatttcacatgtcagtgtctgtaatggtagtgtaattatggtagaagatgtgaacccgttttttactaccttgtcttatagtattagatgtgaacctgttttttactacctatcttatagtaatggtctactgtatccgtcctataatatagcaatctaggatatgatgggatgtttcatagtgcaactaatctggatagaccttctgtctagatctattaaactataaaatgtctcggctgattctaagttgttatattatgggatggagggagtacttgctattacaacaactgatcaagcaagcaaatcaccgaaaccgctcccgaaaattcaaatatccaacgctccatttcgcttccccacccaaattcccaatcccaccccgccgccgccggcgtcgagcgataccggggccgccgctccccatggacgccggcgacgcgagccgcttgggggagtcgctggacgccgtctccgccgccttccagtcccgcgtcatggagctccaggagctcgtcctcgcccgcaacagtaagctccctctcttcacaacctcaccccttctcattcccatctctctctctctctcctcccatcaccgaaaccctccgatcccctgaccccgcctgcctcccccacacgttcgcagtgtacccggctacggcgataccggacctcgccgccgtcgacgtgtcgctcacggccatggaagcgcagttgcaggcggtccgccgccgcctccaggaggagcgcgaagccttccccaaggccaaggtatcgtcctctttctaagatttaatcaatgcactgttaaattgcagtacaggttg

SEQ ID NO: 8481 - DNA, 4559 bp, Oryza sativa
ttctaagatttatcaatgcactgttaaattggcagtacaggttgttccttggttgctgatttgacgaacatggggaggggatcgacacaacatattttgattaggacctaacaatcaaagggatttgatacccactaatcccttgttaatccaatcctcctgtggcgtgatgggttgtgtagaaatggttggattaatcttgcctgttcctgcggcgtgatggggttgcagtgagtgtctgggtatgggggtaaatggatatatcagttaccgtagtttgagtatttggagaattgaacaaaaacaaggtctttgtctttctgggaaaaaaaagtattatatctttcgataattttgctattgctcctaaatccaatcttaattttgttcaatctacccgtgaaatgaaatatttctaactagtgatttcctcaaatactgatgtagaaactagtacaacagtccttgaagcaacagcggaggctgcagcttatgcttgcaaacatgccaactgggatgcgcgaggatgtctttgctacacctctggaacataattcatcaatgtatttgtgaatattaggaaaatacattggctgtttctaccttcatttgtgatatcaagttttgtgcgttacaggatgtttcctgagtcgctcaatttcagctcggctgttccagaagtcagagaccatgatttaaagattaaggaggagccaactgcaccacccaaggtaaagatatacaatcttatgtaacttttactcattgtctacaattcttttcagatagaaattataattgtgtcatcatctaatttattcttttattactgagaagaagggaagaggacctgcacctcgttggtacatatccactgaggagcttgattcgttgtcatcgtgagttctcaattgcaatgatagcttcatttcatttacttgtctttatataccaaccacattcctttatctgcatccaatatgtggttaagtgtttttttttggtgtttacatctgtccgtttgagataatgcgatgtataccatatgaatgtgctacttctttctacaccattcttcttttctgcatacttagattttcttttctgaacaaatggtaagaaatgctaggtgaatgttttgtgatttacctagggcctgttcagattgtagccaaaataaatcttaccaaattttggcattgtcaaaattttgccaatttggcaatattgccaagttttggcaagatttcttatttatttattagagtttggtacgaaactaaatggatgcacatatttggcaactttgccaaaaaaatggtatggtttgaaatggcatcaatctgaacaagcccctagaattgagcctagacatgacttgcagtcaaaacatctgccttctttgcctttgcatcatctttttgctatgtgggtctcacaggcaatgaaggttgtcatgaggtttatattatcaatccagcactactgagtatggagataagtgcctatttacctatgttcctataagttgaagctgttaaagtgctgcctattggttttgtaacccatctatttcattatacaccaagttcaatcagtagagaacctgaaatatcaaaactcaagagacaaacaatgcaatatagctggtatggtcaacttctttgagtttcttataaatctaggttctttgctaacttgtctttaagaaatggttatacactatagaatagacgaaatcacatggaagttggaacaatatttttactcaggaaggttgctatttcattttcccattgtgtagaactatataagacatgcaaactggtgccatgccttcaaactaaaaatggcatcccattttgttactacagatacatgagagggaggctcactctggagaaggttaacattgccatcaatgaagtggcttcatatgcggacggcaatgctcatcttgttgcatgtccaaagaaaaaggttgatcatttcaataactttactccaccttttatttataaaaaaaaatcaagattattgaaaaaacagtgggaactagctggttcctgcacataaaccaaatttacccccaaaatcagatgtttcattttctgtttttactaataagcatcatttgataaactgtagaaatttccattcttatgtggagactttggagagaacttgaatataatataagtactaaccgttaaggaaacaattgaactttcccgatagcagaaaccagcacatcttttgtcacagttttcaaatcaatggaagtttaacctgtaaacagccattgcccagttgtatggtaggattggttgttgaccatccttaatgttcttgcagttatcagaagacacatgggagaaggcactggtaagttctggaaggatgttgattcgatttactcatttttgtgcggaatcagcatttttttttctttttaggaattaagggacattgcagcaagagagtcagttaaggggaggcatttcttcttggaaactgatataaagggaccgggcttaaaacttgataccacagggaaagcaatccttactgtaagtatatgcagctttgaccacttgtgtacaaatgattttttttcttctatatctctaagatgattttaatgatatacatatttggtagacaaaaatgctattcaaatttttccctttgtagttggcaccctttcaaagaaatttggtagcataatttgtatttgtcaaacttgaacggggtagagaaagaacatggtacgctaaattaaacattaactgtggtattgaagttaagcagttaaacaattccattcatatgttttgccctgtttaacaaaattgatttaacatttcataactcatgcgacgcaccatacttacactgcattcctgtctgtttatttgtataacagccagtattaacgagactactagtaaagccatttacttggcaccattaatgatgaatatttgcttgaatgaaaataggatgctacacactaatttcttgaagatgtgaaacaaaaactactactgatttgctcttgccaattggaattttccttttctgccgcattaatcttctcgtgttttttcaggtccttcgtcatctcggccgcttccaggagacccggattgggcatcatcgcgttttcatactttcaaaacaacagtgaatgaagggtctcctccaagctttatttaggtgctggagaatataaagtttaatttggtgttaggctggagatagatacgcatgcattgagcttgtttactaattgctatgctgtagtttgttgtatacaggtcagggcaagtactataatgctctatatgctacccctaaaattgccatattggattgagtgatgaggtggaggagataagtgaggagagagatgatgaaccacccctaaatcaagaggcaacctccacacaaatctattatctatctatctatctatctatttctattatataataaaagtctattaaattttctacaaattttctcaagctgccacgtggcattctacgaacgcttctaagctgtcacgtggcacttttagaaattagaaaatttcttaaaaatctataaaaaaaaggaaaacattttactgttgatttttattaaatttagtggtcccattattttaagcgtttagatttatccgaatcaacctacaggtaggaacgtacgcacccctctttctatgttatggttgttaagatttaatccataatttgttacagattaatctatctatactaatataaaaaggagttgtctccttgcaatcttacaggtgaaatccacatacttaatccccaccgtccatccgacatctcatctaatctgatccgtcgtctcatctcatcatcatcgctgtgctaatcccaccgattactccgcccccgagcgcgcgactccgccgctccaatccccgccccatcctcgctcctcttcacatcctccctgctcttctcatctcagccgcacgaatccccgccgcctcgatcactcgctccgctcgattccccgttgccgccgttggaccagccaccctcctcctcgctctgtgtgcatcctccctctctcagcagcacgaggaatccccgccgcctcacctgccccggctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggcctccatcgcgagctcgatctgcagcccttggtcgctggcgttcgaagctggccccggtgtggagcacgccgttccgcctctgttcaaagccctccaactcctccagccgtaatccccaaccagacttgctccatctatcgccaacactcgatctg

SEQ ID NO: 8482 - DNA, 1224 bp, Oryza sativa
ctcctgcatccccagccatgccaagcctggcgccgacctccggcaaggacgacctcaactttgtgttgttcagcgtccaatacccattcaaaatattccagttggtcaggtaattagttactatcttggctaattgaccttcttttgtctattttctcctatacttaaattgaaccattgaactttgctctttgttaactatttcatcttgtgtaagttggaattccagtaattaaaaatgttgattaggtttcttatttgtcaaaattttaatcatattcgatttggtgtatttaccttctcatttctagatagcacaaattttgattaaaaattggctgcaatagtgttctctgaattgaagaggcagctattaaaaccaattgagccttagattgttaatcaggttgttgatattgctcgcggtcactgtcgttcctaggtctgtaacacctccattactatgctaccaacatacacaactttttagcctatatatgttttcttttgttgttcctttaatttatttaaaccttttcaggatggatagggaattcaggatggtagttggtaatctcctgcaggtagaatccattactttttactgtctttttctcaatcatcgcaagcattttctttgcttagggtctgatttatgacctagcttccatgaatctggttatggcagtcttcttggtagatgtggcgttaggattgtgctcccactcacactcacactcagaggcatattgcctaggtctacagtctactccaaaccacatagttcaattcctccgcgttttaggtaaatcactgatctatctctgtatttgtgagaaaatttttgatttggtatatatgacgaccttgagaagtaatgatatgctttcttctggattctgtatatacttttgtgcagaactggagtcaaatgtttccgtttgttttgtggcttgattagtcctgtgcccatgcatctcttgctcccttactaatttctctggtgtgtagaattgcagatcaatgatgcatggcaaggtcagagcgccaatgaagtactaaaatggtaaaagaagctcctgctcctgtaatttcttagtatctctatgcaacaatggatgccctgatatactttgatacaggatgatctgttgattaccatatccgaaccatttgttctgactgtttatatatattgtagatcaagcaactactgatcatgcc

SEQ ID NO: 8483 - DNA, 9160 bp, Oryza sativa
  unsure (1)..(9160): unsure at all n locations
gtttcgaagagtatatttggttgcttctagaagtaatactttttgcatatagttttgttcctttaaccttttagaatcaactaattttgttctccagcactgatttgatcttaatgactcattgcttccaattccataaggcacatgctagatggttattgacagccacaacaccggcgccgaggcggtctgccctttcgccattgacgcggcccaacagtcacgctgctcgactgcgccggtgtgcccccaacctcttgtccttgaagccacgtcttgctgaaacgttgccccaggcacgattagggcgcttgtggcactaattcggaaagatggaaggtaattacaatcttcgacccgcgattccctccccctctacctcatcgtgatcctctcatgttccctttcgctattcgcgctccggcgaactactcagatcggtcaatccctgaaatagcagataggctggtggaccttagctgtggacgactgggatcttgatggcaccgatccaagcctccgaggagagggatggctgtggaagggcacatcactgacaaggtagtaatttaccaacatcttagtgagcataattccacactaatgagcataaaagttcttttttttgcttttaatacatacagagattcagttcatctgcctcggattgctataaaaatactaattgtctattgcagcactatatcatgtccatttaacaaccaattcttgcacagctaagaaaatgtgtgtgcactgtgcagccacaattgcagatatagttaggtacaataagtgaagttgaggggaataatttggtgatgactataagattttctgcttgtgcttctcaatattttttagatatgttatcctctaatgtaatggggagaaagtctgatatattgtgatacttttcctgctgtaaagaagtatatatggattctagacccttatgctaaatattttcagtgttatgacgttagctgccatgtttaaattgttcatttatacaggtgatatttttttcctgcatttattaattcaaattctaaaactatatatgctgtagaatttcagtgttatgatgttggcagccaaatacattgtttaatagggaatatatttcttgtatgcatagtgaattcaaattctgaaactatgtcaggttgttgacacactatcatatatggctcactgcctcatttaaattcttgaatctgtgttgacttgcatctcccatgtggtactcaaatggactcagaagctccccatgttgatattgctaatcatgagcattctacaatcatcacctataaacttggttgatggactttacaaatgcatcttgtctaaggaatccctgaagtaagcctgtttccatacgattaatagaacatggcattatgttattgtttaatttatattaatgatgtgcgttttaggaaagagtgtattgtgatctcaaaggcttatccaattcgattgagtctaaaaacaaaatcatgaatcacttcgtatgaatcatcacctgggcattgagtgtttcaacatgattgtacagaggcttgcacacaacaaaattcctacatttaatgggtccaaaagttctgttataaagcacttcatggacatgtgattttgtataatatctctgattattacatttggtttcataggatacttacatcactctgaattttctatcatttttatttttttcggcaaaaattgagcaattttggacatcatccattatgctgcaaggttattgatgttaaatcatttgcaagatccatagatgtttggccatggatggattacgatctcgcgttctccaatgtggcaaagttcgctcacttttgcaatgtggaagttgcttacccttgactaaatcaggttttcactctccctaattctcgagctcgcatactatgtttagcacattatgcttttcatttcatgtgttctgtaatatgagagcttccatataattccctcatctgattggcagttggcaacagcctgccgtgtttgttacaattctgaatagaaaactttgcccatgtcggtcatgtgtttgacaaaatgctccagacacttgatcaaatgaatgtatttgtattttctcacttcctcagtatagcaacaaaaatattactggtttgctttttcaatctgaatcactaggtgttgttaggtttggagaagtttggactgaatcaatgcaatggacaattcatagaagatttcaagcagtggaaaaaggagacttctacaactgccacaggtacaatactctgacattgaaatagaagctgaccaatgcgctcacattgaaatagatatatgtttaagtacagcctgaattttccttaataaggaagaccatttaaccatttgtgcaggattaaaatttggtctaagatacagatcttgatggcatggtggtgctgagtgtatgccataattctggtgagagttggatgtaatttgcttgccttcaggataaattggatgtattttttgctgaccaactggatgtatgctttcttaaccggttttatttatatataactttagtcagcttgtgaaattatgtaaaattcagttcctgaagtactggtacttactgttgatttatttgtgcgtgcacttactgatataagatcatttgttattctctttacttacaatttcacttccagctggcaatgatttatacttcaatcataattgtttgcttaggaagtactctctccgcttcatattagatgtttgttttcttttcttagtcaaacttcttttaagtttgatcaaatttatagaaaatatattattattttcaaaagaaaacaaacatattatgaaaatatattcaatgttatatttaattatactaattttatattttagatgttaaatttttttataaacttggtcaaacttaataaagtttgactagaaaaaaaatcttataatataaaacggagggagtagcaacattgcaatgtataaatcatgccgggctaccttgtacgttatggatatattcaccaaaaaggattttatagaaataatccaaatagggtttttactatgatgtatgaaactttatttttaccttaacaatttttatggtctgcactgccttaaaaaaagtcactattgttctactccctctatttcacaatgtaagtcatttagcatttcctacattcatattgatattaatgaatctagagacatatatatttatctagattcattaacattaatatgaatgtgaaaaatgctagaatgatttacattatgaaacggaggaagtacctacatacatacattgccaaaacgtgcaagtgcacgattacgagtgctaatataaaaaaggagttcaccccctagcaatcctacgtgtgaaatcaaccactcttatcccatccgtccatccaccctctcatccaatctgagccgtccgctgtacaccgtagatctatatccacaagcgatttcgcccgatgtcatcccaccacgcggtaactgcgacgcgcaaatccccggtgcgatgacgactccgcctgctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggtgcgtgttcttgtgtgttcttgatcgatcgatctgcgttgggttgcgagatctgagatttttgcatgtttgatctgtgcgtgtgtgcaggggtgatgcgttgcagcaagagctgccggctccggtggacgaactacctccggccggggatcaagcgggggaacttcactgagcaggaggagaagctcatcgtccacctccaggctctcctcggcaaccggtgatttttcttttcttggttttatggttgctttgattgctttgtccatggcgtccatggctgagtgggttgctggctggctctggctgtctacgatgggcgtccatggcataagaggattctgaactgatgcataagagtgtcttgcatttgcagttctctaccataatcgtggtccacaacatagccgtgctttctgaatactttcaatggatagtcaacgaagctctacactacaaatttctgcaataacatgtactattattttttgtctgaattttgctttgcttgctacctttattttacctggagacaatttatatttggcctgtgataatactctattgtagtgtatgtactaaaatgtgtttttattctatttaggagggatcatatggaggttagttaactattgtttatcactgattctcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttggaacatttgctatagtattttctgatcttatcctgggatgtacctgaacttaatattctcggttgtaccggttcatttctgagttcattccctgaacttgttgactaatttcaatctgtgatgtggctcaattttttaatatatatctaccaaagtttggtttgtttatgttattggtgcactgagataattttaattattttggctgttacgttggtaaattatgcagttatgacattttatcacacttcctaatttttatatgtagtttacattttatacttatttttttatacacgtgcacgattcctagtatatctaatggtcaacttaattccttgacttctctcatggaggcaaaaccggttgtggacgaaattctgatgcatgtcccatgtaccttgatacatatgaggttcattggtggtcttaggttcgttctttaatanactgtctttacaacgatgaccttttaactttaacatccattttatgataagattaaaccattgtatatcttttagataaattaactgtttgagctccataattagatatttaatgacttttttaaactgccacgtggcgctctaataaatccttaaaattctattaaaaaagcaaaacatctaatcgttggttttatttaatcgggtgagcccatagttatcaccattagatctatatcttaaaagtcaccaattaaatctatccccaaaaccgccacgtttatgccattgatcgctactacctccgtcttaaaatatagtaacttttagttacgaatctgaacatacaattgtccagatttatagctaaaaatgcttatattttgggacagagggagtaagtaggaaggaaaaaaaagtacggtacgtttacgcccagccccacgtcttttttttcttttcttcttctctcacttagattagatgaaaaataaaactaataatttaagctcatatgcaaaaatatatgttatttggagttgtattataacaagctgtatgctgtcggatcatccataaaaaatataaacaaattgaaaatatagattatataactgtatatcacttgagaaattagacttgcatttccaaaaataaaaataacattcaaacattcccaaaagttaaatactgatataactaaataacattactaattttttcatatattatgtgtttttcttttgatagtattgatgtgctttatgtcctaggcttcattcgctctagctaattggctgagcttatcaggacgtgcaaaacaacgtaggtcattggcattgaatattatgattaattaagaattaaatattaaaactttaaaagtatatttatttaatttttagaatacttttatatagaaaccatttccaaaacacacacaatgttcggtaagcatgcttacagtaaacaaggggtggccaatcctataagtacttcggtacttaaccttaatcattacttcctctctttcgtaatgtaagccattctagcatttctcacatttatattgatgttaatgtatctaaatagatatatatgtctagattcattaatatcaatatgaatatgaaaaatgctataatgacttacattgtgaaacggagggagtacttaggtactaaaattcttaatatgtagtatataatttactttgtcaattagtagtagccaaatatatcaattatatgtccctactattcaccgtatatataagttctatatagaaaccactgtctatcaatcttcgagtctgtcgacggtgggtacccgtagaccgaatatagagggtattggggtacgttggtacgaggatctatgtaatacgacatcaaggaaacaagagacaaagattatactggttcaggtcccttaataggtaatagccctaatccagttgatatgggattatacggggatgaccacaaattacaaagagaataacaaaactcgacgataccgacgagatcgtagtcgagttgattcgactagatcacccagcgacttggctcctgtaggctccggcttcgtaggctgtggtcgttgtgttggctatgagatttgatgccttaggtcttcccggggggtcccttttatatcgcaggtcaggtggtctccaggtaggactcggagacatcggaccctgcacgatatagtgacgacccagtcctatacgggtaggaacctttccattgatggacttcgagatgaatttccttagcgtatacagagaacgtccatacacgcgcagatgtaccgtattgccatatcgcgtacatctaagggtaaagggtatatcttatccgtagccctgacagagtcataccctacacaatgcacctaataattatctcatatccaatgagcacgtgtaccatctagcattgaggatgaaggacgatactaactgggaaatcataaaaagatgacagataagtagatgatgccaccaagtgacagtcaaacaatagttgactacaattagattgtgactatgagtaataatattcctactctcctacaaccacttctaggatgttacatgatgctctaataaattaagtaaatgtaagaaaaataataagaaaaaataaagcatctacccaccgttttacacttaaaccggtggattcattattttcaaccattagattagatctattaaagtaattgctcgctcttaaaaaccagttaatccctccctatgtacacatgtacacgaaaagaaaaaaagaagagtacgtacgtatacaatcctcttgttcggtagttctctttctttctttctttctttctttctttctatgtag

SEQ ID NO: 8484 - DNA, 24462 bp, Oryza sativa
ttatcgaagaagcacaccgtgccactgcacgccatcccatctatttacttgaaagtatttttttattaactatgaagtaaaagacaattgtagatgctcatataaacacgtgcacacccacccaatgaatgcacatacatatactctacccctaggagagaaaaaatatttgtttgttgaaaacccaagaaaaaaagtacataagtacgagactactaatcgccggaaaaaaatattcatgcgtatgtacactcctaaatgtcaatgaacccacattataaacctttttttattatgtcagtctcttctaaatagtgttaacaattagtaaaaataattttgacaatatagatcattccattgtatattgcctcctgaacatgcataagtggatcgatgtataataaaaggagaaaaaaagccaaaacccatatttactcgaatgtttgggaaggatggtaatatgcgagtttacgtataatcgggataaagtttttttaatatgatagacattatcatttagtatatcaaagtctttggtctatttcacggtatacttatttagtttttatggttataaggtaatctatgattttttataatgaatatagtgtgatataacttcttttttagtattctcattacaaatagcaaaataaattgcccgcgcatctgcgtgggcttcctttatagtttcaagaaaggtgtaagagtactagagatattagagatgacattgtatattagaggtgacatattatatggtttgcctcttaatttatgagtgaatgatatgaatgagtttggatgtggtagtcacgtctacatagcacttgccctcaatgcttcaaatggtttgtagacgcaattgaagtgaacttttgaggtctcacttttaccatgttcgttctgctgcgtgatgtaagattgtttgctactacatagacttgttcggccttttccgtgatggaagatcacgttcgcgtgatctcgatgaacaaaacattacccagtgcccctcgtttgatctaatttcttgtacatctccttctatatattgcataacctccttttttccagtatgcgcattttgatggtctaaaactgggccttgacagtaaatttttattctacaatgttttgttaatcaaagatcacaatcgaaagaaagtacttttgaacaagaacccaattgatgcaatatcaaatctgttctcagtaactcgtacactatcaggttattactattgttggtgaaaagcttgaatttagacaaccaaattataattatatgtattcatttacgaaaaggagaatgtttcaggggaaaaaaaatcagcctctgccattggtggagggagggaatcagggaaatggacactatattatcctttagagcatccccagcagttcatccatatttgattttccatatgctcatatggatggccatctaaaaagattcctcatccatattccttctcactcccatagatcatctatattgcatcttccaatatcactccctcctatattttactaatatttttcaactaaccatacatttggattattttttatggactatattttaaacaactaaattttaacagtgttatttatcccgataatctaaatgagtttattttaatggatggattttaatattcccaactattttttctcctcttctctttactccttttctctcatcttccctattcctcttcttctctcctcttctattcctcttcttcttctctccgctcaccgtggaggcggaggctagcggctggtggccgcggcggcgcaacgggcgcggggcacggcggcacgacgggcacaggggcgcggcggcgtgatgggcacggcggccgacgggggctgcggcgtggcggcacgacgggcgcgatggccgacgggggctgcggcgcggcggtgcgacgggcgcggaggcgtggcggcccgacggccggcgtgggctgcgggttccagatctggtatgtctctccctctccaccctcactccttgggaaaaaatgcacatctggccggcgatgacgacgacattgggggggtcgcgacggaggggaggtcgatctggactttggatgggggcgggggacgctggcggttacaggatgtggaggatggcgtgaggagagagaaacgccaaatttgatgtttctctctccccggatggaggatagctaaatttggatgctgggatggagtatctgttggagctcacttttcttctcccaacctctattttgtggatagaggcctgaatggagtatctgctggggatgctcttaccaaatgctctggataataaggtttacttgtggtgggccagcccattaacgtatttttaagctcctgatgcacacgcaccgcatacttgcaaacggctcatcgtttcgcttattcgtggcatatttgtaaacaaatagtaatttgtgaataaattttttatatacatgttcttagagatctaaaagcaatgggtgaaaaaataaacttcgatgaaaaacctaaaatcagctctaaattaagggctaaaattcaaattttggctgataagcataagcataagcgaaaacatgaggccgaaaagtatccatacattaagcgaaggggacgaaccctagttagaagatagggtccaccatccatgcttttgaaggggaaacggattcgaatacgatgcgtgggccggagcatccagtgtcgacgttagaaaggccttgatcggccgctgtcggtgggagaagattagttccggtacttccatctgcattgatctcccaagacaatggtggacgtccactcgttctacctctacgacgacgacgaccgatacaagtcgcatcttgtatatggtccgatacgcatgtacggattactatattttttctccttgtgttggggatcgggttgccgggcgatctatgtatcgggattttgttcacacaacggtttttttgtgtgactagttaagtgcccgtgctctgtaacaggttctatgtatatataacctttatgtattgtataaacaggcaaaatgaattaatggattgtatgatatacaaactaaggacgagaagctgttaatattgaataagaacattgctaatatatactccctctgtactcgtaaaggaagtcgttttggataatttttaagtcaaatcttaggaatataaattatgaataactcttaaggttattgagtttgaaaatataaaaaaaattatatgaatagatttttcttgaaaaatactttcataaaagtatacatatatcacttttcaataaatgtttttctagaaacaagaagtcaaagttgtgttttcgagaccgtgtcgctgttcaaaatgacttccattacaagtacgtagagagtacatctcatatataaaatagactaacgatgcactccctctgtcccaataaaacttaaaccctagcactctagtaaggatttaaggaaaacgacaaaaaaacaaaatactcttagctaataaagaaattgtattggtgaatggatggatggggattagtgaaggaataacatttctcgatttgtgaactgatagtaggtaagaagatagaagttggtttattatttaggacaaaattcaaactttagaactgatttattttggatggagggagtaggagtcccgacacaattactgcttttaatacaatacataaaaaaataatcataaagaaatagatagatttgaagttaatgttagaaagtttgatattctatctcataaatcacaatttgttgtaaatgcacaccctcctacgtagttttgttgtaaaaatcatcccattacgcatgtgcttaatgaaatcaactcactatcgctgatgtagagccatcacatgctaagctagcgagtcaatcttgtccaagtacttgcattagacttatttcttcatgtttcattgaattcttttatgcatatagcgaaactaagtacgacaacgtttaaactctcatcaacaattctctttattgaatcttcaaggaaagtgttaaggctataattctagaagtatttaattttgatagagactatattgatggctcataatttataaaaacacattgattatagcctattacttatgagatgtaatcttaaacgtgttttataaagtgagtaggggtggacatttgcaaccaaattacttatgaggtggaatcgtaaactttaagtgatttatggggtggtttattcaaatttcataattttcaattgtagaataaagattagcgcttggcagccgagcacgtggcagtgagcctaaatctaactgcaagagcggagtctagagtagagctgtcgagtggtccgaaccctgctccatacttctagtttagttttttatatcactccagaccgcttcgttgctattttgggtagagttgaaatcatttgtttgaatttcaacttcaaaagaggtaaagctgaagctgtagccctgtcaaataggccctagatatcacaagaaatttgaggtgataccaaagtgaagaatggaaaggacacacctaaagcgattgaaataaaaaaaacgaatccacggaagaaagatgttactacacccacaccgcgatcagcagagttgccatccattagagttgtacacttacacactgagtgctgaattttaagcagacacaaaattaaactacacatggacagaatagtggaatgcaccaagaagaagaattaaattctgcagctagagtggtatatatgtagctaagctaggagtgagactccaccagaacgtacagtggcttcccattgagcctctcacgaccctgccaaaagaaaaaagaaagagaaaatttcagccccaaattaatcagtcatcggcgacagcttcaatttctctcgttttcttgacgggaactgatgcagagtcctatatatgtatataactggagagagactcagcagcagcaagccagcaaccagcgatgaagtgacagtttgttgaacgacaaatacgcgaatattagaaaataacataatatcaaataattagaaggggtgaggcttctaacccgggcagggttggaaatttcggtcatttcggtgacccccgatacgatattaatttggccaaaatttttgattttttcaattttttcatgaatttggataatatttgttcaaattcaactaaattttgttcaaaatttcggactgaaatttccgaaattttgagatttcggtgacctctgatataaacccctgaaccgatagagtgaaccctgaacccgggtcgtctagcccaccaccttgtggagctagccggaagaccctggacatttctcgcgatgacgtgacagtgacattgtggacaattaaagctgaaaatgcgacattcagcgatccatttggagactggtgatactcatattttccttttaatttgagacaactattagtttaatggaatagttaattcattactcgatgcagtctacggcgattcatcactagtcaagataaactccggttattgcaataatacaacatattgtatttattctactatcatcgatgtatttacaatattcaccccaatcaatatatcccaatgttttaatcaaaataatactagctacaacactttatataattcatgcatcttttcttttgctagtactatcttgcgtatctatccatctttttgtttcatgaaaagtacataaatgtgtcaatgttcaatcactctcggttaacgccggcaatattgaatttggatgaagaacgggatatatactgaattgaaagtaggagcgccacctgccaattcttctctaccaaagtacgcaagttatttaatttgggttaactagttcatttattttatctcaaaatatatatactccgtatctaaattcatagctaagagttactatattttagaataaaaatagtataacatgacctcaaaacaaagtgtagaatataagtgaaataaagatgaaggacatgttcagataacatccacactttacaacacactaccacaaaactccttatgggttgtactaagtcataatttgatggatataggtcttgtcacacatgagtcatttctaacccatcagggatgactggatctgaactagctggtgacactttcttgtcaaactttaccataattcatactcgtggcaaggttggatgaagaaattaatcgcaccatagcagatggagtagaaatgtgttaagccatagttttagttactatagcttgcctaaattttgatatgatataaagtgtgccattcaaccaaacaggtataaggcacttattgtacatgcatgaacttattaccttggtgtacttacgatgcacaccaactaaaaaattatgaaaaccaaacgaaaaaaaatctgcatgtaattgtaatcttaccctatctacatatacaattgtaaatttaaatttattatattttatgataaaaccaatgaattttgtagttttaaaagcatcattttgcttaattaatcagaattgttctatttcgactactctatctgtaatcagtcttaaccggcatatgcatcaacaccaactattaaaaatccgccaatccacatgtggtgtgtgaaggacaaaaatttacgtggatggtaattagaagtataagggtgtgttctttaccccatctcttcacaacttctattttctcctctttttttttttatgtacgcgttccaaattgctaaacgggacttttttttcaaaaatatataaaaaattaatttaaaaattatactaataatatattttttcaactttatttttgctaatgtttaattcactttgttttatgtgcggtgtggggaggtggagttcccaacctccacctccaaatgcagccttattagtagacttttttttaaaaaaaaaattggtgacaattatggttactatgtgaaaaattggtgccggtatatgtttagaagtgcgtgatgcatgtaggggttgtttggttcttaactaacatcgtcataactcactttaggtaatgttagacaagtgtggcttgccacactttctgtggcctacaaattgtaagccacatttgtggcaaagttaggcaaatgattaagtctataacatatggagtaagatggtaagaaaatgtggcttaccataactatggcaatgaatcaaacacaaagctaacgaggtgtggcagtttaaagtatggtctggcaagttgaagcattgaatcaaacagccccgtagtatcccgataatgtggggctagctgtcgctgtccggccggacactgccaatatccctgtcgccgtgtgcaaattattcgtggagaaggatggccggaatcactcgacatcaacactgtcggggggacgcatgaagcaagcaaattagctggtagaaaacatgaattatccttgtaccaatatattatatatttcttcttgtttgtatttctcatgttctcatcgaacttggaaatgagctcactacctgccagccgttaagctagcttcaaatagcttgtgacagggtcccctcctatatatggtatcccatctatatcctaccatgaatgaggtcatagcttgagccaaactgtggtttaatttatcaagtggaatttggtctagagtgaaacaatgcttaaaaattaagggagcaatgtgagacacgcatagcgcagatgcaagatcggtccaatgcggcatgaggggatgaggagacagaggcacgaccaccacagcgcagatgcgacatgttttttggccacgtgtggactcaccaagatcgaagaactcgtctccctgtgcggaggcgagaggctcagcagaggcacgggtttagtcgacacgtacgtaaaaatttaagctggtgatccaaagcaactcgatacgttctcgcactgtaaaggccctaatagtctctggacaattagctttatataatttggaacattgtgttcaatttttctttgataaatcacactctatttcatccaaatagaattcatgtaatcacggaggaattttaattttttatatctatatatattaccccttcgaccttgaccaccacattatatatttatcttaaaagggaaattcaacaacttacaaactgtacattatttatctctcaacatgtattactgttcacagctttatccctgaattagggtggtttccacagttcgatcagtaaaaaaaaataggtcccgtatgtatcaatttttctccccctcttctatcttcctcataagcatcataactgtgatagttgaggaatggggaggggatgttaatatggatttattccatttttcttgaattgttatacacaatttttaaaaattccaaattagctatctttaagccatggccacatccccaacactactctaaagagtctaaacccaaatcaaattaatgtgtgcttaattccatatttaatagtacctgaattattttttaagcatacggtatgttcttaattaagttttaagctagaatgattatagattatttcttaaaagtaaaagtgcctctagttaaattggaaggaagaactcaccttcagttccgggagctcaatcacacatgcacactccaccacttctgcaccagcacgctctgcatgcatgcacattcaaatgtcatatatgatcagaaacagaaaatgctcctatatagtacacattgtactgcgttaacatgttgtatataatattgagctcccccaaacagggtgatagtcacatttgagtcactattgcaccatataattcctccattccagaataaatatcattttttccttccttttatcccaaaataaatccattttaagcaattattgcatcacaatttgtaaaagtatgtgatatatgcatttccagtagataaaaagagaattaattgtaatggaatttgataaactgaggatattttagattttttggttttgtattggtatgtgtgggatggatgaaaaattattttattttggaacggacgggtatactataatacatgtaatagtaatacacacatatatatctcctgagaattcaacaattttgtgatattagcactaattcttcgatctgaatttaaacatatatcatgagtgttatcttattaagcccggctagctggtgaacgatcgatcgatttccaatctggcatatgcatccatatatatgctcattaatttaattacagatatgatataattaatactccattcaattcgtgcaaaaatatataaacctagtattaaataagatacatcatagtattacgaatcccaatactaaagtgtatctcatactatgtttttatattttgggataaaacgagtacgtaccaagcaagacgatggcggcacagagcgtgccgccggtggcgacgaggtcgtcgacgacgagtgctcgctcgccgggctgtaccgcgccgacgtgcatttccaagcagtcggcgccatactccagctcgtactcctttgacatcacctcacctgcgcacatgtatatatatacgcaatttatcaaattcccattcacatacaaaattctatgcaagtttcatttcagtctcttggtcaggtttatttcactactagaattcaatagcttccctagagtttaaattagaactcaagggataataagaatccctagggtgactatggagaactcaagggaagatttatgtcccctagagttacaatatgcaacctagggaacttatgccacatcagctctattatgaaattattggcaccacagtggcaaccaaagtgagtcccacagaaaattttggaggcaaaagctcccagcagcgaaattttttgcgggaaggcaatatactgtagtagactaaaatatattctcccccccccccgctccaactcccctaaacaacatcagaagggtgtttctcctccggtcctccccaactttgctgcttctccaatctcccccaaatccctctccaaatccctatctttgttctggatgctatccaaatcggagctccctgctgattagaagacctcagatagagcattatggagctctattgctgtagatcgatgttggaagtgcatcgtcctctctaacccattgccttccctcgaatattgttagtaccttgcatatcagtaccttgcatattgttagttttgttgtttgccctatatatacaagccttatcaaacaaattggttgttcactaaatttgtttaataaaattgtaacaattgtttttttataggatgactcccaagtatcaggtgttagagaggaaactggagatgacagggtaaatgttatagctgaaggaatgtttggtggctacttgaccaattcatctgctaatggtgccaccacctttctcccagctttagatgaacttgatccattttaatttcaactggctgtggtcatagggccaacttttgggaaaacttggtagttatagcgcctaacttttgggtaaagctgattcttaccgaaacatgtgtaatgaagtggaattatgccattttgagggcaagatgattataatgcatcttttgaatgctatatatggtgctggtggatttaaacaatattttgttcctgtgtttaatcatattatgtgtggtggtggtctttgtgcaatattacttaccttcagtgcaatttattttacataaatcctaatgaattgattaacatcataaattgtaataattatattaaaaaatgctcaacataataagtaattcctagggaatgcatgtttttgttccctggggtttcaaaaggaatctaacaactctagggacagtaactttacacgtcacttgacacccaccagctgggcatttttccctaggtcaaacaaccctagggagcattcctttccctaggtttctcttgcaaaaaccctagggagctctttgtttcccgtagaccgtttccctagagggcattccctaaggttcactctagggaaacctcttccctagagtttttcaccattcccttgggtttttggctctagggatgccattgaattctagtagtgtttgtagtttatttgtgccacgctttcatagtatgattttccaagaacttttcacattatgttagcattgtttatagaacttgttttaagctatttgttatatatatttatgacatataatatttaagtgactctaaaaaaggccattagtttgtttagtgaaaaactttcaaaatataatgtatagtataattgtactttaactatattataaattttatgtaacttgtatataagtattaaaaattacacgtaacttctcatacataagttatatataagctacaatatacgtagttttaatataattacaattataatatagttatattatagttacacacaaattgtactgtatttttttactaaaagtcttatgacaatttttagcaatctctatatttaactatttcctataaacgaatcaaccatctatcagcctttctttccatttcttctctaaaagtccatcccacagctgatggatgcatggctagaggcatgtttggttgaggattaatattgttacacattttttactaagatgactaagcttagtcttgtcacacttttgtgacaaacaaaataacaaactaaactcaggcaaagttaggcaagaaaataaagtgtatgacatgtggacaaagtggttaagggtttaggtaaagtagatttatagtatgaactaaacagtacctagtaaaattgtgtcttacctaagataaaatatggcaaatttagttgtcaactaaacaaaccctggatctttcgattctctcatggttatacatttatatagtctttgatgcgcatttcatattatggataatctttccaataagatataaccaaaaatagtaaaaatacagacaaaagtgacttaattttatgaggaatatactaaaatcatgtattaaatcttagtatttgttacatgtgaattgcctgtacgtactttctaggaagtcgcctgttaagaacagacagatcatagtttttacttagagagttaagcagccatacaattttctgtacctggaagtttgttaggttttcttagtgggataaattttgcaccaatagcgagcgctatgggaggaccgaaaataaaccctctagcttcgacccctgcaccagaaagaaaaagtgaaattaaaaaatctactggaatttactactccaaccaaagaaaatcaaacttaataaacatgcatgagctcaaaatggcctgccaggctacttgtacatataaatatcatggcagctcgatataccagcgaacatatataatggcatggatggttatatacaagtagacaaggcatgcacctaattagaccaattaacatcagaactgaaatactacatccaattttacttatacgacattgttaactcttaaacaccatgtttgatcatttgtcttatttaaaatttacaaatttagtaaaagaattgatacagatatgcaaatataagtaatgtttaaagtacttttaaagatgaaataagtcataataaaataaatgatgcttgcgtacttttttaataaaataaatgatcaaatgtgatataaaaataaacaatgccatatatttcaaacagagagagtagtatttttcatatgtgaatatatatatcatacatgatcacagataaaaggacaagattgtgtgtacacaaagaaaaaaaaaccaaacaaataatagatcgaggagttggcccacaccgacagaaatcgtactcaactacatacgtgcagccatggaacagtacgatatatgtgcactggatcttgtgatagctctcactcattgactagcttgatacatactatcatcatgaaagggagagaaagatctaggaaagcatggacaccagctagtagcttatatataaatggctattgctggcccggagagacagatcttgtggtgatcgatcatttgcatcatgccatgcatgtgaacgtcaaagatttaatgcccactggtaattaacatcgatcggaaccatcgttttgcttattcgcggaataagagaaacgatatagttgtaaacgaaaaataatttgtgaataaaacttttatatacgtgttcttagcgatctaaaagcaaaggctgataaataaagttcgatgaaaaaaacctcaaaatccgctccaaatataaggttgaaaatttaaattttggttgataagcataagtataaaagaaaagatgaggcccgatatatataactatttaattggaagtacacattatatatgccacctcagtttctcaaagttaaactttgaaaacgcttcttctttttttagcaataattaaatttataaattcttcaaaaatatgttactatatatatatatatatatatatatatatatatatatatatatatatatatatatatatatagagcgcgcaacacatgccactagtaaatagagatgatgttcacccaatgcaagtttactctaatatgattcattagacaatattgtggaatcatgttgctcatacacacaccgagaaatagaagtaattaagatatatttgatgacctcgaaaatataattcatggtgaattagttaagttaggaggaacttgggggcaaggatctaactctaaatccgagtcatgacatggaatcaaagtgaaggtcaggattaattgtatcaaccctatatttatagcattaattaaaaactcatgcattttatattggtatagattattgaagtatgtattgttataaatataacacaacatgagatggtaataatcaaccataaaaattattcgagaatagacagtatagttaataagccacacatgtattttggcataaataagtgcctgggatgatattggcccgagaaataaaccgagggttcctttgagatgcaagatatatagaaacaccatactagaaataggaaaatcacaggagcagtgttggaattgcacaaagtagttgtttgatactctctctgtccctaaatataagatattttggttggatatgacgtatcctagtactataaatctagacaaatatgaccagatctgtagtactagaattcatcccatccatccaatttttcagaatattttgggacggagggagaacctgataagaaaattacaataaatttaaaagtatgtatctagatttattagggagaaagaaaattaagaaggtgcctatgaattttaatcaaaggtatttgtgaacattatgttagaccttaattatgctaaaatttctccaaatcatggaggaattttatatcctatgaaattactttgaagcaatgctacatctgaaaactttaatttcataggaatgttttccaatggattgaattcctcctctttagattgccacctatcaccctgtgaaaatcacatgtggagacatatgagtcaataaatgatgtgtgaggaaaaccataaaatctccaatctaaagagtggtaagacatcaaatccccatttttttttctaaattaaattgtggtcacatttcaatagccatcagctatcctctccccatctcaaaatttggtagcatcacaattacccgtgatacgccatagtgcagtgacgtatgttatgttagtgacaaccaagagaatatattagtatgacctagtgagctgacatgagagatcgaatatgtgtatggcatgggggcgccttagaataaagatgtctatttccacactatataggtcaattgaggcgtacatagagaaaggaaagtacacctcaattaacttatgcgcatgtgcatatgttgtcatgggtgaagtgataaggaaagagagcatacccaaaagtttttacatacacaattgatcatatacacggatgcacacaaaagggatggtggactaaagcaacatatgtgcacggcctacctacctaaatggtttctattatcgacctaaacttcaacaattgacgcaaagtattttttttaactgactattagtttttttttctttgtgagtactgactattgaagtttgtaaagaacaagataggtaggggtatgacagtgccaggtgtataaagtgaactcctacaggctatgggtaatagtggaatgaaatgaccactcctaaatgaattgacatatgtgtattagttgttggaggtgtgtattatagagttatgttccatggtttagttttgttgatgtgcatatctaattaccttttggttctagttgaagcttttttatgtggtggaggatccaatccaatgaacatgacaggaccatgaatatttgataagtcacctaatcaaatccaatttatgtatatttttcatagttagtgcctcaaacttccatatatgcctatataccaatctatactggtagctgactcaaatgtccaattgtcatgcacatatatatgatctcaaaatatttgtccaacaggcacaaacaagtggagggaaaggcaaatatttttgtcatatcatctggaagccttcgaactttacaaagggtcagacagagaggccaaacctcctgttttgtagtcaattactactgctgcattattcttcatttctctgtacatttgactgtgacactctcatacgaataatctctctcgctctgatcttacacacactctctctctctctctaatttatttgtcattttagaattattttcgttaatcttataaattaaattgacttagcattttttttggaatcgacaaatgaaaatcatgtcattagatttttccatgaaattacttcgatactactgaactttaccgattttctacagtaataagtaggtaattaacggttaggagtatgtattattggaggccgggtcagtataaaaaacgacaagtaaaagatattgtactgtacaacttggctagattttcaatcgacccatcgtgtgcctgtcaaagtcacgcttttaattaactatatttggatcttcataaataataactctgacttagtattaaaaaaataaattatatatttcaatggatttgataagatctgatatttttttgagataaagatcagattagttactactccctccgtcccttaatataagagattttgacattttacttgtactgtttgaacattcgtcttattaaaaaaattaaaactattatttattttatttgtgacttactttattactcaaagtactttaaacataacttttcgttttatatttgcacaattttttttaataagacgagtgatcaaaacagtgcaagcaaaatatcaaaatcccttatattaattaagggacggatggagtacttgaataaacaaagcgcacaagttcaaataaatcttgattttttcaattttttgagataaaaaacaaaacaattatatgttaccagcaacaacggagatgcctttgccagtgtaccgttcaacgaacaagtcgatggtgtccttgaacacagggggatttagaagtagggtcgtgatatcttggaacattattcctgcacatttcatcaagaaaaacaaatattatgaaagaacctgaaaaaaaaaggtattgcatagaccttttcttctgcagggatgtgtcattgatttaattcgcagatctagtcaatcgattttttttctagaaaaaaataattgccacaaaactcttccaaagtatttgtgggaattctataaattaaatttgggcgggcaagggaagatgagatgtgtgttgagaaaaatgcagagagagagcgcgcgcgcacgcgtgctcaaattaaactgataccaaccaatatatatatatatatatatatatatatagagtgggaaaagacttctaaagggaaaatcataatgtctcgaatacacaacattttgctcacaccaccttcatcatcacgatggatgcgcttatcgaaatatccacataattagccttttgaatagagtgagagtttcacctcaataggaagattaaatatgtcttcatgacataatatagcaggaaaaataattttaaaaataaaggaagatcagttcgcagcaacaatattttgtggtaaatgtgcatgctcaaaccatgcatgtgcatgcctataaattgtagtaatgtgagaaatttggttataggttacaagctgcaaaaagctcatgataaagtcacacaagaaacaagctatattcatgaaagtttttgggttcagaaccaataaacaaaaaaaggaaggaaagaaccaacgaggcaaggatcaatagtaccagtggggacctttgcaaggaaacacagattttggcacttgaaattaaaggcaacccccaaggtcaatattctttacagaattgcagcccctattgcacatgtatatatgagattatgagcacatatatgctgaaaaaaaggatcagaaagaagaagccaaccagttgatacataatacttctgaaaaatatttatactcaaaagaaataacatcgttcggtttcaaaacaagaagacagagctagaaaaccacatgaattaactagcgagacatgcaagaactaagctcgaaatcacagtaaagcaagagaggatgcaagaataattaagctaaaaaacaacaagcaagagaggagagagaacctggcttagggaagttgggcacaactctaatggtggatgctatggcctgtgtcctggggtcttgcatctccttcttctcctcagaccctgccattgctcctcccctctcttcttttcttccctctctctacaaatataattgggagagagagagagagagatgcaagtggaggcctgtgagaggggtgtgtgtataaatagaggaggaagctagccagcagcctccttgcagtttcagatatatggatgaatgaattatagatgatgtagctacttgcaattgtattttggttctgtacaacagtgcatgtttgggctctctcactccaattccaatatatacctggaagatcatatcatagctaggacctgatctagagatgttgctacatagattaatattatatacttatagcacacataactatacaaaatagcacatatgcatgcatgatgaaggtgtgttagagcctctagggatgtaaacggccgtcccgtcgacccgtctgatcagttaattaatcagatcaactctcacttaattggttcttcaggttgtatgcctgtcactgaatattttttttgcattgatccaggaaaagacaaaattggttgatcaatggctcagcagctagcctgcagatccattttgtgttatcactctctgaagagtcagtatatcaatatgtgtgcaaggaacaaaatcctcgattgattgcaggcatgcaactccagtaatgagactgactgttataatatattcaaaattcagttttgcgatgcgtaaaagcaacaatttccattcgaaggatttttttgacctaggtttttctttggaatttgctacaatcttttcattcatagatcacttgagattctttgggtaaccatgacatttaattcaaactagtaagattctgtgctttccaatgggtcatctcatataattagggattggctgggtggatggattgagaataaaacatagactaacctatataattagggataggctaggtgggtggattgagggaaaagtattgaattctatattgattacgtacacataaagggacgcacaacctctggtgcatggtgagaagggaacggaaggcagacgattacacttttaaagtagtagagatatgttcgcttaccatattttgtttaacattttagctaagagtatgaatagcgagcaaataaatatctcaagtgtggagtattccacaaaaccttattgtaaagagaaaatcaagactatgttattaacaaacaagtatgatagaaaggtgaacacaataatagagtccatgctaggtacaataatatgcaagtctagggtaaggccacatttgtaatgcatgaaaattccctactaggattaatgttgtaaaaaccagtgttcggtatccaaccacggaaaatcactggataagacccaaacttggtgacgacaaagagagattcatgatatatatttcttagcgaggttcagctgaacttatatctgtttaaatctgtactgaatttatacgtatattctacacaagttataacaattaatcgttcctgtcatcgtgttccgaacgaggtctaattaaatctcaatggtacttggcttgataagaaagtgaaaatgtgggtaccattaacccaataacacaagtgctaatcatagtctgggagatgttggagctttacctaactataaactctagcagacggcacaacgaaaagccgagatttttcagtgccaatttggattttggagggccgggccacataaaacgaaatctcaaaagctatatatacatagttcgaagaaaacgaaaccgaaaagtttgacgactcacgaagaatcccaaggaggatttgccaaatctcccaacttgcaataaaaccaacgtcttaatttacttgtctctggttcttctgatctgcctatagcaatagcaccattcttttctatcatgtgcacacgtatatgcatactaacccatgcaaattaatagcttattttacatgcaacccaaggtttatttaactgctaatcttgttgattagtcagtggggtcctgtgcctttttgtactggagaagagaggttgagatagagcagcacatatgatccatgccgtgcatcttccgggcacggattccgatgcgtggtcccagccgtggatcgaatttgttgaaaaatataccctaccctatgttgtggagtacagattaattaattagttaacagggggtgctttagaaaacattgttaattatcatggtactatggtagctagagggattagatgtgtagatccactggtgttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagatttgggctatctgcctgtgaatattggggagaacagaatgaggcaaaactaaagctcctttttttttatggatttaagccagtggaggcaaacaggagacaccaccaccactcttttttttttttttttgcgatcagtggaagttagtattatgtatagtttctctaaaaatatatatgtttgagattgtgtggtagagcgttcgacgatgtctatgaccatccgtgtttattctgctagtgctatatataggatgtacattatgcatgagaaagaaaagccaaatgaacggtataccttatctcttatatcaattatttctctcgtaatattttttgttacgtacattatgatcgtctccttggatatgaaaaggaccagtgtaaccggctcaaaaacaaattaaagacgaaagagtctatgtaggaatacataatgcatgggtaagggaaacttttttcccccgctatatcatctctagttaatacggagtcgtgtagactgcttgagagacaatcctttgtaactctttcaagtcataaaagtatgttatttttcagaggcaagtataggaatatgcaataatgcatgggctaagggaaacttttttttttctcttgtatcatctctagggaaccggatcctctgatgtaaggaaaccaacgtcagagggcagtagtttcttcatccaccatccctaaagcatccaacgcctctcttgcttttgcttcattgtggggtgccgcaacctctgttctctcgcgcgcgaaggtgatcgattcattgagacggctatcaaggaagcggtcactgtcgccgagtcaaattttcgtccttcacatccaaaccggattaacgcagcctacgaggacgacaacagcccgatcttgtacgatttgccattgttaagtcaagtgtactccctccgtcctataatataagggattttaagtttttacttgcaacgtttgaccactcgtcttattcaaaattttttaaaattattatttattttatttgtgacttactttattatctatagtattttaagcacaactttttgatttttatatttacaaaaaaaatttaaataaaacgagtggtcaaaatttacaaacaaaaactcaaaatcccttattatgggacggaggaagtatatatttgtgtgcaggtctccgtgtggcgatcaagtgcaagaacagcgctgacggcgagtacgagatgaagcggccgggaagctcgacggcgccggcgcattcagcgtgccgctcgccgccgacctccgcggcgccgacagcgtggctcagctccacagcgcggcgaaacataacgcggcatgccccggtcaggagccgtcgaggatcatgcagctgtcggagagaaccttcgttgccgtcgccggcaagacccactgcacgtcgccggtgtgcgcgtcggcgaccatctgcaagcccatctgccagccgcgtcgtcgaccaagccggcgcccaagccgcaccctggccagccgccgcacccaacgccgatgctgacgccgtcgtacggaacgccgagcccgtaccactcgccggcgaggaactaattaattaatgccgtcgagctcacacattattatgattttttttctgctctgcactagcttaatgccatttatgatttattgttgtcaaggttggagtagcgcagatagcttatgtattcgttgatcttgagtttcttgggtcgatcgaataaagttccaggttgatttgtgaggtttgagtcaatacaggttgatttgtctcaggattcgtttgcttggcgcttcctcgctcgccgcctcgatgaatcaatccccttcacgcgccagagaacagagattgtggcaccctacaatgaagcaaaagcaagagaggcgttggatgctccagggacggtggatgaaggatgaagaaactactgccttctgacgttggtttcctaacatcagaggatccggttcccatctctagctagttaacatggagttcgtgtagactgctctcgagacaatccttcataactctttcaagtcaaaaaaaaaatatatcgttctagatgtaagtacatgatcaagctaacaatgaaaagattagttttttcaaaacttcaattccaattataatatagtgaaattctgttaaagacagagaaagctatatattgtactccctacttctgatctcaatgttaatatagtgcaattgaagactagtagctgtccggtcatgcttaatttctgtcttaattacggcgcgtgttgcttgtcgtccatggacgcccacatgattggactgatgaataattgacacaaagcgatcgatgttgcacgcaacatatgcactgatctatgaacacacacacataattagggcatgtataaaagtcactgatgtcatgttaggttgttgcaaacatgcacagatgcacatatagagttgagaaaatatagctccatgtttagaagcaaatgaaccatatgcctatataatggctaccaatggttctctctttctatggatctagaccatatggaaagaaaactacgtacagaagatggtactacattatatatataactatatatcattatctagctatttgacctcaaaactttggaaaagtaatggctaccactaataagtttttacactatttttattgtcatagctctgaaaaatacacattgaaaggaatgtatttattttttctttttgctagccgtccaaaccgtgttctcttttccgcttaaaagttttgtatttctctctcttttaccactattctgttagcactcacttctcttttaccattatcattgatcaatgttagttgaccattagatttgcccccaaaggcctattattcccttatgaaactaaaagtcataacaaatttcaaacaaaaaataaggagatatagttttaatgttgttagttttaaaggttgtatgaaaatgtatatattgtaagaaaattttcagttagttttaaaggtttttatgtgaaactttaaaataaaatatggaaaatagttttcacatataaatattaagtagttgctaatattgtaaaaaatatatatattaaacatgcaatgcagttaattccctactataaattatttaatgaaacatttgagaaccgaatgattccatggtgcattgtttttgaaaaaaataagaaaaataacatgttcaccaatttaatgtttttaaaatcaatatactttaggtagacaaaatttaattatcctttttttttgtactcgttaaaaattttcaaaggaatgtttaatgttggaatatgcacaagggcataatggtctattaagataaagttaactgtgctcatcagaataaggcatgcgtatgtacgtttataggggtgagtgtgcgcgcgttatggttgcttgtgttagtaatgtgttactaagaaaaagaagttaaatgtcaactactccctctgtttcatactccctccgtcccataatataagagattttgagttttt

SEQ ID NO: 8485 - DNA, 6989 bp, Oryza sativa
  unsure (1)..(6989): unsure at all n locations
aaacaaaaactcaaaataacttacgttggacagagggagtatgaaacagatgaagaatcattggcttagattgagttcgggagtgggttggaaccctcactcccaacacatagagcggcggttagtgcatgatttattaagtattaaccaaaataaacttgagaaatggattaatataatttttaaagcaacttttctataaaattttaggactgaggtagtacgtgtgttataaaaattttcttatagcaaagttgagtaaaaagatcttattaatctaattttcaatgtttttaactaatacttaattaatgatgcactaatgaactacctcgtgctcgttgtcatggggggaagttatgaaccagtggattcgatgtcagccttaatagggatggcaaaacaaaagggtctgttgggctacttggctgcagcgctgctgcagcgctgtttcacacaagccaagcaagcagccggctacagctgtggctgccacagcctggctacggaacacacccaaaaatgcacactaacgggagaatggtgaaatgaataagtgcaaattaaatttcacccaaaaaaaagaatattgtgtgttcccttatgtgagctgaagaccgcatcgatcatcatccctagttattatatattaacgcacgcaagcatgcatattgtgtaagacaaaagggaagctggatagcatatccatgcgcgcatgcaaccacagcctatagctagctactcccttcgtttcataatataagtcattctagcattgtccacattcaaatagatgttaataaatttagacatatgcatatgtatatattcattaacatttatatgaatatagacaatgctagaatgatttgcattatgaaacggaggaagtagattagaatcatctttactagattttcaccgtatgccctaacagtggtttcactggcgcgatcaatcatgcaagatgcatatggacatgtgccaacactcgttgtttcactcctagtgcttcatcatgtgtacgggggtcaatattttccaccataagagccaacagctctcgacttcggcgtgcaccatggtcgaccatgactgggtttacaactttacataccaaggaaaactggccggtttctgcgaaaaatatattttctaggacggctaaaagcataaagcgttgggtttttttattaagtttgaagtggattttaattttttttcttttacgaaattcggtcagattaatttcaccgcttgtcaatggtttcataaaaaccaatgttctaaacctctggctatagcggcaaagatggagaggggaacaactaggatacttcaattttgatgctaagatttatcggccgctaatagttgtacttagcctctaaattaagtatgaattaggaactatgaactccacgtgtgaagtatgaattatgaattggtgatgaacttgatgtgcaaatcaagtgagtgatcgatatgctaacttttagcctaaattctgtcaaatttttgaactttttcctaatattttcgacaacagctaatgtcttagctgttggagagctcaaccgctaagaggcttagccggagatttagaacttgataaaaactagaaaaagccccttgactaagtttttgtgaatggttaggtgttagctagtagaggttgtcctttgtccttgttccatggttgttagaaagcttcctaagattttgtgaaaatccgtttagtttgagataatagatcatatatatgagttgaccgtagtaaaattatggcaaatatcacctttgatcttgatgttcgagttacatgtacatgaatttacatccactgaagtttaaatcctaacgtctatacttaaatagttatgtatccaatctctcgagttacatgtacatgaatttacatccacttaagtttaaatcctaacatctatacttaaatagttatgtatccaatcttttacagatgataaataaagctcttaaaaatatgtttgatagatagagtagacatagccacccatccaatctaagggagacttctcaagaataagaggaacatgataactataagctactgtaatatattaaaaatggtattagtattaaaataaagtttctcttgacaatcgatgacttgactgaacccaacgtgccattcattaaacctactatctacacaaccacttcttttctggtttcatttattagaggagcctagctagataggcacaaatgttagcaacgaccccgatgattcatttctaaactagctagaattaagcatggtaacgacatgtaaagggaagacatgtgcacacactcacgatgtatggtgtggcgtgccctttacacgctcaagacaggccaccgtaaatctataaccctcacaaaatccccattaagagcacatccacgtgtgcgtaattatatatatgtatatgtttttttaattgtgtgcgtaattatagatatcagaatttaaactctactgagtatacagggttgaacgaaaacaggacaaaaaaaactgactaaccgacgcgggacaaaagctatgttgctgaggactaaatcggtccatttcatccaaattcaaatttgaattttattttttcgaagaactcatataaattcctaaccaaattaagaaaatatgaatctaaatgacttgtttaccgggacagaatggaaagcgtgagaaaataaagaacatgttctgatgggctgtgccgtaaggccactactgaactgcaaattgcaatatgtaagcccatttatgtattggtaatagctctgcaggaccccatttatgttttgaactgcaataagatcgagtataagaccacgcgcttgaaccttataagaagaaattatgggtgtgttggggattgaacataagacttcagggttaaaaccacataccacttatcgatgaatctctacaagattaacctaacgaattaaccaacgctggagccgatgttaaacttgccttctccgttcagtttggactaatcttgccgtttatttccgttaggaaaatcgtttattccgatcggttttctatcgatagccaacaagcagaacgagaaaattcaaactcgaattcggttttctgtcgatagccaacaagcagaacgagaaaattcaaattcgaattcgaattttagtttgcgaaaattgatccaagtcggaggtttttgttcggttttcacgaaaacaacatttaaggagctgagtgaatagccaatatggtcctaaagtttcgcttcgggctcaatttagtcatcgatgtttcaaattgtccaaacaagtcctctaaaataattatttgggttaatatagcctttggacccaaaaaacgccacgtgagcatgccaaatcatcctcacatgcagcggtataaatgaaatatcattctacccttatatatcataattaaaaaaaaagacacaaacagaaaaaataacaagccagcctaggcccaacattgttgcagagggtgaacgacaaaaggaatttatacaatccgtggttggctgcagcaatcgtaagtgacaattctaaaacgatcatacacgtgcgaaatatttaccttctttttttttctttcttttctatatggtatataagggtagaccgctgcatgcgaggatgacttggcatacgcacgtgtcactttttatgggtccaaggattatattaacccaaataattaatttggaggacttgtctggacgatttaaaacctcaatgactaaactaagcccgaagcgaaacttcagggcccatattagctattcaccctaaggagctttattaagtcctggtggttaacctattgacctggcaaaatatattcccttaaaaaaactgggaaaatatataaaagaaactgcggcctgctgggctattttcttaggcccacgttaacagcattcacggcccatgcatctccgaattggaacatgactaattgtaacaatgataaaaataattcagaagcattcatagaaatatggttgatagcccctccgtcccattttaactgcagccataattttccatgcacaactttgatcgtccgttttatttaaaaagtttttaaaaaaagtaaaaaacaaaagtcacgtgtaagtactattcatgttttatcatctcacaataaaaatactaattataaaaaaaatcaaataagacagataatcaaagttggatacggaaacttatggttgcacttaaaatgggacggagagagtatttaagagattaggagcgcacgatcggcccccacaggcttctatattgtgaaatgtaaattgttgtaagagtaaattgcattagcagtgttatgaaaatatatgcacaacggagacacgaatttttacgtggaaaacccttgcgggaaaaaaccatgggcgccgaccggcaatgatcactatagaggaattggatacaaacgcaggggatacattgggctatcgcaccctccccgtgcggcttacaagggatatatatagcagaaatctaggagtcctaataggaaactaatcctataaagtagagtcatattagataactaatccgaatatattgtgggcccgaaattcggatcacatatttaacaatctcctccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattgggaacaaatcctaaatttgctggtatgacattgtggaacccagcagagacgcgaaactgatgtacaaacttcaaactcgccatgggaataaaatcctaaatctgctggcattaatttctggaatccaaacagaaacgcgaaaaattcttgtgcacaaaaacaaagtacttagatcccctgataacctcttggtatgttgggtacaatggtagcagaattcgccggacaatttgatcaccttgtgatcttgacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttgtcaagccctaacagaaatgcgaaacactctaggtgcataaaacgaagtatttgatctccgtaaaaaacctcctggtagacttggctttgtgaacatagcaatttggaacgtgaatttgtgttcccctgaacagaaccaaaacaatgcaaggcttaaatccctggtacgatggatatgtgcacgcaggaaaaatccaacgtgaaatttaattcacatgaacagggcaggaacggtggcttccgcttcctgactttcttttctcccgacgtgggcgtgcgctggtagattgatctcctgagtcccgacgtgtgtatgacgccggtagattggtaggtggacgccggctgctcggagtcgacagatgaccccgctttaaatcggcgagacgacgcgacgacacgcgcctgctgccgccgatcagatgagatcgatttcttcgatcgtggaatcacgccagtgaccaggacatcatatagatcgatctgatggatggccacgaacccaacaacgaagcgactatagatcgaatctccaatgctctgataccacttgttatgaaaatagatgcacaacggagatacgaatttttacgtggaaaatccttgcgggaaaaaaccacgggcgccgaccggcaatgatcactatagaggaattggatacaaacacaggggatacattggactgtcgcaccctccccgtgcggtttacaagggatatatatagcagaaatctaggagccctaataggaaactaatcctataaagtagtgtcctattagataactaatccgaatatattatgggcccaaaattcggatcacatatttaacaagcagtacatatatcaagtaggtataatttagtactcaaacttgtaaaacacttattttagtgtatgtacatgtttgatgtgtgcgaaccaagatgaaaaaacacaaaatggccaagcttaccaagttagaagttggttaggacacgatgtatacaggcatgagacatgctatatttgtaaacttgattttcgctttattattgtcagttctacctcttgcataatttctttttttttatttttctccgtgcactcttaggccttattaaacatttttctgaacaatgtatgtctatgcggctctctcctcacttacatgttaatgtaacatcctaatcaacacttaaattagcaggattagtcttgtttgtgtgttctttggccttggttcacatggacctggcaagttcatgtaccaaaatgagtgttttactagttcatgtactacattacatccatctaaagtttgtgtaccgctagtgtaatttactcttgatgcaaatcatgggtagggatgaaacgaagcggataatttccatctgctatgggggaaaagaatactgataccgttcagagtggataattatcggatagtccggatacagatatgaatacagatatattttcctggatatgaatacgaatatggtgtcgaggctttcgatggatacagatatccactgaaaccatgagacatactcatttctttataactctaggacctttaatctacctttttagattttaatagtagccaatctcataacattagtccacactattaatattatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8486 - DNA, 300 bp, Oryza sativa
ccttggaggcgatcttttcgagcatgcggttgtgccgcacgccccccctgaacgcgtagattaccgcgtgtgcagggatgcatggtatggtgttgcggatttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgg

SEQ ID NO: 8487 - DNA, 655 bp, Oryza sativa
  unsure (1)..(655): unsure at all n locations
tgcacggaaagatttttcataaatatacccgtcccncggggtaaggacgagagactaaatgttagttcacaaaaaacacgggaccgacgatcacacggtatggtcacgcggtactgtagaattgtcgcgcgacaccgcggcggtcccccggctcaaaaacgcgccaccgtggtggccaacggtagcgcacggcaccgagacggtcccgtggctcaaaaacgtgacaccaacacggtcccgcaattccattgcacggaaccagctctgtgaacagtagcaaagtcggtgtctctattgtgctaaacagtgtcaaacagcattatatatgcccaccttacgcatgccacggccggtgccgcgcgaccatcccgcgagaccgttggttccgcgattttgcgttgcggcatacattcggtctcgtgttttcaccctgtgggatagatatatttatgcaaagtcttaccgtgcaagtatatacgtaaagttattaaaaataataagtatattcgcaattctttttcttaggctgctagctacccttcatcctcattcctgcaactgcctttccgcttgtcgtcgtgccaagttcctggattaaccggtttaaccctatatatgattaatggcaaataaagaagggttaattggatccatg

SEQ ID NO: 8488 - DNA, 505 bp, Oryza sativa
tttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctcccttcttcctaggctgcgcttgctcactgggctaggctgcccgcagggggaggggggaaggggtggtaatcacgccctgtcagccttaaccctaggcggtcgcacaaccgacctaggcccagggctggacctaccttcgcccactcgttgacgccacccgcaaccaccacca

SEQ ID NO: 8489 - DNA, 1632 bp, Oryza sativa
ttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttgacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataagactgtgaaaggctgaaaaaattttatgagataataaagaatatatactcagatacatcgactaga

SEQ ID NO: 8490 - DNA, 700 bp, Oryza sativa
aaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactaaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaa

SEQ ID NO: 8491 - DNA, 940 bp, Oryza sativa
aagtgtgcttgcgggtggccggcagcttcaggcacatcgacgactgtcagaaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacccaaatcacatatgtcgagcaagttcatgaatataaggtcatatatggaccaacacaa

SEQ ID NO: 8492 - DNA, 1035 bp, Oryza sativa
agggtgtttatctgtccacgaggtactatatgtaggttcagctgagctatctcctccctaagctcagggatcatcccttccattctcagatgattgcaatggctcttacgactcagagcgtcggccacaacgtttgctttgcctgggtgatagtgaacttctagatcatagtccttgattaattctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcacgggtagggtagttttcctcatgtggttgcaattgtcgcgacgcataggccacaacttttccgtcctgcatcagtactcctcctagtccttgccttgacgcatcacaatatataacgaagtctttcctgatgtcgggaagaactaaaataggcgccgaggtcagcttttctttgagctgctcaaagctttcctgacactgttctgaccacacaaacttcttttccttcttgagtagttgtgtcattggtcgggctatcatagagaacccttcaatgaaccgtcggtagtatccagccaagcctagaaaactccgaatttcagtcacagatttgggtgctttccattctgtgacagcttccactttagcaggatccactgctactccaccggccgagattacgtggcctagaaaagcgacttcttttaaccagacctcacacttgctgaattttgcatataacttatgcttccgatgtttctcgagtaccaatcgcaagtgttccgcatgttcttcctcatctttggagtagattagaatatcatcgatgaataccaccacaaatttgtccaagtagtccatgaacactttgttcataagattcataaagtatgccggagcgttggttaaccccaacgacattacggtgaactcatataatccatagcgtgttgagaacgcagttttgggtatgtccccggtt

SEQ ID NO: 8493 - DNA, 94 bp, Oryza sativa
ccttcgggccggcccggcacggcccgaggcgtgttgggccgtgcctgggccgtgagggcggcacgttttgctggcacggcacggcccggtgcgt

SEQ ID NO: 8494 - DNA, 824 bp, Oryza sativa
gctgtatatggagtattctttcaaaattcctaattttttatttttcaatttcagttgtttcaaaactatattcttacttgaactctcttagtttttaatttcagatcttattttattttttattttgaattttaattaatattgtattgggttcttatatggactctttatttgataattacatatttttaatttcgaatttcagttatttttaaattttattcctacttaaaatcttctatttttttttatctccaattaatgtgggaatttgtagccccaataactatcgtgatacctacttttataattttcttaatagtatactacatagagataatagtatcaacaagcatgagtgtcgtcatctggagtagtgtttaaggcaaaatatcttttgaacaaacatagtacgggtctagggcaaaatatctaactgaaatcagtattcataataaaactctagtgaaaaccatcgtcgtcctccactcctccccagtccacactatatatagaacagtcatacatatatatatcacaaatttggcttctacctttcgtttggtcgatatgcaggtcatccaagtagatccaagcggtgtttggacagggtctgagctgtttaattgtcatcctaacagatcgatcatcagctgtttaatcaacgcctcagctgctatctgatcgattaatttgtatatttttgtcgtcatacagatcgaccgcttgcatggggtgcagctgttgccgatcgagctagctctgctgcatgcggtccgcccacgcctagaattaatgtgcagcgagaagtagctctactcttc

SEQ ID NO: 8495 - DNA, 3736 bp, Oryza sativa
acgctcaagaggaagggaacataggggagaggaggggctccagggagtagaggggccatgggaaagcgggagcgagtgcaatgagagggagggaggcaggagagaaggggtgccaaggagaagaggggctgtgggagagggggagcgcgtgcagcgaggaagagatttggggggggggagaaggaagggaggcaagagaggaggggcgccaaggagaacaggagccatgggggagcaggagaatgtgcagcaagggagagatgggaggtgccggtagggggggaggcgaaggcagaagcagaggtgcttgggagggaggggatcggacggacgaaagagaaggcggaagctttacgtacatagattaattagcggaaaaaattcgaattactcccgaactatcacaagcaaccgaattacccctaaactaaataccaaacattttacagtcaactattcgagccagacaaatatttatttgactccatccattcttattttggtcctacgaggcagcaagtagtcaacaacttttttaaaaaagaatcgggggaccaacctatcagattccctcccctctcacctctctctatcttagcttcctcattccccaccttctctctccctcttctcccctagctcaagagtgcggtggtggctggcccgtcaagctcgccggttgtgcctccatctcgttagcacaataagcatactgccattgtgacactctcccacacgagctcgcccgatgcctgacggtggagcttgcgcagaggtggagcccaacctcgcgtgtaggcggcgacaagactggcgatgtctcaagctttcttgctctcaaggaggctggtgagcttggctcctcctcggccttcgatgtgatgaaactcgcagtcaccgcagctcctcctcgatcttcgcgggcacgcggctcctcctcagcctctgttggcgttcacgtgttgaggctctagtaatatagaacatcaccaatgggacaaattataggtgccgaaaattgtaaaatcaacatctatagacattttcccacctccacaggatggaaaaatataaaccaatacctttaaccaactatgtataccagttccagagaaaactggaccaatactttatgtgcttattttgtaaaaataccaacaactttaatatattataggtgtcggttaaaccagaatatataatatattttaggtgccggtctgttaaaaatccagcacccttaaaattcgagtcacgccaatggttgggagcgagctaaaccagctcctttcgcatccttatcctctcacgcccctcgcttccttgtcctctcatgcccgcgcacctcgtctcatcgctctctcaccgctcattctctcgtcgcctcctccccttgccctccccttccccctcttggtatttgttacgcacacagataaattcacaagagtattccaagcgtatcgaacagaaagaacgtgtgtatctcagaaacaggattaaccatcacaacaactaaatgataggcttaggacagagaatattcctatggatttaaccaaggtaaaactctatcgaatgctttgggcaccggcccttccctagtctactgacaggctgagttcggccttgaactctattatgactgtcaccacctgctgcctacctcactttctgtgaagcacacaataaatgaagctaacctctaccctaaacactacgtctaagctaagcaaagaagcaaccttttcgtttggtttttgtttaagtcataagtcactcatacactattaatccaaaggctaggttggagaagtttttttatcttatgtgcggtacatgtataaccacaccattaaacttaatactttatatccattggcttataagttatataaaccaaaaaaactgacttaaaaaccgaagccaataataagtctaagcctaaacaaagagactcttaaaaaaaaccaagttaatatggatttactttttttatttattagtgatttcataatgactttatcacttttttgactaactatacttcaccacccagctgccacattatcaaaacttgactggtgtagtctaaagataaagtacggatcatgttgagagtttgcaaagtattactaaatgatttcacaagtgaatttcaaaccaagatcacgtagtttcattacaacggaacccctcatatatgatgggcggtaacccacatctgtaacgggtatatgtcccatctattctcatttgtcagtgacaaagaaaaccttatctatgatggattccataagtcatctatacgtataagttatgtaccgtcactactagtcatgattttttttaattttaaagacaccaaaaatccctaaaagaattttaaattttactaggtatctagtcgtggtcacgcatcactaaccataaatctacgatctttcccgattgagctttgagcctacttggtgtaattccaaaacttcctcttgtataaaagatatcaatacaaactatcggtagtcaaaactaaattggtgctttttgtcttgaatgaagcaagcagcttctctcatgaattcatgttttaaaacggtgaattaaaaaaagctagctactacatgtctacatctactaggaacagtagtattattactagcagacagataatagctttattgaaaagcattgataaggtcttgagacttgagtaggtcaagcacgatgacaagtatatattgacccataaaaatatctttctacatgcaatgcatcctgtgctaatcaaaccctaccaagctattcgagctcgagctcactaggtttgcgaacctcaacctatgcttaagtttggcttgtctgtagcattcgagtcgtgctcaaattaagctgtaacaaatcaaactcaaacagattgacagccctatctgtagctaccacacttgttagaaatgtcctgtcatctttgatgacgggtcacaactaacacccattatagatggattcacttctaatcttctatgactggtatccacatatgcatatatcaaacgtacgggctacttttagatccgtccgttagatattagccatttgaaatcggtaatattgatccatcacaaatgacctgctgtgcgttcacgaatatgtgagtgtttaggaacaaatatggaatttttgtcccgatatgtacttaatttagtctttcacctttgatacatattgataatcaggggtgctattcccttttatttaggataaacaaattagagcacagttgataattggaaatatgaatgaaacattgatcggtattttctttgtcacaattcagcgacaactttattttattatttataacaattggtagcaatatgtgaactatatttagaaaagagcacctgttgtaataaaaaagctaataagcgcgcttctcggatgaatacttcttcggattttacattaaagagcacatgagctgtggttttcaattctcattggatcatcctatatccaggtttctataggctattgtgtgggtgatgctataacgtgaaaaacaatacgggaattcctgatcatagcgcgcggtttccgattttcaatctgaagtttcaattcctatagcgtacgtttctaattgtcccgtactgtttccactagaaattcatcccaatacactataaaaacgattatttttttacaagaagccctttagattgcaaagagaccg

SEQ ID NO: 8496 - DNA, 866 bp, Oryza sativa
ttcgccatcgcccctctccacgccatgttcccggtgccggcggccgcgggcagcttgtggcgagaaaacgacggctgcgtggcgtggctcgacgggcagccggaccgatcagtcgtgtacgtgagcttaggcagcttcgccgtcatctcgctggagcagttcacgaagttcctccacgggctcgtcgccgccggctacccattcctttgggtgctccggccggacatggtcggggcgagtcagagcgccggcgccctccgcgaagccgtcgcggcggcggagaagaacaacaaggcgcgcgtcgtggggtgggcgccgcagcgggacgtgctgcgccaccgcgccgtggggtgcttcctgacgcacgccgggtggaactcgacgctggaggccgccggcgagggcgtgccgacggtgtgctggccgttcttcgccgaccagcagatcaacagccggttcgtcggcgccgtgtgggggacggggctggacatgaaggacgtgtgcgacgccgccgtcgtggagaggatggtgagggaggcgatggagtccggcgagatcagggcgtcggcgcaggcgctggcgcgcgaggtgaggcaggacgtcgccgatggcggctcgtcggcggcggagttcgagcggctcgtcgggttcatcaaggagctcagcaatcagcatgatggacagttcatacaagcttaactcgagctattcaatctccgagtgatgatattttaaagaaaaacactttcccaactatagtattgttgttgtggcactgacatgccaccgtgtgcagtcaattggtcatagttccctcttttctctaacaaaatttaacaaatcaattctttcattgtttgcgtttc

SEQ ID NO: 8497 - DNA, 462 bp, Oryza sativa
ctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataaccgtggcatgctagctttatctgttcgggcatacgatgcccattgtacttgttgactggtctgatatccgtgagcaaaaacggcttatggtattgcgagcttcagtcgcactacacggtcg

SEQ ID NO: 8498 - DNA, 1004 bp, Oryza sativa
tgaggggcggcgagggggggagcggcaggttggtgacggggcaggtgaggtggccgccgtcgagccagcgctggatgctgcggcgctcgaaggtgtggccggaggggaggatgacggggtcggtcatgacctccagcgagattgggcagcggaagtcgtccggccaggtcgagccctgctccggcgacacctccatgcgcgttcttggcgtgcgagccgatctgcggcgaggaatggaaagcgtgtgggactcgtgaggaagacgaagaggaggagagtggggaaagtccacttcttccggtggacaggaaacgggatttgctgtggggcggtgagagagggtggggagaccacccggtgggcttaagtaacccactaatctaccctacccccaccccaccccaccccatacggccatacctagaaggcaggtcgattaccgacgtcgtgagtctacatgtggtgtgtccatccaccttaggttgggaagcatgccggctgctggcatcgtgagtctatgtgtggtgagtccaccttaggttaggaggcatgacggttgccggcgtcgtgagtttacctgtagtaagtcgggatgagggaggatgaagcgttaaggttgtgttggaagcggtgggggtagtttcagaagggtttgtttcaatgttgtagtatctgtctgtgttcttgttgctgtcttgtgttttacgagggaatgcgcgtgtcgatcttgtgaaggctggaggatatatcatttttggatttaactaatgctttttggtggtggtgttttttttttggggttcgtttcgacgtcatggtatctatctgttgcagtcttgagctttcatcgtgtgatgaattaaaggatagcgatgttgcttatgtttatcgttgttatgtctatccgctgcagtcttttgtctgagtaacgtgtggcttatttggatttagcagacgatccttgataatgtttgcttttgtctatcttatgatccatacatgct

SEQ ID NO: 8499 - DNA, 36160 bp, Oryza sativa
  unsure (1)..(36160): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctccaaatctatccaaactaaaagaaaaaatagttatattagataacacaaaatgtagctgtagaacatcagtcatacatataaacaacattaatataagtaattaagtagccatgttttcaatcaaaagtagaccgcttgacaaacctttcaccaatttctggcctagaacagacaaagggatgctgacacgcaccatatggagcttaggacgctataatcaggagttcgtcttgatcaaaggcaaaactcatgaagtgtattcacatcatttgatgctacatcatatcgatttgggggtcaaatctactggaaagccacatggagcaccgctcaaacggaattgcgtcatggtggttagctgctcgaaggactcgtagtcgtacctttagctagttggttgcggttgtgcatgggtgcagtcagctgcggttcatcctcgttgccacccaatcaaccactggagccgcatccacgtcttccatcatgctcgcctggatctcgtggcggcggcagggctactaatggatagagagaacatattagagatggaggaagagagagaaggggtaggaggaggggatctataccttttgaagatggcggcagagggtgcgggcggactggacggcgcgatcggcgttgagggcggcagactggacggccgtggaggaggcgggctacccggcgaacggacagcgagtctcgatatgtggcggcgtgacggcgcccgcacgaacctgccgaaactcctgttcgtgaatggcaaggaggcggggcccaggtggtggtggagggaggcaccggcgggcggcggcggcgaagacgggagcggccacaggagccgatgtgagggaggcaccacccggagtggcggagtgggaaggaggcggcgatgaaggcggaggaaatcagaaaatcgcgtggtgggggttgggaggaaatcacgcgattgattttggtgggaggtgggagtgggaccgagggaatgccgagcgacgttagggtgtggggtattgatgatttgactgtagcatgggagaggaatcaggtgggattgatgagatagcgatggacggatgagattagatcagatatgcagatggacggatgggattaactatgttgatttcatctgtaggattgcaagaagacaactcctcctttttatattagtatagatgtcctttgcatgttggatcatttcacaggtgtgtttttttcattaattaatctaacgcaacagacttggtcgaccaaacattttttttccttttttttaagaactgaccaggcaagatcagtagcagctagatctcaccatacacgtctgcaatgcatccaacgagtgagtcaacacatagtacttttcttactatgagagaatgagtcaacgttacatacatttgaccgacctactcttcagagtctttgaccttctacgcgttctacttctactgcttcagttcacaatttcacacctccaaccaacgcctatatatacacaccttcccagcacatctcatttcattcaatcatccatcgatttctagcttagcttctactgccaattgcttggagattgatcgaccatcatctccatcgatcctcgaagtcgatatatagctaattggaccatattccatggcgatcatggcagccagagctctactcgtcgtcgccatggcagcagcggtgctcggaacggcgctcggcgccacctacaccgtcggagctccgagcggctcatgggacttgaggactaactatgaccagtgggtttccaacatcaactttcgtgccggagatcagataggtgattgtccgtgtttgctcaccagcttaaatgtttgagttgaactgatcgatacatgtggcaactttagtataatatctaaccgagctaatgatatgcatgtgtaatgtgcagtgttcaagtattctccagcggcgcatgatgtggtggaggtgaacaaggccgactacgactcatgctccagctccagccctatcgccaccttcaactccggcgatgacaccatccctctcaccgctaccggcacccgctacttcatatgtggcttcaatggccattgcaccggagggatgaaggtcgctgtcaaggttgaggccgccaccggcagcaacccggccccatcaccgatgacccctcgtccacgcacaccgacagcaatggcaccgaacgcaatgccgccaacggctggtggccggcccgtgcctccatctaactcagcaagccagcccgctggtgttgcatctctagttggtcttagtttgggtgccatagttgttggtctcatggccttctaaattagagtaagaagatactttgtgtatctcttcgaaggcgatcgattgattgtgttcgtatatattgattgctttgagtattttctctggtagagtccggctcatattgttatttatatgtaatatattttttgttatatgtaattcatcagctcattaattatgatttgattctattgttatatatgtgttttggcccatcatgactagcgtttgacttcaattttgtcatttcacctaaaactttccttaatccattgaaattaaacaaaaggggggggacaattccatctcaaaagcctgtggcataaatatctataaccctattgtagctagatagaaacaaatcaataggaattaaccatcacaacaacatagaaaccgtagaccatacctaaagctttaccttctagaacatgtaaataaatagtactaacataaatgaattattttaataatatcttgacaatcaatatgtacatatatccagttgtccaccctaatcccagtgctccatcttttccgcccccatcaaacaagaaatttcagattatgctatcatcaaaagtgagttacactataatgccatccttcaattgagtttcaccaaaacactattatcaaatagaggattcatgccagattcatcttcttcccttttacagatttgttgtctctcttgcaggtgaagggaccaagatacccctgtatcggttgagctatatatagagagggggtatccaaaccatgaagatatccctcaaactcccgcactagtgttgcctcttccaacacctacctctccactaccctcgattaattcaacttagcaacctctaagcaaaatatctctaacctagccacctagtcgatgcaacattcatttcatagttctaatccaaccatcattggtcaaacaaatcaaccactttgttggggtttctactttatttttaaagagacatgtatatatagtggtgtcgagtaatagttgcataaccacaccaacaagattatccacatatacataatcaagtgaaatatgtttttccctaaaggtaggggtgtggaaggaccctttttttgcaaaagaagtttattgaaggatcaataaaatattttgcgaattgaggaattcaaccgcctacaatatcctaaggaaaaaaattagaccacccatgttttgttgatgacgtggatgtagtagtagctttgtgggaaagtattaattaatcagctttctctatatcaaatattatatggatttatccatcctttgtgttacaaagggatgcatggacatgtcagaaatgtgtatgtagtatacatgcatgatggaattgtgcatgtagtataatggtgcgaaaatcgtaattggatatcggtgccctccgcctttcttttcattttttcaccacataactttcctttttaagtaagtttgtacaactaaactttatactcttaaagtttatacacccaatgtttgtacacctaaagtttgtatacccaaagtttatacattgaaaatttatatgtccgattcgaatttgaatttggattcagattcaaatattatatagatagaatgatgctatataaaaagtttctacacataatgtataaagtttatacacatcaatattgttaaacataattattgtccctttgtatttttgttttatccaaacgtatttttaaatttgtttttagaaacccacatggtctaagttgggcccatgcatgttttctgaaatagataaaagtagagacatgaggagatttgacaaagtcagttctcacaacactttaattactatattttgtcaagttctgtatttgaagtttgaacacgtatgtagcatttttctttttgttgacggaagtgctttccgaataaagctcatatttgcataactaatcatatatccatgcttgaatggttaatttgatatatgtgcagaatgcgtatacgtgggaaccaatggcatggaaaagtctttaggcctagtctagatcctctaaaatggcaaaagttttgccattttgtagcactttttgccattttagatctaaacactagtagcaaaagttgtcaatttggcatttatcatttgctagtccatagtagcatattgtgccaaaaagtgctttgggaccactccctctctctttctctctctcactttagtgctagaatggcaaaactttaacacgcatctaaacaccaactagtacttttgcaatgccaaaacttttaccaccaaaacttttgccatttgccatttgccatttgccattccaaatagatctaaacatgcccttagttctgatattttccactaacaactaatttaatttgaaccgacgcttgaacaggctactagtctattgcgatttaatttgaaatttgaaagcatgagccaagtcatcatcgcgtgaattcaacacaccagctcgcgtgtgtatatgtgattttttcacccaactaaccgatttagatcttggtcaagcttaatttctagaaatttggcttttagataataataaaatacatcaaacaccagggcccccatctgatgtgcaaattaatttcatggtatatatacttatattactgcatctttttaaacatatgatgttattatttacttttatatatatgacgtttgacaatcctcttaataaaattaattatagtattgtttagtttattgtgttttgtgttatccttaaagacaattcaaggatatataacttatattttatatatttaaattaaatttttaaataaaatgaatggttagatatcgtatccaaattaaagtaaaaatagttacatattaaaaaacaaaaggaataaaatttagtcgccaaatcgaacaacccccacccaccacccacgaattcttgcactacacatcagatgatgattatatgtattacgtacacaaattcaattagataactaatttcagactctgtcaatttgatagtttcaatcaggtgatcattaaattaattcagactcggtcgagcagcagcagtcgatcacgacttttctcacgtgcacctatcattaattaattatacattttcctatatatacgcgcgtgtcagtgtgagcggatcgagtcatacacatttgaccaaccaaagccttagactgacctcacttaacgcgcttagcttacacctaattaactaacaagcacctatatatacacctcctatcatacctcctccccaaatcaaccaagttccatttcatttcttgcatctccaattatactcttgcttccaatttcaacctctcttcccaaccatggcagccagagctctcctcgttgtggccatggcggccgcggtgctcgggacagcgatgggcgtcaccacctacacggtgggagctccggccggttcatgggacacacgaaccaactacgcgcagtgggtctctgctatcaccttccgtgtcggtgaccagcttgtcttcaagtactccccagcggcgcacgatgtggtggaggtgaacaaggccgactacgactcctgctctagctccagccccatctccaccttcaactctggcgatgacaccatccctctcgctgctatcggcacccgctatttcatctgcgccttccctggccattgcaccgcagggatgaaggtcgccgtcaaggtggaggccgccaccggcagcaaccctaccccgtcaccattggcccctcttccacgcactcctacagtaatggcaccaaatgcgatgccccctacgaacggttgccggcccacccctccgtcaagctcagcaagcaagcctgttggtgttgcatctctggttggtctgagtttgagtgcaatcgttgctggtctcatggtcttttaaattagagggaaaaaatattttttttctctcttcaaagttgatctattgatcgtgttcatatgtattgattgtttgtgatgagttcggctcatattgttactcattttttttgctacatgtaatttagctcattacgatttgattccaatattatataaatgttcttttgacccattgctagtgtttgacctcaattttgtatctccacctaaaatggagaattccatctcctaagcatgtggctcatgtgaacataaatatgtatatccctattttagttagaaacaaatcaatagcaattaaacaacacaaaacaacatataaagcatagaccatatctaaagctcaacaatattcttttttaaaataatggataaacattggaaatctgccttttgcttcaatagaaatagacaacaaaagatgagcagataataaaaatgagacaccaaactcaaaaaagatatgaacaacttactcaagtagcaatcctactagtaaatctcgatcgaaagttgatgaaaatgtgcatagtagtttctggcatgtaaaagagagatgtataggtttttgtccatgacagacatttgtagtcgtgtcaaaaaccgaaacctatatgttacctaaaaagtatctgtaaataaaatttagatgaagttttgtcaaaaaccatatcatttttacttagtcatagagtccaacataaagcaaatactcgcttttttttcaaccaataccaaacagccagcttccacctatatgatgagagaaactagttggtggtttcaagccaaaggatacatatattacactccaaagaaatttagcataaagctctaccttctagaacatgtaactgaatactaacatgtactccctacgtattttaatgtatgacgccgttgactttttaaccaacgtttgaccattcgttttattcaaattttttgtgcaaatatgaaaatatttatgtcatgcttaaagaacatttgatgatgaattaagtcacaataaaataaatgataattacataaattttttgaatggnnngagagnnnnnnggnngnannnanngnnnnnggcgtcatacatatatttcaataaagtatcttgataatttaaacttatgtatttgaattggtagttttttgttcacaacttcgcgtaagtactatcctagagctgtatcacatatatataaccatgcttgaaattgttttctttttattagtattattattttgagggtcggcaagcaaaatagttagtttgatttatgtgaaacatatgtggagtgtgaatgaatcaatgacactttttttataatggcatggaaaagtactactggtacctatagttccaaaggtaccggttctatatttttgacctacggaggtgggcagttaataggtgtcggttttaaataatccggtaactataagccgatccctattaggggttttgtagtagtgatctaggctcccagcctcccatcatatcaagtcatcatgtccccgttctgatagccggaccttataattcctttagggaagaggtcgatggggaatgggggaagggttcaagcagagaaaaagatccaattaatgatgtttcactatcggctaaaattaagacattataatacaaaaataattttatccttttaaatttgatattgttatctattgccttcgtcccataaaaaataaaattaaaaaaaatacaagatgtggcatatccttgtactgaaaagtatttaagtagaaagataaatcaatctcaactgttggatctgttggatcgtttatattggtgtttatattggtagtacatacatccggttatatatatattcgcgggtacaatttcaatagaattttcataggattagaaattaatttgttgttggtatgcgcttattagtgtatatattaggcctcatttggtagagctacaaactctaactcccaattataaacttcaactctagtgggagctagctcatatagaagttgaggtgggtaaaaagtgtttggctagatttaccagctccatgtcaccacgtgccttgtagccatttcgttgaacacatagagggcgtcgccgtcgccgcacatgtgtttccctgccattgctgccgtcgccgcacatgcgtttccctgctgttgccgccgccgtttggctcgtgcctgtcgacgccaccgctcgccgacgccacacgccgcctaccgacgccgtcatcctgctgtcctagccaccgccgccgacgcgaccagcccaccaccactacatgtcgtcgccgacgcaaacgtcgcttctccgcccgcgctgcgccacaaactcgccacctcagccgccgcctgtcgacgccgctgcccacgcgcagcccgccgtcgtcgagaggaggatggccgtcaggaggatggggaggaagatgaggagagagaacgggaagagaggggatatgaataggtagttcaatggcatatcacgtaattacatgaaaatttaaagggtagtgggtcttttggaatgaagtgaagctgtggggcagaaaaacccagctccacccccgtagtacaaatttgtggagcagctctgctagctccgctctaaaaaaaatggagaatctataccatttggtacagctccagctctaggtaagttggagttgagaaacgcttaggggtattccagctagctccacaagatggtaggctagatgatcttgtttgaagcctcaccccttattgatattaagtcattccctaatattcgtgtcttttctaggtaagttggagttagtagctagagctgtgtcaaacgggtgtttgtgtgtggtgtatgcgtgagcacttggtccatttaacaataaaaaaatcaatcaggtgtttcagacttagtcgagcagacttagttagattgttattactaattattatacacgttcacacacacacgtctttgagcgatggagtcaaacgcatttgacccaccaacccctataatcctggactgacatcacctccactgtctctgcaatgcaatgcaaacaatcacctataaatatactcaaaaccatcatcgattcttgcaaatcatcacccttccatcgatcgatctgatccacctagttgcaagctcgatcgatctctcatctgctctgctaattgatcctaaggcgatcatggcagctgccaacagatcggctctcctcgtcgtggccatggcggcggcggtgctcacgacgacggcgacgggcgccaccacctacacggtaggagcaccggccgggtcgtgggacacgcgcaccaactacgcgcagtgggtgtccgccgtcaccttccgtgtcggcgaccagcttgtgttcaagtactcgccggcggcgcacgacgtcgtggaggtgaccaaggctggctacgactcctgctcgagctccggccccgtcgccaccttcaactccggcgatgacaccgtgccattgacagctaccggcacccgatacttcatgtgcggcttccctggccattgcgccgccgggatgaagatcgcagtcaaggtcgaggccgccactgccaccggcggtagtggcactgcactgtcgccaatggcgcctcgtccgcgcacgcctacagcaatggcaccgaacgcgatgccacctatggctggtggtcggcctgtgtctccatcgagctcggcgagcaagtccactggtgttgcatctctggttgggcttagtttgggcgccatagttgctggcctcatgtccttctaaattagaggaagaatattttttgttctctcttcattggcgatcgattgatcatgttcatatgtattgatttgtttgtgattagtccagctcatattgttacttatgtaatttttggttacatgttattgagcttgcttatattttgattctttattgctatatatatatgtttttgaccatcatcactattgtttgacttcaattttgtcttttcacctaaaatgtacaccttaattagtcagttgcaattaaacaaaagggggagaattccatttcaaaagcctctggctcatatgaacataaatataaatacctatagccatattttaccgaaacgggggatatgctagctaaaccttcaaatatccgtacctataaatccgatgccctggtgctaaccaataataaattctctgtttagaaaataggattaattaagcaaagagtatgttttacattatactgtgtataggccaaggctatagccacttttcacttaatgcaacatattttacaatttattgtaaaattatccttattcacgctgtggatgatgatcccctatccacatcagaagaactatcaactacccatagatctaatgtgctcctctaaattaaaaaaaaagaacattaaatgactaataacagctgtagttatatggtacaatataaacatgtggatgatcgaggaagctaacattgtaactatatattgtgtgtttaaacttacgaaatcattgcatgcatcctgatgaattactctgatttctttacgaagtataaaaacataatttcaacacctcaaacgtgtgttcgcatcgccgtcatgagcaacggatattttaggtggctataattaccatcgaacgatcatcaaagggaagaaaaacaagtttgttcaagctagatcactgaaggagaggatgtaaaacgtacaaaaacagaatgagaatgtcatggaacatattagaacgcgttggagtcaatccaaaattagggcctcgtacagtcgggcaccccacacttgtccacgtagcatattgtgtactccctccgtactcgtaaagaaattcgttttggacagcgacacggtcttcaaaacacaactttgacatcttatttctataaaaatatttattcaaaagtgatacatgtatatttttatgaaagtatttttcaaaacaaatctattcatataatttttacattttcaaactcaacaacttgagcattatttatgatttatatttccaatgtttgacttaaacattatcctaaacgaattcctttacaagtatggagggagtatcatttatactcctttaaaagcctttagtagtggtggcagcgaatctaccaccctattagtgcttttgaattattttttttacaaattgcccccataatattttaaatattatagaatagtacaatattatgatatgacatattatgaattttttttcttctgcctatagcaaagcttgtagatgtgtgttagtggatacattcgtggatatttatatgtggtgtgtgtaactacgccgatgttatgcagctacattatctcgagggggaaaaaacctcctaactattggtagataatcaaattaagaccccatcttgttcttataaaaagacaaaaaaaaaccatccagaaagagaaaattctcatctagaagccagtcagtctacatccatgcagctttgatcatttcaatcaggtgattcagaccaaagtcgagcagccaactcgacgactattctaacacacctacccatcaattaattaattaattaactacactttcacacgagtctagtcaaacacatattgaccaaccaacccctgcattgacctcacctcacctcactcatccctgccaatccacgcgcttaattagcttaatgcattaaagcaagtttaatagtatagctaattaataactctaaattatatcaatctaataattaatttatacaataattaactataaatatataatacatcattaataattggtccacctgttatacacatataacattttaaagtctgtactacagctagttataaatctgtatagtcttctcttttctttcgtctctcatctcttctatatgtgattatagctgatttataatctgtattatatatgttcttagcttaagctaattaatcacccatcacctatatatacacatacttcccatcgtctccttgccatctcatttcttgcatcatctcctcccaattccaagctccatcgatctcctcgatcgtcgatcgtcgcggccatggcagcatcagccagagctctcctcgtcgtggccgtggcggcggcggcggcggtgctcgcgacgacggcgatgggcgccaccacctacacggtgggagcaccggccgggtcgtggaacacgcgcaccaactacgcgcagtgggcgtccgccgccaccttccgcgccggtgaccggctcgtgttcaggtactcgccggcggcgcacgacgtcgtgaaggtgaccaaggccggttacgacgcctgctcggcggcgagccccatcaccaccttcaactccggcgatgacaccgtcccgctcgccgccgttggcacgcggtacttcatctgcggcttccctggacattgcgccgccgggataaagctcgccgtcaaggtaagnccgcccccnccgcccctggcggtagtagcaccacgccgtcgccgtcgccgtcgccggcggcgttgccgccggtgaacggtggccggccggtgacgccatcgagctcggcgagcaagtcgggtggtgttgttgagtctcttgttggtctgggcgttggcgccatggccgctggtctcatggtcttttattagagtgacaagaatgcatgatgagttcttgatttgttctctcttttttttgttctttttggagataccagattcatcatactttatattctttttttcctgagatgaattctgctcgaattgttgtacttaattatgcaattctttgttgaatgtaatttgattcagtatatatattgttggattctattatgtgatccttttcacttgaatccacatcaattgtttaatttatgagatagtagtggaagtcaaggtaatttaattattcagaatcacttgagtaatttcagagatgtcacctacaactatcactatacagagccaatcacaccagcaacgagaaacacccagggttcttccggctaactctacaaagtggtgggctagccggtttgggtttgaagcctcatcccttatatttatttgatattagttcattccctagtatttatattttcaatcacaccagcaacacggtaattatgaaattgccatggatattcatgagaattcttgaattgatcatccctaacatgtgggatatcacaagttgaaaggatgactgactgaatatataccagaaaatcaaagccgccaatttttttctgttgaaaataatgtgatatctcttggctgcgtcccgacccatttccggagtacatgatatactttgcagaaaggtgcatcacataattggataattctctgcttgggcctctgtatgatgcagatgatgacgatgatgagctgcctgtctcgtcttcgcggaagaagcatatctccgttgctatatgccagtgtgtttagttcacgctaaaattagaagtttggttgaaattggaacgatgtgacggaaaagttaaaaatttgtgtgtgtagaaaagttttgatgtgatgaaaaagttggaagtttgaaaaaaaagtttagaactatactcgccataaggagtatggacggaggacataaaattggctgcatatgctcagtgctgttcctgagcacaaactgtagatgaactgctttccgattgcattttgctctggagctccaactttgcccatcggccggtgaacttgcccatgacccaatcaccatctgaatttggtatgcttccaatcagtaacaatttgtcaaggaggagcttcttcagctcatgagagatgtcaatatacgtcgtattgctggatttcatgcccattgctggattggaaattttcaattaggtccctgagtggtgaaaggaaattgggattatactaattgtgaaaactgaaaagtggttttatccaaatgccaaatgagaatcgataaaatttcattctaaatacgtggctatgtgctaaaatattatttggcaccaaataacccttgggcttctccttccccatcttctctcctctcctagctccggctgcccctgtacgaataccccctagcttcctaagttgctcggccatgaaggtagcatcctcgccctaggtcatggtaagggcaagtggtatgatagatatgactatcacatctaaacttatctatctcatcaattaatttttagagggtagctcatacaccatattgtctctaatatgctagctccaatgtgtaacgctccgcttttcgtgagacgttaaaaactaattcagcaaaatcctaatttcaaaaattccgttctttgtgtgaagatctcaattcaatctccatctttgttccccctcgttgccatcaaaatcgcccacctcaaaattccaattccgattcaagtctccgaaattcaatcgcctccttgaatcctcgccaaatacctgttctcgattcccatttgagttccttccttgactccaccttgtgtccctaagaccaagcatcaaattcgaaatccaaatccaaaacctcaattcgaatccactccaaatcagtcttctctgtaaaagtctattttgcctcctccgtgttttggatgggccggatccactccccagcccatctctcccctttgccatctccctcacatgcgctgcacgagccgtcgccgagagaaggatctccctctctctcgttttctctctctcgcgctgacgccgcttccctccgtcgccgcccaaaacctccaccgccttcgctcgttcccgcgcgctcgcgcgtggccgaccgcccggttgccgccgcgtcaagccctggcgtcgcctgcgtcgtgcgctgccgctctgccgctccacgccgctagcttccaaagccgagagaggcagcccctctctcactccctctccctccttaaacttttcccaaaacagcaaggagcagagctccctttctcctcctcctttttcgttttgcccaaccaccatcagcgtcaccgcctgccaccaccttgaccacgcccgaccgccagctcctctccttgaccgtcctaaggtcggttctcccaaaccgacatcgccacctataaaaacccgagcccctcccatctccctcactcgtttctctcgtcgccaatcgcgccttgttgcccctgccctgcagtcgcccacgccgtccgtcgctgaagcaccagggagaccggtgcgtgcgaaggacgcgagaagaggactccgggcaccgtcatcttccccttccctggcccgaggccggagagctcgctcccgcgccgtcggctgctcgtcacaacgcccgtctcggctcggtagtgcctcctcccgttccccttcctcgctctccctcgccccctctagtctgcgtgatagctcggtggcactcccgaacgcgcatggacgccgccccgagccccgccgccgcccggcatggcctcgccgccattgccgtctgctcccggaggccgccgctcgtcgccggccctccttggtactccttcgtcccatccggcgctggaaacggattccttgaaccccggatatgctccccctccttttaatcgaacccccgttgctccggtgaagtttcctccttttctcgccgccggcgtgcgtcgccgcgattcgttgtcgccggcctccctccggcgaatccgatccggtggctcacttcctctcgtccgtcccatcgttccggtgtactccctctctctcgaatcgtcgcgacgagctccggtgaacttggccgccgtccgccgtccatctcggcctcccctttttcctcctcccgccggcccacgtgactgccacgtaggcgccacgtcggcgccacctcatctttgaccgggccaagcctatcagccgccccctccctccatcttcccccccgtgcgcgcagtccacggcaagccgtgcggctgcacgtgggcccgtcaccatccgtccacccggcgcgccgcgcccgaaccacgcacacccgaaaccctagcgcccgcccccgcgtgcgccgcttccaccgtgcaccgcctcaccgacaagcgggcccgctcgggaccccgcgaggtgagcccggtctacccggctccccttcccctctctctccccgcgcccctctcttgggccgcctccctgtagcccgtgccggcccaataagctcggccgagccacgcaaatcctctcgggccgcgccaagccgctcaggaaagtctgattcctatccctccttccttttcttatccaaagggattaataaatcctttttcctttttcataaatcaattccttattccaaaaattccatgaatcatttcctttggtcccgcatgtcagcgaccatcaataatattcttgagaatattattccataaaccatttctcgtgttctagaaaaatccaataaatcatttccttgtccagaaattccagttaagcttccaaattcatatttctcgatccattcgtccgattgactttgttccacttctagtatttccgtaaaattgagatctatttaatggcactattatttagtctaaataggatctttcttttggtcttttgtttaggtttttgattgtttgcgtatagttgcggttaccggattttcgtcgatcgcaggttttctcgaagattcgtgaagctccgtgaagaccttgagctaggaaagtcacctttgatcatcttgcacctataatttaaatctaagtatttcttttccgcaaatattgcatgaataggtttaacacaagtatttcggccgcggcttgcgagatagcctgccggccccaatcctaattgctgcaattaccctccttgaattattgaacacttagacctcctttgtcgactgttgtgcttcgatgcatgggccttcgggctcgagcatcggaacacttcccttcaaatttaaaatatccaacgatgggtaaaacttggggttttacaaaagaattggaaaacccgacacctgggtcggtgcttgcaaactaaatgaatttccaaaaccgcggaccggaggacgttccaggagtacggtttcccgctcttgcacttaaggaccgtttccttggaatttcatccaaacataagataagtacaaccacatgggtggaataggacacccctagctgagtaattagctaatcgggggagccatgatgccaagagacatgtggattcaacggggtggtgccggggagaacccccgggcttcctggcacagtatggtctgggacctaacctattgtcggtctgggacccctctcgttggcatatggtgaacctgtgtcggcttttgaaatgccttgtcgtgaaagccccaagtcaccaaacgtgtctgatccacacgggctaggtgaccaaggctagtaatatcatgtgggtaaagtgtaccccctctgcagaggttattaaactgttcgaacagccgtgcccacagtcatgggcgaatgtgaggtgattcctagcgtagttttgtttgactactgctttgtgaaattgctgttgtggaatgggatcgatgtttggaaaatctatggctgatgggatcagctaggcccgggtggccgtttgaaagctattggccggatgccaaccttgaccaattcaaagaccgatacattgcacatactccgaccggacgagacgcactgtctcatccgtatcgtttgagaagcactcacttagttgtttcaaaaaggagtttaaataaaatcaattgcaaaaataacagcctttcctttgaagcctgcattaaacacttaattcccatggcttgctgagtacgaaagtactcacccttgctctatataaatatatatatatatatagttcctctgtctcgaagagaagatgaagtgaagcgaagattagggttttgtcctggttcccagccgttgcctgtggtgttgggtgttagttcgttggttccgctgctgctactgctgttggtgtttccccgtccgcgtcgtcggttgtattctcaggctgtcctgagctgcaacctaagttaaggtaaataagtcctctaatttttttaaggatttgcaatgattcatatttatcaccgtgggtaccagcactatgtcctgggactggtactgagaacgcggtttcgtaggaagcggttcgcgccgttattcctacgacacgttcctgtcaggtgccgttgtacggcgatgccagattggggtgtgacacaatgcaacataactatttattttatccactcttatccaatcaacctcattctttcttttttttcttaaagtttgtgaagaggttgcccttgcatgagaggtggctcatgctctatcttctttcttttctcctccacctcattatttaagcttaagtggcatcttaggagtttgtactcagatgcttatagtacttgccctaagcaaattagttgttcctcctcatcattaaaagacacaccctaaactgacacaaaaccactaacgcacactcgaaaatagcctcacgaaatccgtgatctcaaaaagatacacagtcctacacaagttcaaacatagcctcactaaacctgaagcaactcactagtctcactaaaatcctaatataaacgtatccacgtgtacgtaatatttgtgagaactaaaatttaatccatgataccaccatcatatcgctggtactttatcatcacattactagtgcttctttatatttgggataagtttgattctctaccttttgttttctgtttatatttcaatttattggtagtaacaaaccttgaaaccttgagcataaaaccaaaaccttacggatttaattatttggtaagtgttggcttcaacctaaagacttgggaatactccaatcggttttagattactttgttaacttttgacctaattattcattttatttaaaaaaattatacaaatacgaaaacgtaagtcatgcttaaagtattaaagaagtatttttaatgataaactaaagcacaacaaaataaataaaaattgtgtattttttaaaaaataaaaagaaaggtaaaagactttttaaaagtaaacaacgtcccctattaaatatcgaatgtagcgatgttaaattttaccaattacagtattacttagtagggcaagttttgcttaaaattaacgaaacagtcgcaagtcctgtatggaaagaccgcgacattagcgggagctaggcctagcgacaattttttcaaagttaactaagcaaattaaaattttggaagtttctagcagcagaattagcttgtcaaagaaagcaagattaaattaagttcatatacgagacaagttccaaaatcttttgagacactcaacacacgagtgaccgggtcctctgaaaataatctgacaatgataattttcacctgctcgatgcgactaagtactagtgctcccttatttttatcatgagaaagctaattgagatcgctagctaactaatgaccatgtggtacacgcatgctgactaattaagaccgacagaatccagcaacgttcagcgaccataatctgcaatcaaatcaacgctatatatgcaccgagacacatatgaatcatcacacgtcttaacaattcccatcagctctcgattagattgatcattgatcgatcagtgccattaattgagtagttcgaatatattcgacatccatttaattagctgcaaatagtgagcttggaaagaatggcattgctcgccgtcgttgtggtggcggcggcggcgttctcgacggcgtccggcgccagctacggcgtcggcaagcccaacggcgggtgggatcttcagaccaactacacctcttgggcttcctccatcaccttccgcctcgacgacaagcttggtaactaattaataatcaccttgcattttatcatatatcctcctaaatgatattaaactatttatatttagtagattttacaacttacaaaaactatataggttatactgctagaatttgctacaaaaatacgtattcttaagaccgtgtcgatatccaaaacaacaaaattgaatttttttttttttacattacagtgttcaagtactcagcggcggcgcacgacgtggtggaggtgaccaaggacggctacctctcatgctcggcgtcgagccccatcgccgtccaccgcaccggcgaggacgccgtcgagctcggccgcctcgggaggcgctacttcatctgcggcgtgccggggcactgcgacgccggcatgaagctggaggtcaggacactctgctcaatcccgtcgccgccgccgccgggcagcgacggcgacggcaacggcacgccgggcggcatctgcatcgacggctcgtcgccgccgacgatcatctccacccccggcgtcgtctcctacggttcagctccgggatcttcaggcagtgccaccactgcacttgccatcatggcagctgctacagtgatgctgctatctctcatcatagtttaattgataaaataaatcatggtttctttagcacaaagtgttgtacatgtcctcatttcttttaacaagatttgtatcgattggttaaattacataaaacagcatacaagacaaacagaatttgggtgataagaaatggtgtatatgatgctactgaatttgacaccgggtgtctgcagagaacaagaatgagcattcttcctttctccggaaaaattgtattgtacattaaaagggggcagtagcctctatagagcgccacaaatgtcagcttacttccatacaaaaacgaactactaacacaagaacaatagtgaatgtgaatcagggacgacgatgcccaaccaatggattgagcaactaagcggtttcaggttacgattaattcacataacgcaaccgatgaagcattacgcgacaggcgggcacgcttcgctgtccttggaggtgtcgacttcggaaggcggcatgaactgccacatcgggtaccccgggtatccaacaaaaggcatcatcagcttctgccccgcggcttgcccctgggcatggtggaagggggcaagtggtgcttgtgggtacggtgctggcatcaatgtggggtgaggcatgtaggctggagttgcagtcagaatcttcacctgctgctctaatgtctccttctctactttcagcttctgcttctcatcacgaagctcgtccttctctgcctgaaattggaagaaagtaagacattagccatgagatatcatcatttcaaacatgagtaataactagttgggcgttctccaaaacatggagcatagatcatagcaggataggacacttatgttccctacagttccacttccacatcttacaaaagctggaaatcatgtgaacaatacatgcattgtgctccacactactatgcagcatcatcatatgattagctaatttatgtgttgccgtattggcaaacaatagcccaacgcaagcatgagaagtcctattaaacagctaaatgtgacaaataaaagaattttagctttaagccaaatgatagattgctcgcaacatcccaaccaagttgtattctaggtcactcaaaatgtgttcccaatttcccatcttagctaaaatgaaatgtatcagccgcaagctaaaaattgttaagaagcactccaatcacaagcttttggataacagaaggttggaatatggatgtaagttaggttgcatcaccttcagttctttaatcttatcttcaagactctcgttagtatcctttagctgcttcgcttcagcacgaagttgaattaccatgcgagtggcatcacttaggatagcagctttgtcagattttactggcttcccaggctccaaagtagtccccaattcaagaaacctaggaagcataagtaacgttacaaaatcagggtcagtctttcttccgaactctagaattagaaaaactaggaagtatgatgtacctatcattcatcttatctcttctgatcttttccctggaagcttttgatgttggcctaccacaagaccctgaccttacactgcaacttgcaatagaatcaccatttaaagaactgacttttgaacacaataaactattataagaacaagcatgctttagcgcaaagtgaaaaagcagcctgaccgtttattactgccaggttccttgaggacataagaggtggtgttcacatagctgcttacttccacactgtaaaaacaataaaaaggacatgagaaccatagcgcaataggaaatctagcctacaaatgctggaaatttaagaaaatctcaaaaaatggcacaataagataccaaaaaccatttaaactcctcgtagctacttgcttgagcacaacctgttaaatttcccgcaatcaattagcgaatctttaagttgttcaacgtagagatactggtcagaaactaaaggccacatgactaaaatccgcaccgcttacaatttattcaggatagccagttaatcgtagaattgaagtgctatcacgacacaagaaaagataaattgatgccatatacactagaaataaccacatctagattaccaatcctggcatgtgttgtacatcttgcatcaaaaacaaaaagcatccgccaaactcgatgaccaggttagccgcagcataattttttttactgtgcgtactaattgccttatctacaaaagaaataataaccaatatagatgaacagatcccacaaacagaccaatataggttctaagatgcatccgcctttacatactataataataataataataatattatgttcccctcctctccacaaaaccaggaataataatctcactaatcccacacaaatccaatcgctccactcgctcaaaccgattccacacaaatccaatcgccccactcgctcaacccgattcgctggacgaactagagaaatctacgcatgcatcggggaggggatgcgtcccacgggagaggacggctaaattacctcgggttgaagcaggacggggatgcgtcccacgggaaggccccgcacgcggccgccgggaggtcctcgagaatgccgcagtcgaggaaccagtcgtccccgctccctccgccgcctccgccgcctccgccgccgccgtccgccggggtaccggacatcgccgccgcgctctcctcctcctcctctcgtggtggtggcgatgttttcgcggattctgacgacgaggagcttcgcctcgcctcgcctcgcgattggagaattttgggtggagattaggagggtgggtgggtggatgacaggtggggcccaccgccgcgcttgcgtgggtggattcgcgtctcctcccctcccttttgtttttgcgagtggatgggagaggagtaggtgggcgtgtggggcgcggcttgcgcttacgtggcgccacgtgattggtccagatccggatggcagacatcccctggttcgctggctacatgttgctgtaaaaaaacctcaaaaaaatatatacgaacatgttgtagtagaattagtgactgtttggtaatgtttgtccattgctttgagagaatcccatttcaaaatgtggtgtttgaattggtattgatgttatgaaatcgaaattacaaaaattagtaaaacgaatttattatgaatgtggcatggcgtggcgttaatcgaaattatatagaaatcggaggaaacatttgatattaggtgggttgattaaagactatattacttattttctttaaaaaaatatagtgatgcctccatgagtagtgtgatgtattgatgtttacagccagtaatgataaggagtaatatatgtttgtttaactcaagtgtcataatcgacatggaattatttatttagttatgtgccaattgcactttgggggctagtagcaaacatgaattaatccagtatattagccttcgttttcactcaggatgttttctaaattgggacgtacaaactagcagcccatggtatgtcgtacctgtaaaattttcacattctaccaatgtatccgagagatggaaacactacatatccaccaggtttccttgccccatactcacacccatcgcgggtacaaaatcgtccccatacccacagtgtgcgggtaacgggtacataatggatacccatataattgacttgtagcatttatagttttgtactgtaattagccatattagacatataaactatcattattttctctagcaacaatgctattaacattaatgttcaaatacgagtaaaaaaattatacacataacataatcaagaaatcaaatactggactagaacaaatgcttaagaggtgaaatgagttttatgttactcatagttttaggtttaatctatggattttttcgcccacgggctagtgatacgggtgggtaaagaacggatccatacccacatactaaatgagtaagagttttcgcccgtcagtagacccatgggtacaagagcatgattagaggtgtcgggtcacgggtccctattgctatctctgccatctctaattcaaggtgctctacaataatgccaattaaatctttgtgcgtttatgcacagagaaaaacagacggaatgagcatgtaaaaaggtcataatatcttttcttatttaatattaactataacctacttgtttctaattaaaaaaagattttatcggctaatttggaattgcaagtgatcattatggatgggactgccctacatatatcttgcggtaagtgatgtgactataatagggttttttaattaggtcaggtgactaattaaattagcatgcatgcatgattatatagttaagtattacatcaattaactttgggtgcatgtcacctatcacctacatatatacgcatctgagtcaactaagcatgactctagcccggtggcatgaacgtaagccctgaggtagcatgtatgagttggattgaatttcatcgagttggctatggtcttggcgtttccatcaacatgttatttaaaatggaactacctactgatcattcgatcagattagaactttaaatcttatagaactttaaatcaatggatccaacctattttaaataaaacaaaataaaacgataaatatgtcaaaatggtaaatctagagaaaaaaaagttgtagctaagtgtagtgtactggaacttagtgtaagtgccctgtaagaacataatcttgatgcaaaattctatggacgaaaaatctgtcacaagtcgcaagcgaaatagtcatcatgttgcgattctatattataggtatgtacatatctcttattttcaatattgtgaaaagagagaggtggttatatgtggtactgattctccacctatatgcatgaatgatatacagcccgttaaatatgtcaaaaaaaatccatcagattttatgcaaaaggaagaaaaagctgataaaaagttgcaactaagcttagcacaaacattccccttcaaactatttgaagatttaagggtcccttgaaacttcttggatctaccattacaaactatcggtagagccaacacaaacaaaataaagatttttctcgctaccaacatctattcaacttttcaaaatctactattccctccgttaaaaaaatacaaaccaaggaggagatatctctcctaatataatgaatttggattgtacttatatgtctataggagggacaacatccccttccattaggtttttccgaggcggagggagtacagagaacatcatggactgaggccctctttgtttaggtttataaaccaacttataagtcaaaaagtctaaacctaaacaaacaagcaactttttcgtttggctttgttgaagccataagccactctaacactgttaagccaaaagctaggtttttttttttttttgcttatgtgagatagatgcatgactccaccattaaacttaaaacattaaatccaccagcttataaatcacataagccaataagctgatttaaaagtctaagccaataaacctaagatcaaacaaagaatacctggaaatgggccatccttatactgtccggccccacattaccgcatcacatgtcagtgagacaaagcccaaggccaaggtacccaaccttcttcctcccgcgatggcagataaacccctcacggcctcaccggcttcctcctcttcagactccaatccaccaaacccaccccaaaacccctcccaaacccgcaaacttcacctcaaattccccccatttttgaacaaatttcctcataatcccgtcgaattcgacctcacctccccatccatggagccgcagctcgccgcactcttgcaacccccgccttctccactccccccatgccttcctccccaaggccacctccacctccacctccacctcctcgtcgtcgtcgtcggcggcggcggggggagaagccctcaagcctcgcccgcgtctcccgccaccgcagcagcagcagcccggcgtctcccaccaccaccacacgcggcggcggagggagctgggcgccgccgcgctcgcctccctctgcgcggggatcgaggcgctggccgccgaggggcggcacgacgaggcgcgcgacgcgttccgcggggcgcgcgcgggcgccccgttcacgccgctgccggcgtccacgtacgacgcgctggtggcctccgccgccgcgctgcgggagcccgggttcgccgcggcggtgctgtggcacgtcgagagctccgggttcgagcccggccagcgcgcgtggaaccgcgtgctccggatgcagctcgcgtgcgggatgctcgccgaggcgcggcaggtgttcgacggaatgcccgcgaggagcgaggccacctggggcaccatgatgggcgggctgatcgacgctgggcgcccgcgcggcgcgctcgcgctgttccgggagctgtgggaggaggtgggcggggatgctgcgccaagggtggtggtggtggccgtccgtgccgtgacggcattggggtcggcgcgtgccgggcagcagctgcactgttgcgttgccaagacagggatgtacgaggaccagtacctgtcgtgtgcgctcatcgacatgtataacaagtgcgggaagcttgatgaggcgaggcgggtgtttgacggggtgcctcagaagagtgtcgtagcgtggaactccatgctcgcgtcgtattcgcttcatggatgcagtgaggaggcattggatttgtatcacagcatgtgcgagggtggtgttgacatagaccagttcacgttctccacgatgctcagggttttttctaggctgggcttgctggagcatgcaaagcaagctcatgctggcctgattcagacagggttacctctggacattgtcgggaacacggcactggtggatctatattgcaaatggggtctgatggaagatgcaaggaatgtttttgagaggatgcctatcaggaatttgatctcttggaatgctctaatagcaggctacggctatcatggcatggggcaaaaggctattgagatgttcgaggagctaatagctgagggaattgctccaaaccatgttacatttctagctgtactaaatgcatgcagattttctggctttgttgaggaagggaagagaattttccagttgatgactcaaaatcaaagaacaaaaccacgggcgatgcattatgcttgtattatcgagctttttggtcaacaagggcgattagatgaagcctattcaatgataaggaaagcaccgttcatccctaccgcgaacatgtggggtgccttgctcactgcttccaggatccacaggaatttgcagcttgctagattatctgctgagcaactgttggcgatggaacctcagaaaataaataattatgttgagcttcttaacttgtatattaactctgggagacagactgaggtctcaaaggttgtcaatactttgaagaggaggggtttatgtatacatgctgcttgtagctggattactgttaggaaaaaagatcacaggtttttctttaaagatagtctccatccacaaagttctgaaatctataggaagttagattcattattgaaggagataaaacaacttggttatgttgctgaggagaatgaattgctccctgatattcttcctgatgaacaaaagacatcgaaagtttaccatagcgaaagacttgccgttgcttttggccttatcagcacatctttgtctactaccttgagggtcacccagtgccatcggttgtgccatgactgccacaaggtaatgaagtttgtaacacaagttaccaagagggaaattgtcataagggatggtagtaggtttcaccacttcaaactcgggacctgttcttgcggtgactactggtaactaggtatatccaactgggtctcactcctgacaatgtattatccttgtattaatcaaagactttgtattgttgtatgaggtattcctaaatcgaacagtttttttccttgtcatatgtgttcttgacttggcactataactagaggtaggagagctataatggaggcttgagtgttttcctttttaatggctatgctgaatgccataaatatgcagcactatttcttgggcaaaattttctttcaccattatcatatgacccatcagcaaacttcagttcttttacacgtttttgttatatgtgattgtataatttgtcagatgtggtatatgttgcttatgttgatgctgcgtaatcaatattgtctattctattgtatgtaagctaacatatattttgctggcagctgctcatttgcagaggttctgaaaccaattctggactggaaatagcatggtttaatgaggacaaagcagtctgttgatttctcaattgtttgtgcggactacttggtaattggtaagtttggaaacttttagtttctttgagagagtaaaattcaagtttgattttcaccgatatgcttgtatgcttatctttctatgagatattttactgtcggcaaaatttctgtgcatatcttgctgataagaacatcatatgcttttatcactgggggaaaagctagcttttgtgatgccctcaatagaaagttatttttctgagcatgatcagatctatatttaccccatgttttcacacgcttcacagaccttctgtaaaagcagaatctgcaaaagtggcctgaatatgtgacagatgggctttcacactggagatgctaatctttacttgtgtcctttaaggaaggaataaagctcatatgtaacaaaggatcaaaggaaagtataatactttcagcatctattgacagctaatttctactcagttcataactacatcatagttggagaaaaattctcctgttctacttttgctctcagctctttattcaccgattaccaataaaaaggggtacacctccttcgttgtaagcaggcaaacaagattgttcctcccataactgctctcagcttatcctgcttccataacttctctcggctgatagaagatatacgtttgagaacacgctgcgatggcaagagcaacaattggggctgctattcttgtctgtgtggtgattttagcgctggatgttactgctggcatactaggacttcaggctcagattgctcaaaacaaggtactattccaagatattatgaaaacaaatcttggtttccatttttctaggtttcacaaagggattttatgacatcgaagttttgcgcaatacacaatatcttttttagatgtattcaatgtatataatgaaagggtttcatgtaatggatgttttcagctattgcaactctatcttccactctaattgaatagtggttcactggttgttaatgtgaaaaagccaaagacagctgacatgcatttctttgtcaattttccactctaaatgaatgatcgttggtgtttcttattggcaggttaaaacggtgaggatgttgttcatcgaatgtgagcaatcatcctccaaagtataccagttgggcctcgcggctgcagtgctccttgtagctgcccacgcagtggctaactttctcggaggctgtgcctgcatctgctctcagatggagttcatccgggcttccatcaagaggaagctggcagcgactctgatagtcctctcctggtaaccaacccctctcttttattgaaaccctcccttttgtaagttgtatagctcggatgttaaatcatctcctttaaggtcatagtatcagatgtaacgtatacatcctgactaaagaaacttccttttcaaaaaagaaaaagaaggaacgaaatttttgtgcttgcagactgacatcaccatggactgttcgatgttgtaacaggcttgctcttattgccggattctcgctgctgctcgccggtgccatgcgcaactccaacccccggagaaattgcagctttgcgcaaggccataccctggatctcggagggatcctgtgcttcgtccatgccggggtcaccgtcgcctactacgtcaccgccaacgctgcagcatacgaacttccttagagatcatgctacgagcaagctgatactttatcacacacgagatcatcacctgatcaccaaccattctttccttcttttttttttcttaacctgttgtttttccattcagtttgtgattcagcttttgcaaatcatggaagcatcgatcgagttctgtattgtgttgaagtcaaaagggaaattgatatacttgtgctttagttacctttctttgccctaggagcttgacattgtgttatttgccacggaaacatgctcatttaggggagaaatgagtttaccatctatctatatgtttacaaattataccatctattatatgtttgcaaagaatatagtaccaacagttggtatagcgtgaattgttattcttttatcaaattatctaagaaaacatagctcgagaggaatgtaaatacagtttattttgtcaaacactttcattcaatttttaaccatttcaaaacaatctttaggttgattatattttcctttttctttacaactttgtactattctgtacaagaaagcaacctcgggcccaccagccagtccaaacagtattaggcccacccatatggttactgagctaattttcttcatgaacgcaacattattgtgaagggaaaccactgttttctttcagaagttcatcatatccagagatgagcaaaggacaattaaggcaacaatcagcttctattatcagagtggttacaaagcaggtctatacatcacacttacaaattgtcatctctccatacaccagttaccagtcaccactaatgctcaaaactgcattctctctatccaattgtgtcatccttgatcctagtatttttaatatcaacaaaacaaaagaattgcacagacaaaaaagaagaaagtgccaagaacaagaacagccgaaaatgttgtgttgtcaatttcagtcagacatctgcaagatcagagacactcccaactgattcttgtctctgatggccggagagcgaagattgaacctcggatgcttccaagtcgacagattcatcgtctgctctacctggtggaggcctccttttgtgatgcttcttgctctggctgtgtttcgccacacggatcagagcctggacaacatctctcattgctgggcgcttgcgggaaactcggcttacgcatctgtaggccacagcagccatgtcgttgagctcctccacatcgaatgcgccttctaaccgagaatctgcaatctcctcccatccagttttgccatcagcattgattgcagcctgatcatagattgcattgtaagtcagcaattacaaaccttaatgttctgagaaaaaacaattcttgaacaaaaaagagtaaggaacaaattcttgaacaaaaagagtaaggaactaagtagggggcttccttacaagctctacatattccattagaccttgttgagggtttctgccagcaatcatttcaaacagcaaaacgccgtagctgtatacatcactcttctttgtgaacgatcgtgaggacacatactctggatcaagatatccataagttccacgtatgttggctccatttcgagtaaccatttcttctcttgataatccaaagtctgcaacctggccaacagaaagtgctcattagtctgagaataaaacattttagtacaataagacaccatatccagtgttatccaagaagtactgtattttgaactaccaacacataggttaataaactaaacttttgcgaatttcttcaaaaaattgcattaatatgtactacgttgaccatgtcactaaactagacgctgacttgatgaataggtgcttaatatctgatggatatcatgatgggtagcagagatgcttcacataccctggcatgcatggactggtccagcaaaatgtttggtgatttgatgtcacggtgaactactggaggaactgcctgcgctagagttgaatgagatcaaggaatctggttgcatttcatagtgtatcatgcttccaattatgaaatacaacagcctaccccatcatgtaggtactccaagccccgagcaacatccagagctatgtttaccctcaaatcccaccggagatgtgcaatgttttcacctaaaccataaaaaggatattaagaaagccaaaaaaaaaaaaaactgagggcacaggttctttcaagaaagtatagcatgctatcatatggagataatgaataccatataagtgcgatgcaaggcttccattaggcatgaatgcatataatagcatatgctgccctttttcagcgcaatagccaaccaaattcaccaggttcctgtggtgcaatcgtccaagaagtaaaacctgaaattaacagtctatcaaataaataccaagcagtcagagtttctggcgcataaagattggcttacctcagtttgaaactccttttcaccttgctttgaattgttagcaagcactttaacagcaagagtttcaccagatgacaaatcagctttataaacaggaccaaaggctccttgacccaatagtgttgtgaaattgctggtggccttctgcagctctctataaagagaaaattatgaacttcagaaagtgtatagtacaagataccttatgaatgtcttgcaaaaaataaaataaaattaatggcacacaattatgtagaaagcaaaaaattagtgataataattgtgttggaagtatcaatatgtgaggcaccaattaccggtaaaatttgagagaagtttatatcagcaaattctatgttcttgttgaacttaaaatcataagatataaaagtctcctttgatgtctaatagttactgacatttagtggtttaattttaccctccttacatttataaattatcagactcattgaagaagaaattacaaatataaaatatgcatatctcgtgggaagtacaattcctacaattaactaaatgtttcctctcgatgtgatttagaaagataacctctgtcaacaaaaatgaaccaatacatggtttcaaaagatttgcttatcaactaaaaagaacttggtcttaattggatgaaaaactattgatcttgaaaaataaaagagagacatcggccttcagtttgattcaccaaaacacctgagtgaggctggatgctatggtcaactgttaataagtgaagcacattttcatcgaatatataactcaattatattgaaattgaccacaataaggtccaacatggttgtccaattcgacatatcatcgatcattacatccagatatgcatatttgacatgttttcctgtcctcacaccagttttctccccatctagaatgctagaaataaatattgcaaaatctcattgtacaaccccctctctataagttctccaggttccactttcctaatgtacacttccactgtgacattcagaaaaaaaaagtccaaaactaaaagaaaagaattagtaggtaaagaaatatgtgggaagtcaaaggaggataaacaaccactaaactttgaaagttaacaggaatcgattaccaaatgtttcagtaataaacaaattgcccatcactaatcctaaaactagatcaattgttcaacatacaaattagtacaaacaaccatgagagtgcaaggaaacatacttgtatgcatatttgggtatcccagaagctgatatcacactcttcctaccaggcccttccagccacatagatgctccgcgatcttcaacctcccttggcgattcctgccccgtagtggagttcgagagtatcgtgcaagcattaacaccattggcgcggatgggaatcgtcgatgccctccttgagctactactccttatctgtgcctgagatcgccgatacctcaagcacagaagtatcccaactgccagcagcacccctatcaccactccaactgttattccaatgatcaggccctcagaaacccctttcatcctccccatttcgccgcagatcttagcaattgagatattgcatccacctcatggaagctctaacagctatgcctgtcctgccaagaagtacacaattcagaatttgccaaaagtctttgaacgtgtgagcatgtgtctccatgcgttaggtggtgggtatttgggtcaacagcaagattgatatgtatatgcaaaccacagatatggaattactagtagtagtagatggaagcagcttactgcttagtgctttgtcaaaacaatctttggtcaaactttgccatcccaactcatgtcacatcagaagatcagaccattcacaaagtatggtgacaaccgacaacactgataatacacgaaactaggaccaacttgcacaaaagaacactactaattggacaggaactaagtcagatattactggtgaactaatctggcattattatcactagaaacatatctgaatgcatatcagaattcccttttgatgcgatgaaaaaaaaaataatcagacacacagatatctctcaaggaaccatattactgtctttcaagcagttttagaacaataacaccaaaaactggaacttattgatagtacgaactccaaaatggcaacctaaaaccaggctccggaacacattacatactactcacagaatcctcatggagtcatggaccgcatcatcatagtggaagaactacaaactacaggcctgacgctggttgtctccacaaacactaaaatcgtcaacgcgaatgcaaagatgccatatctttcactcgcaaatcggaaatacgcaaccctggaatcctcacatgagctcaagaaactcgagaagaaagaactccttcagacagactgacaacgatcctacaccgaaggagcacgaacccacaacagaaaaatcagaagaaaaaaaaagaaccgatgcaataacactgaaaaataaatccaagaaccgaacatgaacagagaactagtcatggcaattgtttcaaacaagaaaaagaaaagaaaaaaaaacgaatccaagaaacgtacgaatgcggcgggagacggggcagcgggtgggcgaatccgtgcttgctcggctcagcgaaaacgcgcggatctcgatcgcgccgctcctgatcggaaatggcggcgagatgggggaagaaatcgatcgggggaag

SEQ ID NO: 8500 - DNA, 8799 bp, Oryza sativa
tagtaaacgagaaaaaaaatatgtcatgcatataccaacgaaattatgggtttttatcttatttcactttccacaagattaaacaaatacatttactctaaaccaagctaagtcataattagttttatatcgcattaggttatgtcgcaggttccctttgtaagacttcttataactttggatcatgttttgcaaaattctatttgaattttcaattaaacatgaaaattgtatagtatgttgatgtatctcgatagaaagtaatatgttcttagtccatccatctcagaatatagcaacctaggatcggattagacgcatcctagtactacgaatctgaacatagggcatgtctagattcgtagtagcaagatacatcccatccgatcctaggttgctatattttggaacggaaggagtactttacacctaatgcacattgaaagtatgctataaattcggctctgttcttaggctgagtttgaggagaagggcattgagaagattaggaagatacgtaaaacggtctgagctattagtgtatgattaattgagtattaattatttaaaattttaaaaatagattaatatgattttttaaaacaacttccctatagaattttttttaaaaaaacacaccgtttagtagttcggaaagcgtgcgcgccgaaaacgagagaaatctttctctctatcacctactgcgaacgctgccttagttctgttctcttttcgtaattgcaagaaaaataagtaaaaatttaccataatttttctttaaaaattggctctaaaattaaaatgaatttgggttataataatttgtaagaaaccattaagtgcttgttggaataatgtaaaatgataactttgaattctattccatttattttttccacctcatttcatccattcactaccttcatatatttccctataccaatctaacatctgatatgatcatatcacatgatccaaacatagttccaacttccaagaccatatagatcacccaattatcaaaagaatcattagattaattagctgccgtccaaagcgatttggcaaagaaacagagagtatacaattttgctatatatttgtcgataaattttctctcaaaaatttaacagatgtaattacagtacaatcgcagtgtaattacactgtaacttgcatgtaattacactgtaactataatgtaacttgtatgtaactttcaaaaatctctccgtaacatgttatttcggtaaaatagagatcgtgggaacaaatcctttcacatatatatgtgctgtgattttttttcttcctcaccagaataaatcttgtaatagatctaacgatttaaaattatgtgaaacttacatacaagttacactatagttacatgtaagttacagtgtaattacatacaagttacaacgtaattacactatgattatactataattacatctgtcaattttttaaaagaaaatttgtcgataaatatataggtggtcccgagagtatatatatcctcgagacatgagctcctgtcagctcccaatgctgccggtggggccacctcactttgcctcatgtcaaattaccaaactacccctgtccgttccggcagttgttgacttctcctccatcttccgacatctcgctccatctcactgacgggtgggccccacagatgtgctgccccacgcgtcagtcacagagatgtataactgtttattggagaatgggccgtgccggcaactccgggaactgtcccatcgatccgattcgccaaattcaactgctactcgtacgaattcttggtacagatcccacgtaacaattttacacactattaggactaatttacgagacgaatcttttaagattaattgctctaagatttgacaatatggtgctacagtaaatatttactaataatagattaattaggcttaataaattcgtctagctgtttacctgatggattatgtaattagttttttattagcgaccgaaccccccatgcaacaccctatataatgcctaatgtgacacgccaaaattttacaccttatataaaaaacaccctcttacacgaatttaggggtgttaatttctctgcagaaacagtacggctatttggtacggattcaacctaaatttgtgtggttggtttaaggtcgtccatcaggacaatatatcgaattattgatcgagtagtaggttttcttctcttcttgtttttttctcctctgaaacacgtttggttggtaacaatatgctggaaagtccgaggtagcagatgggatactgaccaaacaacacctgcctcgatcacttcctccatcttttgtcaagaactgcatcgtgcttctctctccccgtttcaaaatataagcatttttaagtatagtgtcaaatcaatcaattttaacttttactattaataaaaaaatcaatcatgtaaaattaatattactagatttacattaaacaaactatcatatgtatacaactctttttatttaaaacatcttatttttataaatattgttagtcaaattaacatctcaaatattatatagaagtccaaaatacctatatattttgggacagagtgagtattgtactaggtatgtgtgtaggtctatagatcaaatattttgctctgcgaaattatgataaattgttgggtttatttgtaggacaggtgatagaaactagtcattccgcctactaattaactcattttaacagatctaaatttctcaactcaaacttaatttatactaaaactcttataaatgcttatgttctggaactataagtgggttatttgtcttacttatttcgagcttatttatttatggtgtgggtgtggtacatataatgatattttcaattcggtagcatgagttagtcagtctcgtactgtcaatttctttttcttcagaaaaaaataatgcacggccaaattctatgccacatcttccctcgggcaaaaaaatcttaagaaacttctatttttagataatagaaatgagttgcattctccggcatctgcccatggacacacagccaacaagattcagaaacttccataccacaactaaggcatgaaggatttaaaatttaagagggtgaaagtttataatttataacttaaatatgggttgtcttttcttttctaataataaaaatggtatacatctccagcctctaccattggacacagcctgaagctttgccaaccaacaaaacaccctagttaatcaaaaggacttagctagtaaacttgaccttatcaacaaataaggaggaggtagatctagacagaagaaggatcaacaaattccctataaatagcttagatcaatgagtatatatatggtcaccaaagagtgttagcttgtatgtaatctcaattaattaaccaataaagatatgggaggagtatatgtgttgggagcaaggtcacatggtgattgcaagtactcagatgtatgtagtgaccgtgctcacatggccatgcgtgaattgtgtaagccacgcaactgacttgcttcaacatatatacatataaaccaactatatatataactatatgttctcacatgtatctatggttcctagctagtacactttaattatatccataatatgcttgccacatgtgcttacatgcaaattctccaattcgcaatgtgtacataagataagatcttgaaaattatttaattgattgatttttttgccaataatgtttgattgattatctccatcaattaaagtggccgaaataggtgacctgtgagtgtgttcaaatgtacaaggaccatgcatgcctttgcctatatgaagtagtagactgactataagaaaagaatattaatcatcaaattttcatatcgttctttaatttcaaactgatttcccaatttgtgtgcatgtcgttctttcaattcagaaattaattatttcgatccttgtctgccggcagcccagcaccactagctagcaatatatagttagtggctagattaattagtgctttgatatcttttgatgatctgtttgaacaaaaaatatttataatccattggaatttgttgggaaacgatctcgttgcagtttattatcacaaaagctagcatgcgtgcatgcagtggtgcttctagacaagtagttaaactttcacatgaattgtgcagcaaaactgggaattgcaggtttatttcgttgtctgatgatatgatgcgatcacggggaaatgatgaaaattagctagcatcatcagatgcaattctgacgctgacgcttaacgagaaaaaatagattttattagcattcactgctgcactgtagccatgcgtgagcagaatggaatctatgggtgtactactcgatcacacattttgtgtgtaatccgttgcttaatcatgctctgtatttgcttttgtcacgaaacattaattcacaaaacatttttctcacgaacacgcaatgggattgcacgtcaatatataaacagagtttttattacacaacccaaccagccagacagtcgttacggggaccaggaaaaaaaaagaaagaagcagaaaaaactgctagagtaaaaaactacaaaagaaaaggtgttgctcctatatatagaacggaggatggcggtggagccccattacacttccaacaaaccctcaaaaacagcagtgccggcgaaagaccacaaacgaaagagagtaatcgaaaaccctgaagtttcgctccttctacaactgtcaaagagatcaagaggatagggagtcgaaacacacggtcgaggaggataaagttggcatggacccaattgcagcccaactagacagcccaaaatactttggagcacgggctagatttgttgtcctcaagaatgtgtgcataataataacatggagttaattaaggggtttcattttctcataatcccttcatccgtgattactttccagttgcagcgtacgtaggtattgttcacatactcattaatattgtgattagaaaattcatcttgttcaaatataattaataacaatgtaagctcaataaacctcaaagtacaggggtaactgcgaaagagcatgtaaactagtggttacaaaagtcttagtagcatcttaagtcctgagttcgactccttgggagtaattttttcagaatttaacgactttgtgatttcagtggtaggcgacagataagcgagacacctatggtgacttcgtcaatctctaggatggatttgcaacccgaaataacttcagagtctaactataggtagagatgccaaatcgatgaaaaatgaagaaatcggcgaaggattaaaaaattgatctagaaatgcagagaagagattaagaatctctgatatactgatacaatgattaaaatttcaggctatgtgggtattaagtaggttatgcatctgagtcattttcgcgggaattctagtaccgtgggttgtttaattagcttgcagcggaatcacatgcatcctattttttttatcaaaattcatacacacttgtgccaattttttcatatagtatacatatatatatatatatatatatatatatatatatatatatatcttgaaatctcgaggcaaataagcttgctcaagcaaatatatatacttggacaaatcgctactccctccgtcccaaaataaatatagttttgcattgttcatgtccaacgcttgaccactcgtcttatttaaaatttttttatgattagtattttttgttattattagatgataaaacatgaatattactttatatgtgactattttttatttttaaaaataagatggatagtcaaacattggataaagaaacccacggatgcgcttattcttggagaggggtagtattataatttaattatcaccactatatatacatatatatacattgacaatcattttgtacatgacatttttacacaccatatgtccatttatatcaagatattcgattacaagacatgttcatgcatcaattgtgatgttaattatgacgtatatacactatatacaacagatgcaattccatattgtatctttcaacacacacaagtatattaattacatacaagtagctagagatcgatcaccattatttcctggattcatatatataaatccttagtcctgcagtaagtagaaaataatagtctatatatatgtttgatacagttcgccgtcgctctacttttcgtcatcatcgccggccacccgacgccgccgcgttcagaagaggaacgccgccggcgcaaacgccggcatggacaccgccgtctcgatgtgcctgggctcatacacacacacaatccatggatcatcagaagcttgcaaatcatcaatggcgagatagagagagagagaaatctggagagagattgcatgtaataacgtagctagctacctgtattcatcgctgtgtgcgcgaggaataaccctgtcggcttcgcggtcggcgaaccgtccgtctctggcgtcgacgggacgacgtagtttgactcttacggcgtcgtcggcgccggcggcgctgtactcctcgtagatgtcaccaactaaggggctccgctgcgtcgaaccgccaaggaacctggccctcctccgccgcctcctggcggcggcgcctctgtcgccggcggtctccgccgacagcgcggcggtcggcgcgtcgtcgattggtccagcacggcagccgcagggcacgaacgacaggagcctcatcagcttcctgcgcaccctcccctcaatcttgccctccctctcactctctctagaagctctctactctcttaagctttctctctctagctagctaggctttctctctctagaaagagagagagatgtatgctcctatttacaggaatgcccgagtggccagaggctagctacctggacctggagtgtgtgacatgtaaggggtgggagatttatagggtttgcggatgtggcgaatgactgaaatgtcccggggtcggggtctagttcaagggtataccttcagaaagcgagatgggacgaatgccatgcacggaagggagattgtttttctttttggaggaaactgtgtgtaaaaaagcttagttgtcgatgttgatatctagctaggtgttttcttcatttgcgtggtgcatgtatgcgcacctcgtcaagtggctgatggttaggcgtagaggaagtggtgtatcacgtctttgtaccaagcatatagtacaaatgtgtgtgcattattgtggagattgtaggttcgaatatatatgttagcattgtttctacgaacgtatgtgtgtagaaagcaccagggtttctctgttactctcctttctccaaaatactactaccgtcctaaaatataaacttttgacttgtccagatttatagctaaaaatacttatattttaagacggagagagtagttatctttctaggatttaaaatgtgttttaaaatatttattactatatagtactacttgtctcatcaaacgtcaacatttaaatttctttacgttctaccccagccactttgaataagacgaatcatcaaatgttacatggaaatcaacaacatcacgtcttttgggatggaggtagtaacaaattattcatgagaatttttttcttccacgattgaaattcatttcttcctaatccagcctagatggcatactaacattttctgagagccccttccaaaagccagacctaacaaagaacagcatgatatctatatagaacgatcattttttttaaggataatcatgtgcatgcaatgcaatgtccggttgtttttagtcaccgttagacacatttattatagcaaacatttattagaagataataaacggatactggattattattagttgacagaggcagcagagagaatcgcaagcaacaaaggcgtcgctagcatcacacgttgcgcgacgcgatggcttccctgcgtcgccgggcatctcaccgtcatgtctagtctgcatctacttacccgtgagagcaacccctgtggcaaccattcatggcaagctcaggcctcaagccctccaagactcctcccaatgatcgtatcgtcgtcgacctccatcacctgattggtgctgaagaccgacgaccgatgaatcggatcctgatcatgtggatgatcagaatccgattccttcatcctcgcatttgttacaaaggagggttttccacgtaaatcttcgtggtcaggttaatcgcgacgacaaggactgtagatggagctctacctcaggaactgtagatgcttcggtgtacaagtggtcagatattatgctgccacgagcgatcctgatcatgtggatgatcaaaatccgattcctccatcctcgcattagttatagaggaggattttccacgtaaatctccgtagtcaggttaatctcgacaaggacgatagatggagctccgcctcaggaactatagatgctcagcttgggtgtacaagtggtgagatattgtgctgccacgagcgcgcaatggcgaggcgtcgccgtcggtggtgttaacgatggcggtcgccgcccgacgccgcgacggcggccatgggaacgcgtgaggaggcgccgcccaaagaggggaagcatccattgttacaggtgggcaaatcagcaatggtaagaagaagaggcagtcatgaacagtgtagctgcatcagctggcaccaccaaaaacaactcatgatccaggcaataactccgaaaataatgcacaactgaa

SEQ ID NO: 8501 - DNA, 10074 bp, Oryza sativa
aaaataatgcacaactgaaaatctcaaatcaaagaaaggaataaaatgtgttcctgaaatgccagattgtgactgtaggtacaccagtgaagacgccggcatcaagaggaaattagtactgcatctagggcacaggtgtaccaatggtgagaaaaaaagacagggagatgcacagttgcaaaaccacatctggcaagaaaaggataattgcaaaatcaaatgaagtacaagaacagagcgcaatatgtaacaagtgcatgcactgttgatcacgaatgaattgcactctgcacagatcagcttcaccgtcgctgtcagcagatcaggattttgatcaaggaaaattcagttgtaccttgtcatgtataaacgtgttattctgagcaacgagtcattatccagtacatgagcagcacatgccaccagctgataagggctacgacaattcaaatgaaagggtgactccaacacaaccagcacctcatgagtcaggacaagcaagacatgggggtcattattagcaaaggtttgaagctgttcgtgtcctgttgcgcgttgatagtaatattgtttggtccatattcagtttgacaagtgcttctccatgcggaaaccatgggatgcaagcaaacgaccactccaacacgataagaatattggatcggaaactctgttcacacctggaacaatatggtatagcgataaactaaatatagaatcaataacttgtcgatccgctgtgagccccacggccagatagagggccccaagattgtatcttcatctactgtgcaccccaggaactggatggagggccccatgatttgtgtggctgtgagttcatttctggttcctgcggtggtgttctgggtctagcatattcagcaaaaataacccatccatcgagaaactgcatagaagcagagatatatcagaaaaaacctgtgcattatgatatactgcagcaaggctctaaaaagaagcccaaaatggtcaatgatattttcaccagttgctttcagagtatctaaccacaccaaataaacgcttcattttattttcactatggtagaaattagtagactgaaaaaataaataaataattgagagctcagccattcaagaaagcataaattatagcatgagggtcatgtgggcaatagttagtgtatcacatacgtaattttcttacattatgtgtgaagtattgctttggtgccacaagaattcaagaatgaattaagaaaaatatggagtatcattgctaatgaggaaacatacagagtaaaatattttagtatctaaatataaagcaaaaataaaaacaagataccagaatgcaaatttgtattaagattctaaagacagtgcagaaccaccagttcacgatttttgttgaagaaatcagtccaagcatgtctgagtacggttcatgatttgccagttgcaacgaagcaacacaagtcacaagtcacagcgataacatgtaagaaaacaatgtaactattatacttgagcattaaaaggttagcgtataccttaaaaattaccacagaaatttatcaagatatccagcatctagcacaatacaagctatatgaaatgagtgcatgaggctgatatctgtgttcttaagaatcttgcacatagtaattctggattattcacacataattatttttaaaataatgaacatttttttttgcatttttgttcttcagagatgagcacaacaagaaagaatgtgtgcaaaatatatcagagttgaattgtggtgagaccttaggtagttagcaaattgtgctaccaatatcataataaaaaaaacttacacatgaacttgaaaagtggtaacacatgccctgtctgcttgtgcaaaacacaaagagtaaacctgagtgaccacgatgctctcaatttcaatctcaggataaaatgtccagaaaaatgtgatgcctatgatgtccaccccatagcatgtccaagttattaaatagtactactatagtattgcacaacgaacatacgctcacagtttctggtcaactaggatgcaaatatctatacttcggtactgtcaaaatgagatacctgaataattctacaacatatttagtttgaaatagtctgttgacaaagggtgcctaagcaggctccctgggctctacctacctctccaacttgtcctgctttctctgaattccacataatcaaatcaattctgtgtatatattaactgcctatgctccaatacaaaactagctttcttactgtttccgcctttccagtggcagccagtgaaattaggcagttcttgtattaaaatttttaaaatgaggcataacaagtagagaggtaaggtcatatattctgcttattgcatcatgggaactgatcattatataaacagtgagagttcaacacaagagaattgaggaaaaaacaacaaatcctaacaacaaaaatgatatgaaagtatgaaacatacctttccatccattccttctattcctttagctgcatcctcaactgtagcataccttacgaagccaaaccccttagagaatccagtgacacgatctgtgacaactcgagctgcaatttgaaatcagattgaaatagaactcagtgtcttgaaatacaaaggatgaaaggaatggctgcattttaagcaaacataccatgtatgacttccccaaactttgcaaaagcttctttaagcccatctgttgttgtacgcttgcttaagcctgcaaacaaggatgctaagatgggagtccagagattgtgtgcaacaaggctcaacatgcaaggaagcatccaaaatggaacaacattattgaactttaaattgtaagacggtaaaacagggaactggtgctagctttaagtaggtccgataataatatggagtacaagctcagaaagcttgcacacattttgtcactacagataaggaatttaggtcagagcaccataagtagacaaaatttaaataatgtttattaagtgattgtccatttcctcagttcccgcagtgaatttccttgtgtcgagcatgtagaatcaagcaagcagcaagtgtggaaaacgccgaagacctgagcttattgggcatggactcaattgttcgtaaaactaattgaatcaagttccatgaacagaaggtggaggggtacgacgtttgctatcataatctgaaccagcaaatccagcaataggtctctttcaacctaggctgatgtacagctggttcatcagtcattccaccggcgtcctagatccgtcctatatcctatatcctccactaagtaacaaactaatatatagaggagcagtcagtataaagttacatctagaaacatcaaaagattatactaacttcacaacatatcagtatccactatatgtcttactaccatatgatcttatctcccctgattttgctcatacgaatcaagcagcccaaatccatcagacattgaattagtactaacaacatatatatacatactagtatactctaatgttgcttttgaccgcccaaaagtgcaaccaccatgagatcctctaaattaagccatcctagatcatccacacgaccgaatcgggtacggcaacgcaacgggagcacttctacggccgccgcccaagaagagggagagagagagagaaagtgaggcgtacctgagatgaagaggttgggggaggggtcggccttcgggggcggggtggccggcttgggcggggagaaggccgagatggagaacatgcgccggaatccggacctcgccgtagccgccgccgccatcgccgccgccggatttcgaaggtgaggtgagaagctagggatttgcttcctctctcttctttggggtttatgggtttaggtcatgggctgaattgactataatgcccttctctgacactagtattagcggcgagattattatgataatgattgaaaatttgtttctgttgggggaaaaaatctcctcagatgaatttgcagtctgacatgatgtgttgcaatttgcggttataacaatttgataatcaagatgagatttagtcaaatgtttgaaatttttaacattgaatacctctcaaaggttatagttaaaaatggcacgagtagattttgtcttgaaaggtagagtagtgtcataatatcatagatttcaaaaattttgtctatgggtttaggtcatggggctggaatgactataatgcccttctattgatagtagtgttaacaacgatattacttaaataattgaaaattttgtttcttttgaaaaaaaatcctcacatgaattcgcaagttaacaacatattttgattagatactccattcgattgtatacatttgacatttaagataaaatttgatcaaacatttaaaactttgacaactgaatacctctcaaatgtttattttttaaaaaagaagtaaaatggtatagtatattgtcttaaaaggtagagtagtatcataatatcataagcttattagattttataaatctgttttgatataatattgatgattaaagttttaaaagtttgactatttttttctcctaagcattaaatatttataaccagaaggagaagcgttttagcaatttttttgtttcttttatttgaaacttgtaaataaaaatctatttgcagctttgaacttttgagataaacggagagctctggactacaaactaggacattttacatgtttaaagcttccgctatctctctcttggacgaaaaccacattcatttcggttacatgtcatctacacgtcactataatttgccatctcatcacagccttggagatcatgtgggctaccatttcaactgaagaatatttaagtactaataaagacagcaatgaagaaggcataaccatattatattgaagtatgacaattcactcatcacatccacacagcaacagcttttcaatctcacttcgattcaatggtcatcccaaattgcaagtctcaggctctgagcagaacaaatgccaatacaaaggccaaaaaatcaacttcagttcaagaaaactcacatggataaggatcaagaaattccacacacaaaccagcaacacaactactaggtagcagggtaacacaagaaaaatatcactagatatttgagacagtaacattcttagatagatcagaatttccgtcttttgtcacattcagaggtcatagtccacccaaaatatcaagaatgatgatgatccacatgatccaaaattccaaatgcagcctgcatgaatcgcttgcacagctctggatgatattttgggttgaggatagatttgtctgtcagagctttcccgtatgcgacgccaagtggtagaattagctagtaagcaagttctttctttccattacgtggatgagtgcctgcaaaactgacctaataaggattttagatcaattacacaacaatctatagctaagggttgtttttttggattgcatttctacctcatgaagaagaggctgactcaggctgagcagtctgcggccttggtctcctgcttgctgggggtccatctcttcgcctttcataccgtctgctttcatatttggatgtcctccgctcttttggttggtaggttgggtaagtgcatggaattatctctccgtttatgtatttatcacctgaattgtgaaaggattgagattttttatttaagaagcaacaactaattgattatgcaaataaccagctgcagacaataatgttgaactaacccccgtagtctttgttcttgacatcgatgtaggaatcaggaagcacccacagaacgccgggtaaacctacaggtaatagaacaatagtttgaaccagggcaatccaaaaatgtttagacttggttaaatactgaggcaaccagtatattagcaaatacccttgaacttctctgatgtttcctcgtcgacagtgcactggaaaccagtgtaggtggttgtgctgaaggcatacatgttcttcttggcttcctccatgctgtgattgcaaacatatgctcagtatcaagaaaatgaactaaaggcagaaaattacaaaactgtaggcctggtttatagtatagcaatgctgatttcagacatagcaccgatgataacttcaccaacgtgcagtgaccagcaaagaatacctaaacaaataatcaaccattccttgtgtttacgcaagaaattttaatccttgtgaatcgtcaagcataaactgtgcaacatatagacatgtctaccaatctactacacacttgtttcttcaacaaattatcatgcaaaatttgcaaccacctatagaatgtaaagcttttttacattttaccaaaaacgtgcgctccaattaaaatttcgactatcataatttacaatcgaaacaaaatttattatgtttgagtgaagcatgaaacaaacatttctctcgagattactctaccgacttagtcagtcagtcagtcagtccttgcaaattggcaaccaaactaggtgagtcaaagagaggtggagatcttgacaatgaggatgagaaattttacataattatacctgccaaggacggtggcgagggtgttgaggtaggtgtcgatcatctgctcccgcgtcggggcggggtccttggggaactccatcacgatcagccagtggttgtagtcgcacccggggagcagtatcgtctccctctgctcgctccccgtccccgcccccgccgccgcggccaccaccggctgcctcgccttcccgcttcctcgcacagccagcgtcgggaacgccgccgccgcggcggtgcgggggaagagcgcggatggtgcggcggcggaggaggatggcttcggcgcgagggcgaaggcgaatgcctgcgcggcggcggcggcggcggtggtcgggaaggaagccatgggaggaggcgcaagagtggggagagggagaggtttacgagtttggggataaggtgggaagaagaagaagagaataaaaagggagaagaagatattttttttgtgagggtttttagcctcctctttagtgggccgggccgggccgggccattttcggcgtggatttatgggctgtaatgtgtgggctcagatgggcttatggaggcccaattgtgacggtgatggaataagtccctcattattagatccaatcggtttttttttggttaaccaatcacttttcgggttttttttcaggcgaggtggctatctgtttttattagcggccagaagaataattaggctaaaaattaggatacattatgagaaataaaacttcttagaagagaagcaaatgaaacactttcattaaaaaattctcgaattaggatacattattagaaaatgaaactttcttagaagagaagcaaatgaaacactttcataaaaaaaattctcggcacttttaaatggcgatttagcttcctgtagcaatgacatgtttgatcatgcaagattactgatatgtaggtcagaggaggataaatactcatcttagaatcttggatcaaaatttacaattataagatcactggtgccacaaaagtgacagaaatataaaacttaaacataaattacagaaatgtagctgttgaattccatctctttttgtgtgtgtgtgtgcgcgctctataaacaatcagcagtgtttcaaaagcaaaatgggtctgcagaaatgtgtcggcaactgagcaaccacacattcaccatgatgaccaagaacaaaaaaagggcagcaacccgaagtgaatggcagaaaacactagagatgatgttcaactttcaagcagtgagaagtcaaaagcatttgacccattcactacaaatcagagatgcaacaaaatgcacattcatttcaggaaaaagaaaaaaaaacatgccgtctctgtcggtgcagaaagtttaagggttcaagggaaagtgtattcatccctcgagcggatatccccttgtatctaaatagtcatcaaagtgcacagcgttcagtagtgaacacttgacactagcagcttcaaaagaaatgcttaacaataagctagtgccatcagctttaccatcctgagtggaggtccattccattctgaaaacttttggtcctgtgcatccagtcaaacacattcagttattggattctgaaaaacaagaaaaaacatattgctgattcctttctttgctgttccaaggatgcaggcttctggtgcctttgtatgtgagattcttgcatttagttgcaggtttgcagctatcatcaacacaagtggctgtgcatgtatggggactttgacatggtgcaccaactcttccttccatctccatctgcttgactcaccatatacatcatagacataaacagtaaattaagctggaagttgcaggattgcatagtgaaggaaatgacaacagaaatgaggtcatgcaggcctccaaatagctaggctacaaaaagagtcactcaatatgcactcaatcatgccaaatcatgcctatagctttcataaaccaaccttcttgcaaaagtaaaggcttctcttgtctttccccttctctggtgggagtctagaaatcttttaaagtttctagtgaatatatggtgctgcactgacagatcttcttttaatttggtacgcaacattcatctttagcggtatggcatggatagaattaaagcttttatggttttattttgtagagtggttttcatgatttcatcatattagtggtttccaaatgatacttctcctatagtcaaatcctggtgaaaatcagctcttcccagcacttttactacagtccttaatcctggttaattcaaacaaaattggcttgacctttaacaacatttttttttaaaaaaaaaactatcatctgactccatttttaggtaagaaatgagtcctccaagggattcaatttctagtaaacattctttttaatctcttaacgcaacacaagttctctgtttgatgcttctagattgtttaacaacaatagtttgttaagaatctatggtaatctatgtcaaacttttcctttggagagctttaatattgaaagaaaaacatgaatcacaagaaatgtcatgtgtcttcaccagaaagggaacaggggacaattgagttcaccaaccatagaacaatttgtagtacctttctaattgaaaagaaaaggcagcttcttctagattgaaaatgaccatgtcctgcttctggttcaacatccagctactccttccatctcatgaaagataagttcgaggcatcaaacgagtgcgctgtggaactttaagggatgatcagattatacagcataacaagatagatgtgactagtgtttaagaacacactatataacatgattgcttcaccaattttctatattaattggtaatgtaagtaattgatctacatacatgcctgaaaattagtaatttaattgtgccactcaaatggtacggaaactagtcacctttcatgtactgaaaatgataggaccaaaagatactcacagaacttaagaaaagtaaccgtccaatttcatcaagcaaatccatggcaaaatattcataaaagaaaacaatatagaagaaatagagcatgtccacatgatgccagcatgtttcatgctagaaagcagtaaagcaggaaaaggtatgggatcacatatatcatggcaaagtattgggcaacaacccaaattacattccaatggcactctgaggtaaaataacaaactatcaactttagagctgaaactttattccatatggatgatcagactcaaacattgtctaggtgatcatgcggaacccttgagtttcttcgcaattccagcaaagtacttcccttggtggaaggcttgttgcagctcaagctcagtggcaacccttgatccatcaccagcgaatgtgccagacccgtacgggcttccgcccttcacttgctccatctcaaacatcccagcaccaaaggtgtaccctactggaacaaagatcatgccatgatgcactagctgagtaattgctgtcaacctacaagatg

SEQ ID NO: 8502 - DNA, 11770 bp, Oryza sativa
aaaccaccaccacaatcccgttttctcgacgaacatccgtactacccgaaccacccggagaaagaaaaaaaaatgctgaaaaaggaaaaggttggggagctcacactatgtagatcttggcggccatatcgaagcagaattctggagattggaatcggtggaaagaagggagctgggattgcgatgtgggaggaaggagggaggacttggggcatttatagctgtggggagaggtcttcgccatgtccatttgggtctaaattaaatctcatttaattcattttttgaggcaaaaagtcatttaattctacccgtataaaaaaactcatttaattccttctctttttttcaccgatgtattttgggttatcaattaggagtactccctcctttcaaaaaatattattaagataagatttagtcaaacttttatgatttattatcgattttgtatcagaataaatctacgtatatatattttaactctacatttaaattttttttgatgtttgggattctaaaagctctatcaaattttgccctaatcgatatttatgatcaaatgaaattacttttactccaaaaaatactttatattgttaaaattgtctttgtttttttaattcccttgtgtttgatataactgtaataaaattacacgatctttaaaaaaaatactctagacgtcgtgtaatatggtaatattgtattttgtagcacgaaaaatgtccatatgtgatttgatcatctgaagaaacaaatggttttttttctcctttttgcaaggattttccaagcaataatatgcaatactatatggcagtactcctacgcaattgtgcacataactttagcttgtctttccaacccagaaaaaaaaactttagcttgtctctaaatacctttataatactatttaccaccgtttgtcacgtttgccatgttgaacaattttatatcaagatcaaaaaaaaagagaaaaagaatcttcattgagatttacgacaagtaaataaagattacgatgacacaccagatgccaaacatttggaaaaaaagttgcattaaaaagcataaaacacgagatgcttggaatataagagcaattggagaaaacttttggaatgaataatcatgttgaaagggaatcatgttacatgataaatagctcaatggtgtgatatgctatgcatttgtctaatgttttacgaagtataaactttttaaagtttagtcaaaggatacaaaatgtgaaaattctcaaaataaaatttaggttaaatacttgctagcaactgtagtaactgatgtgtatagctgttcatttaaactactatgacaaactaataaaatcgtagtagtacaacagtatccataacaattggttgtagtttcttttaaagtaaatatcagaatgaattctattatcaaagaaaataaacatgtaacctgcagcattgcacggatgtaagacattgtcaatatttgtcccttaccgcgcaagggaaaatgaattgcgcctcccttgtacccagattctacaaaataacaatagatatcactacttatttagcaacgaaatgcaaacataaattaaaattgtggtattctgatggttgaagcatgatcgatgggcaagggagaaggatgtgcatgcatgtcaaaacttacataaatttagattttagttggcaacgaccaattaaacagagaaactgaactttgtagctactccctccgtttcacaatgtaagtcatcctaatattttccacattcatattgatcataatatatctagacatatatatccatttagattcattaatatatatatatgaatgtgagaaatgttagaatgttatattgtgaaacggaggaagtagtcagcaaagtcagcatggaactacggccggctggccggcggcgagctgccgcaatccgtgaatccgtgatggccatttcagtcttcagaagacgaatacaaaggcatggagactacacaccggctgcctacttgactttgtcagttacatgagacaaatgtgtatatggagtagtccctgatccgtaagagctacgtataagcatcacctgacttttatttgctaactatgatgccacgtaagtgctacgtacatgttacgtggaacggggactgagtcagcaagcaaacagaggttgatccagacaaagctttaggttaagtcctcttttctatcaatgtaagacatttttttagagaggcaaagggcaagtgctatgatagatgtgactaccacctccaaatttattcatatcattcactcataatctaggaaaagggtatgtggttgcagtgacttgagtaacatcttaaggttctaagttcaaatctccataggagcgaatttcatgttgggttatttgagctccaccctcaagttcccatggtacaagtaccgacagtggaggctcgagccctccaccctcatgatagatctgctcctaccataaaaatgacatgtatcaaataaatagaaggtgtgagacttcgaactcaaaccggctagcccaccaccttatggagctagcccaaaaaccctagaggtttctcgcaacagatccgctcctatcatcaagccatatatgagcacacattagtcgaagctgttatcaaatactgttgatgggcttgatttgaaccggttttagaaggtatgggacgctttatacccgattagttaagggatgtgataaaatccccatggttgaggggcctaaactagactttttccttgttatagataggagtagctctagtcttttccggtccaaatatctggtggtaggacttctaattaggcccaaataatttggtgagcccacttcccatttatatttttatacgtgatatattgttgggtgggaacagatgatttttttttcattttctaagattcttttgagaaaagttagaaatagtcatccgtataacttgttattccactttcctttatatttgccaccaagcactattcatatttaaactttgatcattcatcttattttaaaaataaaattctaaacacgtgaatagatatcatattatcaaagtgtctcatacttaaaaattcattataatataatcattgaaaaattattggtggtccaagttgcaacagcaacagtcaacagtgatatactctctccgtcttataaaaaataaatatagctagtacgggatgtggtacattctagtactgtctcgtagtattaggatatgccccagtagatccgttgttttataggacgaggaagtataaattaacggatgtactaccaggctgataccactaccctaacctggtaatgccaatgtcccccaacactgtcatgaacaatgtgtcataaatcacaagtggatgagtttcctctgcagcaacgctttctgacgttgatcaaagacatgtggactcgcgggatatgcggtccacatgtcagacacttaaaatcagagggtggtactacaaaggatctatttctctcataaatagcttgcaacgtcatggtttttttccatgcggtagaattttccaacggagccattgtatttgttattgaaaaaggttcaggtttagatatgagttggaaagggaaaaatttttttattttacttttatctaagataaggttcggaacaaataattacctgaaatgctcttagtgcattccagatatattacattgcaaaaaaaaaaacgtggtacacatttaagtatgtaaaagagaaatgcagtgcacaattttcaatagcagtacaaatgatgcaattgaatgattaatttacacttgtcatttctgaaaaacaaagcagttgtacgaagtagtagcaaataattcaattgacatcttatgataaaagtagatacatcgctacattgaaaatacatacccccgttctcaaataaaagcatttttagactatccagattaatattattgaggagaaagatttctttttaatcacatcattagttaaattttgaattactcaaattccctttctaagtttctaattggttaaaaacacttggatttttgcgcataaattctaatttatagaaatatatatttttttgaaagtacaagagtgcactacatcacactcctcctgaatgggagagagagagagatgtgattgcttgcattgttagtaggaggtgtgcatcttccttctctgaacatccagcccgacacaaatcgcattagcagtaaattttggcacggagaaaaatcagagcttgtgaagttgagtgaaagaaacactacaattaaaaggcacacgtggacaataatactatacatcagcctcacctaatcacagttggttgacgtttttatcgatcatcactgctttactaatcaactagctgatgactagtcaacaatcagctagcagtcccgtgtcctaagtagattctgttcaatgtctctttgcgcaagttaagagaagaacatttgactacgactgaaaagaaacctgctctgcaaaactatctagaacagtttgtatttatatgggaagatattagtaatttaaccttgaaagtgcttgcattgttgaacacctactaaaggatgcgagaatcaggggcggagctagacaagagtggaggggggtgcaccactatagtagcaatttttttttctcaaactacttcctccgtttcacaatgtaagtcattctagcattttccatattcatattgatgtttagattcataacatcaatatgaatgtggaaaatgctagaataacttacattgtgaaacggagggagtatattattgtaaattataatgttttcgtgtattatcaccatcaacggttcaacataagtaacaatggagtcaggttaataatacggagtagaatacttccttttattttagtcaagaatatttagtgtctaggataatacgttcagtcaaaattgtaagttctgaccatcaaatttcttaaatacttaactaaaaaataaaataaatggtagatttgtctccaaaagtataatcatccttgagctttatcatgcctcatctgctgactttcttttgcattgctagtattaacgagaggtttttttaaagaaattctccataaatgcacatctcatttttagtcatgcaacaatatttagataaaataaaagacaataactatacatactatcctaccatggttacattgcatcacagtatgtatatatattttctctccaacgaaaactattatcacgcaattcaaaactacctatctttcacatgagttcttccaatgaatcaaattaacttgtaaagaattatataaggggacgaaaggatagaggagattgcaaactgcaacgtaactcatgctgtggttatgggccgttcgtgtgcctcctgtggtctgttttctgatgtagggggttcactaagctgggagaaggggggtgcccatgcggtaagtaagggtattaagcactaatttttcttttttcgctagccgagtgcccaggaactccctaggatgtacttagcttcgccctggcgagaatgtgctttttggctgagattttgagggcgttcacagagcacctatatggtgttcaacctcaacaccaaaaaatgaatattcatcgcaacaccctccatctgcgcagcctcctcaagaccacatagccaacttgagccacgggttcctcatcagggtttgcaggtgaggccaacactcgtgctccgcaccatcagagaagagagagggaggagagatacctcgtcggccatcccgcgctctacatcgctgagtttgttgatcaggggaggagggtcgccgggcgctcgccgactcaatggggaaggcggcagggctggagaagctcgccgagcatgctccaccggtgaggaaagacgccttgtttcctccgcccaacgccgccggagaaaggagagcatcatcagagaggggaaaggccgccgacggggagagaggagcggcgccactgcggggcaggtcgcggcccccggcttcacgcggttgctcccgccgtctctccctcctgcgtcaaatccgtgccacgaagcgcttgcccttccttgctcccgccaccagaggttgtcgccgaggtgaggaggtgttggatggatgggcagcgtggaggggattaggtggggagagagattttatattactttcttgattttggatgttaactgcaaattttggaataccatgttaattgaaaaaacataaaagagactaaaatacaaaatgtctgtaagtcccaccatagaaatttttttaaaccacatcttgcatcctttgaagttgctaagcctacatggcagctgaggtctagcaaattgcttggacgcattgccattgcccttagcgaccggtgaaacgatacgaatgattaattgagatctttttcactacctaagttgttttgtaatggacagttcgattgtcactggtatgtgggacccccacgaaacaaatcaacaactgatgaccccacaaattgatcattgagcttgcataacccagacaaatgatagagagaagggggcgtagccccacgaggatggctccaaaagtctccaattgcaatccaatccaatccattgcatggcaaaattcgacacgtggcagtgattaagcaagaacagatcaagatccaaacacattgtgatcgaagtttgccggctagtatacacagtcccaagcttttatcatggaggagatgtgttcttggccaaccacctacaacctccaatttggcagcattccacttggctacaaaaaggttgtgatcatccatgcatgcattcagcatgacaaaggttaattaaattaaaagatggatagcatagcactattagtattagttagtttcaggtcaaactatctgtttggtgagtgactaagaatatggtaaaatgagttaagtgtggctcctcttgtgcttcttttcctactaattcaatgctgtgaatgcttgcaaagaaacagttgaggaaagaattagacacctacctaaaataactgaggcatgaccactaaggtttaagcttttgactcagaactggacactctaaaacaagaagaagacaatacatttcacaaaaccacgtatatttttacaaaaacgatcaaaactataggtttaaaacatcacatcataaaactataggtttagcgttgaacttatcccgaaactaattcaatctaaaatgttaaaaatacagttttaacgataaatttatttaaaattatattttgagaggttaaaacctacagtatcattttcataagctactaagagcaggtacaatagcagactataagcttactataaatatattttaaaaagataaaagaagagagaaaagagcagcgggctacagatctgtagccagctgcagcacagactacaaaacgtaatgtgtatatgacatgtggaaccaggtattaatagtatagtaagcaactattgtatgaattggctgttacattggctatagatggtttggagctagtagccggctatactattaaacttgctctaacaaacgctaaacatatagtttttcggtactatggcttaaggctgtaactttgtgatgaacttgatattataatttgcggttttgtaatattatggattaaagagtacatatatactcacacatatctagatttatagccaaaatatctttatatttagagctagagagagtagttttgttaataatgctagtagtttcatgaaatttactactactactcatcaaagaaataatagacatcaatgcccactgatcagaagaggtagggcacacaggatgaaggaacagactgaagagatggcacttttttttgtgcatgatcacttgagcataaatgcaaagcaatgctggggcctcaagacactgaggcaaactgtagctagagactcattgtatgcacctccttttgacaacatcctctctccgaaaaatcgatctattcgttgcccttgtccccttatgcctcttcttccactgctctcttctttgtttcttgttatcaccatcatcatcatcatcgcctgaatcagattccatgcatctcatgatgttcacatgcatatcagtccatgataattcagaaaacaggtttatactctttctttctcatgaaaaattcagactcagattcatcattcatggaggttttggcacttctcttccatggtcacaatctgttgaagacaattgttatgagtacatagtctttttttttgtttttttttcttgagtgaatggaatagagagatgaacagtcgccgacacggaggccccacacgacagtgacaagaggcgtcgcgggcattttcgacctaacagaaaaacattattgtttgttgttttgtgctgattgcagaagcttttggtgtctgaggatggtgcccacagtggtactagccattatactgaaagatggaccacttgtgttcttatgatgcaatgcaaacctatctcttcctgctactattccagtgttatgatggttttcctccaggagcattcaccattcaggagcagctttggagaaagcttacatgagagagcagttttcagaggaaaaaaaagattacataaaatagattcaaccaaactgatggaaccagccttaacttgatcctttgcaagatcaatgctaatgccacaagctttagttagcttggttgatagtgacagaacagttctttactgaacaatgagcatggttcatcttttccgattgagtgctggattctgaccctagcggtatgacgtttttcgtcaaattttactttttcaaatttgaattctcgaaaaccattcgacatttcacttggaacctacttttgcctcgtgtcgaaacctcaaaatttcgtgggttttgatcggttttcatgggaaaacataaaccctgacaatgagtgcaatgatgaacaacacaggagggagcaggcatacatagatttgccacagtccacaaccaagaagagcaccaaaatcaggaaaggaacaagtgcatttcaggaaacagctgccaatgtgcaatctgaaaaattaggtactccacacctgaaatggaggaggatccagtggatgagtacttctccaatctccatcctacacccccccagatgttgctacaaatgcaaaggactttctggtgatgatatcacatctcacaccattttctcattcagtctatgaacatgaataattgaattgaatacccccattgcacacttctgtactgaaaaagttgccaactaactctgccatatgtgcatggtcaaactgaacatggtactagcagtataatttcaacagctcggtcaaaaatggcgatcactgctactgccaaatcagttcagaaaaaagagtagtacatgaccatgaagaaaagctgctgcacatcacacagttgcatttcatcacctgaagcgattcagggccaggggttagctgatgatttgcatggtttgcaatctgcatgacttaatcctgtccacttaacaaaatctcaaaattagatccctgaaaccatttagcaatcaggccaatggacttttgttggcttagaacaagccatgcttccaaatggacataccaaccacctccaagaaaagtttgtggtcaaggtcaacccttatcttatggttgctaggtttccattcagacattgtcaacatcaaggccacatcaccactagatgatccactaagtttatttttctatgcacttctagataaaccaaggagctgtgcacatagcaaatcaacagaaaaatcgtacctttttgttgcacataaaggctaagtagctagcaattagcaaaagtaagggttgctaaatgctacaaaaacaatcaacaccttcccctgaatgacataggagaaacaaccaacataagctgctaatttcctaagctagttattgatcacatcgaatcttatgaagccccaccaccgctttgtcaccgactaatgagacaaatccgtgtctagaccttttcatacttaatcagatgtagaaattgcaagtttgttgacgttgcagaaactagaccatctaaaaaaaattttagggtgtccttgtcagataaaacaataagcaaagttgcatactagccactcacttgtttagcaactacagtgacacaagcaatctcgtcagtatctcatttcttggctacaaactgattgcatactgtttctccatgcaagagcatctgaaaattttatccaggactgatacagaagaacatataatttagaggagatatgttaccttgtcaaattctattagccacttcaacaaaaaacaggaactacagttagataatctagactaatttaaagtccatgatatcaagggaaatccacgagtatgatgtgagatctccaatggcaatttaatatgggaagcaaattggatgacactccttatttaattttgacgtggaaaacatagatagatgcacgaggtttaagtgcaccacttgaaaaaaaaaaaagaaaacaagcattatgtgatatgtcaaacctcacataacaaaaatatctgatgaagtataaatcaagcaaacacgaccagaagagtttgtgagcaagtgaaaaattgacaacttttgcgcttttctaataaattccacttcttatatcatatagcattacatcacaatccaaaggaggatgataagcagatacacacaatcgaaccctcatatcaacaacacaagattgtagtgaaaaatcataggaatttcacaggagacacttgagagcaaaaaagagatcacttgatcatgagatgtatcatatatcatacgacatttcagattggatgattttgggattcagaattcaatccagaacagaacaccacagaaggtctgggtgaaatgatgagaggaccatgtttttctaagcatatgaacaaaaaaaaaaggaactaaattctacttatttttttttcttcttcttcttcttcctttcgacgctgctaccacatgaaaagagaagggaaatgaacccaaccaaaaagaagagaagagtagaccccaaaaaaaggttcacctttgctgtttctacctttgtacaccgagcccaacaccgattcgaagaggcgccgaatcaaaattcgcacaaatttgatgtttggagtttggatgaaattcatcaaagcttctcgagcgtccgagctaattccaccgcgttcttggcaatcttgcagttgtcgtcgttgacgagagcctcgcagagatggaatgctccgagcttgatcgcctccctcgccaattggttgctctcgccgcagatcaagttgaggacgacgagcgcctgctcgatggcgcgcgcgttgccgctgccggcgacgccgacgagcacggcgacgacgcgggggatcctggacagctcgtggcgcccctcgcgggacttggcgaagaggccgagcacctcggcggcgcgcgcggagcccgcggcggcgaggtcgacgagcgcgggcgccgccccggcgcgcacggcgcggcgcctgttctccggcagcttgcagagctcgtacagcgccgtggcggcctcgcgccgctcccgcgcgccgccgccgcggcggaggaggccgaccagcgccgggacggccgaggggtgcgccccgatggtgcacttgttgacgtccaccgtggcgaggctggtgagcgccgtggcgg

SEQ ID NO: 8503 - DNA, 21005 bp, Oryza sativa
ctttttggtggtggtgttttttttttggggttcgtttcgacgtcatggtatctatctgttgcagtcttgagctttcatcgtgtgatgaattaaaggatagcgatgttgcttatgtttatcgttgttatgtctatccgctgcagtctttgcctgagtaacgtgtggcttatttggatttagcagacgatccttgataatgtttgcttttgtctatcttatgatccatacatgctacgtatacgtaacgcttcctgcatggtttacttaatttgttagcatattttggtatctctttagttcacatttttccgttacacttccgcaatgagtaatctgcatgtaagttggttttacgagcaatcattaattgatagtcatgcacgtctcatacatcacgctagttggcgactctgcggctatgctttgcattcttgtaatagttagcacctttagtttttttgtactcttatagctttcagttatcgactatggtagcgtgaaccaataaacaattaataggaagtgcaagggcatttttgccaaaaacaatcaacgtggcatctgcaattaccccgccaacctatggctcctactggaaaggtaaatatgtcagtgtggtttaatcatttcctattctaacaagaataataaaaatctgcaatcaataagggttttatttggtttgtcacatggatcatacaaattgtttctattataaaatgtttctatttggtttgtcaccgaaaccaaaaacatgttatattgctctctcattgggttatcatatgttttatatatatatagttaagaggcataaaatgatcggtttcaaaattatgaattgatttatataaaaaagatagatatttatcaatccacaatgtgtgagctccttggatcatttaaccggattttaaagcttttctttcaatgtgtagaatgttttgatggtgggagacatgtgcacatatccctcgcttttagcgcaactcatgagaagcatataatccctttttttcatatagttttttttaaaatcgtatctaagcatttaatttcttttggtgtgtatgagttaatctgcgtatcatttttataatagctgggagattttatttaatgagaagatatggttatacgaatgactgtgctagtattaattgatagcgatatatatggacatggccctcgtaataatgtttggagatacagtactataattatgctttattacgtgattaatattcagatgttgtactggaagcaccctggcctactgattttctactggccctttatgattaagtcctggtacttgtaatgcaacatacatgcatgtgttttccatggcaatatgagcaaaacactcctatatatcatattgtggggacagattaagatagagacatggtaaccaacgagattatgtgcaggtgcaattttattcagaagtccaaacagtcatgtggattattacctgattaacagttacatattaaaatgttctattatgtagttatgttgtaggcaatacaacattgctcagaagagaacattgtgccctttaatttttattagaatccttggtctctagctaacaggcctgagcaactctctagttatattagtcaactattttgtgtctagcatgagaatggtgtatttccacccatatttcatattttccatatatcaatgtttaagtcaactagctatattattgggtgaacttagctcactggtgagaatgttttgttgacctctgtacatccgaagtttgcagacctttacacatccgtagtttgaaaacaactccatccatttgagtggcagtttttttttgtcacaaaatttagtggaaattaataaagggactgcctatacttcttgtaaaaaaatcataaatttaatgataaaacaatcagatttcacacagtagaattaaaaagagatcactaaggttacaaccacattgtacgaatatgacgatgtatttgtaacaattccgactaataaaatagggtccacgagtgtctaccaagataggtggcattggaccaaaacgaactatgtaattaagaagccaacgagcaaattaagccatgatcacgacacttaaagatatggatacatgcaaaatcatagtacttataaattaccttgaaaagagatatcataatatcttgcttttattatgtgctataaatctgaaattatactgatatagaaaaaaataaagaaagaaatctttcacattaaaacttaacatttgagtacatacacacatttttgccctctctctcactccccaccatcacattcattcaccaaccaccagggtcagtgatttttttttcggttagtgacttagagcctcatcggttatctatatttcttaataaaccaaaaagactaattaaagaataaaagttaatttataaataaaacttttatatatctttaaaaaaattatgttgaaaatatcttaaaattaacttcaaaatcaagtttaaaaattcaaaatttaattttttttatttattagaccaatcgatggggctcttaatttgaaacaattttacaagtgaaaaggaaaatgcaaaaaaaaaaaaacctaacccaaacggtagaactcgagataaaacggtgacgaaaccgaattgtgcggtgcagtcacctcccccaccatcacaaaacggggagcggagaaaggtcacaggaatcccgggggacgcatctgggccgtacacgtggcacgcgggcccccgtgtgaacgcctggaaatttatccacgggccttatcccctcccacgccactgacgtgtcggcccgcctcctcccggccccactaaagtaacttatccctaccggtcgaacgtttgaaccgggcaggtaaggttttttttttcttttcttttaaccctttttggggtgtttttactgcgcggtaaaagtaggaagtggaaagcgaggagacgcgcccaacggctagaagtggtcgctggcgtgtactttgactgcgtggtggggccctgcggattcagtcagtcagtcagtgacagtgagtcagctgaatcagtcaatttctatagtactatatgtgtagaatctctctttggacccctggaactttttacaaattgcttcctcctgggtgtggactgtgagtttggaactgtacatcatatgaacaactctgtccagattaaaatcccttatattttagaacagatagatagagtatgagtcaactataaactcatgtggaagagagatgaaaaaccgaggagtattggctctcatgcaatagttatacacatgctccaatatatttacattataaattcatgatgagagaaagagagaggagagaaaaaaataaaaccaattttatagttaacttattatacatgttaactttaatatatgagctaataaccaattgtttgctatactattaaatctgctcttacggtggttctatgtcgtactaaaccatattttgggaattgaaaatggtcccccaaaatcactatttgctagtatcatttgtaaaatcctacaaaggagaaaaaaacatttagtgtgtgattaatatttggaaaaaagatgtctacggttttaatgtttgacttgtatattagttaaaacagctcaacatgttgtttgtccgaattttgaattttagaaactatataatggttttttatatttcagtctagattattgaacatctaaaaaatcaagggtataaaagtataaaaatcttgtctgaacatttccggtcatagaatatgtagccctagccaccccaatctctatatcttctctattattataaaaatcaaagatatttccgctgaaattttggtacgtcatccgtgtttgagttggtttttagtttcgtacgtcatttgtgtttgcgttgatttttagttggttcactacaagaaataaatatgaccttctgtgacgaattcctcgtgacgtcggagctattcgtcactagcacattccattttatgacgattaattagtatgagatgtggtcgcttagtgacgaaaaaaggatgttcgtcgttaatactacctagaaatcgtcataaagtatttcactgggacatcgtgacgaatattaatttgtcataaggggcacaaagcaaacgtcataaatttatataatgcatttatggaaaaatatattaaaagctaaagcaatttaatcaagtgaattaatgaggaaactaaatttttccttcaaaaatcatggccggaaatatttttttaatattctacgtggtctaaataattctctgaaattttctgtgaatttcggtgcttaataactatttttaattccacaaagtttatttaaccaattaaaataaatggaaaacaaattaaaattcttctctctgtccttgggcttttttcggcccaagtattactctctccctcccttagcccgcagcctctctctctcgtcctccctcttcgggctgccggcccagcccttttgttcctccttcaccaggaagtctaattttcctccctcttcttaattcaaataatttttcggatagtaaatgatttcaaatgaaaaaaaaataccaataacaaagttgtatattttaccaacaacaaagttacgtcgctcgtatccaattcgacatgagtttaaaataactattatacgccttcctcctagcgcaacctaacccaatcggccacaccatcctgtgcgcttccactcgaagctgcacgtacccctccccacgttttttttgctcttttttcccttttctcctttccttttgtcctggtctttctgaccctctcctctccttccaatttcctttatttttgcatccttttctgtttcgctattggtatctctactattataaaaattgaagatgtttcccctgatattttggtacgttgtccgtatttgaggtagttttaaagttcattcgctttttggaaatacaaaaggagtcgtataagaaatccttttaaaaatcctgcgtgctaagttaggacgagagtcggactcctaattgcttcagaattctcgccaggccataataaagcaatgtatatgatgtgaccgtcatctcaataaagattccgaattagatatcaatactatcaaaataaaaatcccatatactttttactttttagaaaaaaaatctaacaataatacggttaaaatagtcttcacccgttacaacgcacgggtatttttttagtataaataaatagataaaacaccctaattggaggcccaaacattttaatttaaagcccacgtcgatgtaaagatagacccaggtaagctcacagtgggccataaaggcccaaaatggccagcctacgaggacgccacaataaggaaaaagtacaccgaagatccctcaacttgtcatcgagttacaaaatcgtcccctaaccacaaagccgaatacaacgtatcccccaatttacaaaaccagtgtagattaggtccctcggtggttttgcactaggttttgtccaatgtggcggctgagtcagcgtgggacccacatgtcaggatgccacttcagcaggctggcctctccctccctctcctttcctctcttctctctctttctctctctcactcctctctggacttggcaggacggtcgacggtggggaggagccgaggaggtcgccggcgatgcggcggcggagacacgggagaatgggaggacggcggcaagccgaggcggcgtcggcgggcgagcgcggtggcggagagtaggcggtggcggctcccacgcgggaagccgaaggcgacggcgtgggcgagcatggaggcaaagtgaagaaagctcacctcctcttggatctaggcacgccgcctggcacctgcctcgcgaccgccagcttcgccttcgcaggagaggccgtcgtcggggctagcagattctcctacaccaccaccaccaccggtttctgctgctctggctgcggctgcgtcggcggcggcgtaggcgtcggtagagacgacgacgacgaagaagaaggaaaggcagcgcagaacgccttgagaagctcgtcggcgtaggagaatctgccagccccgcgtctctggactgggcagggctctacgagttcaggtccagcagctcgatgtatagctacaatgagaattgtactggagtatgagatagtcaatccgtgatgagataaatgatagctcactagtagctgcattcaatcacctccatcaacacctccacctcatagcattcgttcattagcagcattaacctgagaaatatgaataactgtcatcttcttcatcgtcatatccagatagttaagagttagagattattgctttaacaattttgcaaatatttctagaaagattgccaaatccacacgagcagcatcagattcgaaacgcaccatagccacgaacacaagcatcggcaaggatcgaggaagggaacgaattaacaaggaaggaaggacgtacgatggcgacagtggcgccgtcgacggaccagagggtgatgtcgcccttgtgcagcttgagtgcgcccgcgcccgcatccgccgacagccggaacgcctcgccgctgctgagcccaggtgccaccgccatggcgaacgatgccctcgtcgcgccgctgctcggtggccgccgccgccgctgcttggggaggagtgggagccgcgacggcgtcgttgccgccaccgcctctccgccaccgcgctcgcctgccgacgccgcctcgccctgctgctgccctcccattctcccgtgtctccgccgccgcatcgccggccgaccgtcggacctcctcacccggcgacctcctccccactgtcggcctccctgcccagtccagagaggagtgagagagagagaggaggaaaggataggaagggtgaggctagcctactgacgtggcatcctgacatgtggggttcatgtgggtctcacgctgaatcagccaccacgttggacaaaaccgagtgcaaaaccacgagggatctaatctacgctggttttgtaagttaggggatgcgttgtatccggttttacgtttaggggacgattctgtaactcgaaaacaagttgagggaccttaggtgtactttttccccacaataagtctcaatcccgttcttgggcctcacataagcgaaattccgttccggccgaaaattgttcaggccgcacgtaacttacaaggaataagttcatccgaggtcccttaacttgtcaacgaatccaatttttattcaaccggaaaaccagatacaacgggtcccttaactatcaaaaccagtgcagatgaggtcacttggcagttttgatggcggttttgactgacgtggcacctacgtggctaatgaggcagagcaggaggttgtcggcgagcgcgacagctccactccgtcggccgctccgccccgcccctccgccgcgatgctctctctcgagcgacgcgagcacaacagcgacggccgacggaggatggcggcggagggagatcatctatcaactccggcggagggagctcctcgcctggccgccgcgccgcaaccgaagcgccaccactctactgaggaggcagcagccatggcgcattggcgccagtgccacgaagcagacgctgcacgccgcgttgtcgtggtcgacttcgtcgtagtggcggaatatttgtgtcttggcgctgcgttcgggcgtcacgccggcaatggttgtgctgctgctgctggctcgcttgagggacgagacgagctacctcaacaagccgccaggatggagcctgaggaggaggttccccggtgcgttcacgggttcgggggcgactgcatccaacgcaccaacaaaacaccacacgaatgaacaaacccagtcaccaccaagcaacctaacacataaatacataatcaagagagtagagagagcacgtatggtgaattggtgactccggatctctcttccatcgccggcaggcacgcctgcgtgtatgcaccaacaaaaactaatccatagaacggattatgcaccattcctcaatagcgcaacaaaaactaatccgtcttccgccttgcgctcccccacgccacggccaccgtcgtgtcgtcgtcacgcggcggtggcggaggcgcgagcaggaggagggagtacgcgtgctcacccaccacgcacccgggcttcttccggtgcgcgctgcaatggagcggcgcgtcgccgtcgcgtccctcctcggccggcggagaggacagatgagaggggagagagatgaacacacggagttggggggagagaggaggaagatgatgagggtgagaatgacatgtggggcctacgtgggtctcaacatttttaatttatttttttgtgcaaactagcatgtggcccacaatttttaatatttttcaaatcaaattgccacgtaagcgccacgtcattgccatgtcatgtgaagaccgagtcaaatagccacgtaggcgccacgtcagtgaaaaccgccatccaaaccgctatgggacctatattgtatctgtttttggacccgttatatctgattttctggttgaaggatgaaaatcggattcgttgacaagttaagggacctcaaatgaacttattccaacttacaatatcatgggcctcacctaacaaagatgggccatgatccggcccaagtaaaatgggccgcacgcaagtcgaatcgctttccggcccatgaaacgggagagccgagagcccgagatgtatagctggtcacctctgcttcggtgcttcgtgcatgtttggtgagatcttttttctggatttctgtgtctttttgaaccagtggcgtgcagttccatgaacacctagtggaatttgatctctgaatcgatgtcttacatgcagagatggaaaggaagcttgttgtgagtgagcaagatcagaatcagaagcagaccccacgaaatctgcacttccatcaacaactgcctgatagctgaaaaggaagtgttctctctgtacttttttttttaaaaaaaaaatcttacctgcattttgggcaatgtcaactttacactggagtttatatgatactgttattatctgaaaagaaacatagtgaggtataattgactgtttacattctatttttttaccgaacaacacatcagagtatcagaccacacattgcttaagcatcagttctttgctcgctacctgcctccagcttcctctcaccactgcatctttgactccatccacaagtaaagcaaagaatctgagtttatatgtacatcctcagttacaaattgtttgtttctttgtgaccaaaattgaagctgcagcctgcatggtctcagtctaagagagcaaaataagggtgttaggaaagtctactggtgacaacctactcatggatcgatacaggtaatttaacaaggtcaagctgttagattttgagtaattattttcttcattctttttgtatcaacactggaagtttggaaccaacatatgcgaatgtgctactactttatatgtacaatttctgttttgtaccattatacgcaacatacactgagtatacttaactagttatccagccacatctcaagaaagaaaaaaaaagaatcattagtattttctgaagtctatagctgtagtgtttatcagtttgacagctatggaatgaatgggagatacaagtgttggtgctggtgagcttttccctgcaagtgttcctcctcttgctctcgggcatcaggaagcgtacaacctccaatgtcttgagcatattcatatggctcgcatatgtgtcggctgactccctcgccatcttcgtccttggccatcttgcgctccacatcaatggccggcgccatggtctggtgctcttctgggcgccgtttatgcttcttcaccttggtggccaggagacaatcacagccttctccatggaggacaacatgctgtggaagcgtcaccttctgaccctcgccacccaggtgggtttggccgcctatgtggttggcaagcagtggcagggagacaagcagctgctggctcccatggtgctcatattcatctcaggtaccatcaagtatgcttgcagaacatcggcactcatgtttactgctgaacaaacaacacctgggagtaatcttggcatgcaggcaaagggttggtcagctaattggaaacattattcgactaataattggatgatgaatgaggtgcacacttacaacgaacttttgtgggaagccaacgcaggctggaccttatacatggccttcctgatggatatgacaccgctgatatctaggcctgaaacctattcactgaaagggctcctgtcgaaggaacaccgagtctatgtctcttataagctagctgagctccagctctcgattgtgtatgactacttctacaccaagcttggagtgtattttgagcccgaggaacgactaaatggtcgcttcgcccagcttgctacattgggctccacctttgcagccttgtttctatttgccaggggtaatttcagctacgatagagccgatattgttgtgtcttacatattgctaagtggagctttcattctagagatactctctgtttttattgttgtctcatcattctgggcatacttcatggcaactgtatctgatttcctttgtactagatgtcatgatgtgatcttcagcatcgtcaagcttgtccatccagagagcaaaccacaatggtcccaaaagttggcacagtacaacctcatcatcggatgtataaagcagaagagagcagcagctggcagttgtttactgaaatgcatgaagcgtgtgatcggcatccagcccagcactatgactcatgtcgacatctctcatgagctgaagaagctcgtccttgataagctactacaggttggaagcagattgcatccagatgatgtgtggggacatcagcaaattcaccggccaatgggcaaagttggagctcatgaggagcaaactgcacattgaaagttcatcaagagctcggctgcaggtgctgatcagcgatagcattcagcgtgccggtttcatgtctgctgtccttgcttggcatattgcgacggacatatccttcttccatgaagatgagctaggctgcagctctccatccagaggtccaagcagagaactatctaaatatgtcatgtacctttctgcaaagcatggcatcctatctggcaatgatgggcacatgcggcttagaaatgctcaggaattcatcgttgaatgtctggaagaccgccaggaagctctagatcaagatgctgttgtcagaagtgtagctgcaaagatagataatctaactgaggatttcgagcacccaagaatactgacggcagttgagcctgtgttaatccaaagtggccaacttgccaaggagctgcttaagatgaaagaagcaaatgatcgatgggatatcatcatgaatgtttggatggagatgctttgctacatggcatttcactgcggacctggtttccacattaagcaggtaagcaagggtggagagttcatcagccatgcatgtgaaggttgtgatatataatctaggctttccatattcaacatattcacctgaaaccgaagaacccgctgcaggccattcttgacaagcttctcaatcgatgtttggctggggcatatattcctttcagaagccaatatcagtgctaccgttctactattatgtttgatctctctctctcaatgtatatatgctgaacaatataattcagagtgggatgtgaaactctgaagatatctgcagcaggacggagagcaagggtagaatggagtgaactgaaacaggagtttggtggggttcagacttcagaggggcacaacaagatctgtttgactgttttttgcaaagagaacacttcaaaaccatcaaagatcagtactagccagcagtatcctacactacatatactacctctgctccataggaccataataataagttcatttttggctcaaaaaaaatcatttttaaagtaacctttgtattgtagtttgtgaaagtagagaataattgtattggaagtagataaagtaagaaataattacatggggatttgataaagtagagatattttaatcttttaggttttgtatcagtatgtgtgggatgggtgaaagatgaacttattttggaatggaggtagtaatatacatgagctcatatttgaagatttgacattcgttaatttcaaccaacatgtaagctaagtagtaagtacgtctagattgctgtgatcagtgtagattctcggttcatctcacgtcttgtttgtgaggagtaacatattcctttttccccgaaaaataaaatgtagattctcggttgggtttgtccatcgttgcccatgagcacgattgtcgaaaccattaaacggtgttgatttttcatgaaaaaaatttatatatagaagttctcctacaaaaccaaataagtccaaacggaactggaagtaacacaaaagtaataccactgtattcatatttcaatggaaaaaaaacatattttacaaggcaaaaatattcccaaagttcaacatatacatatatagaagacctaataattgaaatacagtcacgcttcattagaagaaaactaattaaacagagaggatgtagatggagtgtattgtatccttgagcgaacttggatgagtgtatgcatcttggtcgtccttgtagacgaaatccagcacgcgtgtggcgttgacgacggcctccagcagcggcggcggttgagccgccgccggccggagacactccccggcgatgtccatccatgactcctccacgagctccctcagcttcgcgtaggcttcctccttcgtgatgccgccgtgctccctcatgcaggcttccaccgtcgacgacgacgacgacgaagacccttgctctctcttcaataataaggaaattaattggccgatccaagttagcgaacagattaattaagagaaatatttagcaactagttaactactccattcgtcctaaaatataacaacttagaatcggatgtgacattttctatttttcagattcatattactagaaaatgtcacatccgaacataagttcttatattttggggacaaaataagtaattaattagcagatgctatatagagcttgtttttttttattgattcaatcatgtctcttcggcttataagatgtaaaaaagtttcaaaaaagagaaatttacgatctttaagaaagtacctcgaggtacctaaatttacatcaaaatttccgataccttaaatattactcctttcgtcctaaaaaataacaacttttagctctcaagatttgtcccaaaatataacaacttctccatcaacattctcttcccaaccaatcacaactctccaccattcacttttcccacctaccttcactatttaatcaattacaaccctccaccattcacttctacttgctttcttaataaccgtgtctaactctaaaaatgcttatattttggaacggagggagtaagtatctagaggtaccaatacataaaaaatatgatacctcctggtaagatggtaaaattacccaaaaaaaacactcaaacatacctcatgtgaagctatgtcattgagtaatcggccaacgatgcaggaagatgtgatgatcttggggtaggccatgccccagttgatagcatcatcggttgtgacatcgtttcccatggcgacgaaggcgtagacagggacgtgcatgcagcagctgcttggcactgaaatcttgaggtgctcctccaccgtagcagctacctgatctgcaccttcagagcgccatttcacctcgttgtaaaagcatctcgtagcgtcgattaactgcaagattaaccaagcagttaaagttgtgatcaatgagatcagctgcctgcctgcctgcaggtagttgatgagactagctacttactaggtttttgacatagtcgacatgcttgttcccttggagtttaagatcagtttctatggatttcatggtggtcagtactttcttgtagaagaacttcatgtagcctggaagttcttcagcggcttcctcatcccatctattatatttttatggttcaatcattgataaaaattaaattcaagttaaagacaagaattttggctccatgcagcttctttgaaacaaattaagttcggaatgaatttcattattaaaagaagaaacttaatcaattgacctttcaattgcttctgtgaacagcttgctttcttccaaggtgctgtagttgtcgtagatgtcatcgaaaatcgagacaaagatgaacaatttagtgagcatggttctcccatatgagtactgaggctcgaagagaactccaagcatccaaaagtgcatctccaccatcctatctcgcgcaaagcttagatgatcctggagttggagctctttccaccaccttcaccacaccgaaataataaataaaaattcacattctaggtccagttcttgtatgtacatgcattaaattggacatctatatagatatataggtgaattttggtaactcccaataccttggcaaggacagtaaaattgagcctatgcatgttttgaattttagggttggttcaggtattatagctagcacgaaaagataataaggtattctcttgtggtgtagatgaagatgaagattaagtgttttacgtaaaataagatggtattaatgtataattaattgagttttaattattataaattttaaaaatagatttatctgatattttagaacaacttccatatagaaagttttcgcacgaaacatattgtttagtagtttgaaaagcatgtcaccaagatgataattttcatccaattcctatagcagaaacgataattggacctaatctagtgatttttagaacatacatggtgaggatattgagctcctcgcaatacagagattgcaaaatcccaaagtcgagcttggcgaactccaaaatggtctcatttcgtgtgggcaacttgtcgtaaactgagatgtagtgccttgcttcaactcttcttggcctcctgaaaagaggggtcctaagtgcactgcacacctcgtccgccattggcgactgcagatgttttaccacagactgcaaatagttcctagtgaagacgatagcatcgtcgagtatctcctccccatgaatcctgagatgggcagcattgtacaagctcagcatgcttcttgtgccgttattgttatcatcgcgtgtgaaatttccttcctcgtccctgaacctctggaacacatctacaacgaacatatttcattgcatatattcaattacctccgtttcaaattataagttattgtgtactttggtcaaaatcaaactgttccaaatgtaattgagtttgtaggaaaaagtagtaacatttttaacccaagacagatataatatgaaaatgtattcaattttagatctaatgaaactaatttggtattataaatagatattactatatttgactacaaacttggtcaaataaagagcaatttaagtttgaccaaactcaaaacgacttataatcttagttaactaagggagagtattagttcatgctaaaaatatggtatatcatcgtcaattacacacacacacccacctggagaggcatagtatccatgcttcctgagcagatagaaccggagagctgtagtgtggaggtcatagtgattgtcggtatcgtcttcttcctcatgaacccggcgcaacacattttcaatctccttctcgtagtggtagtcaatgcaaagacgttctaaggtgtcgacgagctcaagttttacgtgcaaattggggccagaagaacactcaagtatcatccttctcacttgttcctcggaaacatgagcttttctcttcatattcagaagctacatatacatatacatgcgaggacgattatgctacgaagtaattaattatttgttaggcatatttatatgtactatacgtactatatatctctaaatgaagaataatagatagataggaaaattgcatatgggtagtagtaaattatatataatttactgatttaattgtgctgttttaccattgatggagtgcagggtgagaaggtaagaaagtaatcgccccagacattaggatggtgatcaaagtggggtttacagtgcagcagatctcctccttctactggtgagactagcatatcggtgcaagtaggcacaggtagtagtagtacactcggaacagaggttgccatacttcaactccctcttgctctgcaagctctaggatgagttgttgctgagctacaaactaacttggtctttccctaacttacttggctgctatatatagagataggaatcttataaaccgacgtggcaccacaaataaagctccgttcggctagagaagcgtgccacatattcgtacaaaattacatatctaccatggattcgctaaaatgccattactcaatctacgctagaatgttatcctcgaccaatttacctctgaccttcttctttctccctcccacccctcattttccatcatcgtttagttcccacacaaaaattttacaccatattacattgaacgtttgaatacctgtatgaagtattgaatataagcttaaaaaataattaattgcacaaattgcgactaatttatgagataatttgacaatatagtgctacggtaaatatttgctaatgacggattaattaggcttaataaattcatctcactgtttattgagggattatgtaattagataccgacgtgacacgctaaaactttacatccctatacctaaccacccccttaatcccttaatcttcatgtttagaagattcgaacgggggatccagtcttcaacttggcacgcacacgtctcaatctgcctctccattaatagccaaacaagctgtgtggcttttctcttgcaacttgcagctgtgctgatgttgctgcattctggtgaactaggctaaaaggcattttgtggtcaggccctgtttagttttacggtgaaaagttttggcgtgtcacatcggatatacggacacacatttaaatattaaatatagtctaataacaaaataaattacatattccgtctgtaaattgcgagacgaatttattaagcctaattaatacttttatcaaatcatggcgcaattaggcttaaaagattcgtcttacaatttacacgcaatctgtgtaattagtttttttatttatatttaatactaaatacatgtgtccaaatattcgatgtgacatgatgaaaagtttttgcgtgaaaactaaacaggacctcatccacattgccatggatacatatcattcatgccatggctagctacctcttgataatagtagaattgtcacgccccgaactagtcccgaccggaactagcccgtgacgctccaatttaacctgttaatcgataccagtcccaggaaatagtgctggtatgacagggagacagaatatcacagcaacagaggtctctttattatagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggagtatgtgcaatgtatcagtctttagaattgaaacaagattggcacccggccaacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccacacaacattactaacccggatcacccagcccgtggggatcagccacgtcgggagacctccaagctttcatgacaaggcatttccaaagccaacacaggtttaccatatgccgacgagaggggtcccagaccaacaacaggttaggtcccagaccatactgtgccaggaagcccaggggtcctccccgacaccaccccggcgaatccacatgtctctcggcatcaaggcccccctgataagctagttactcagccaggggtgtcccattccacccatgtggtcatacttgtcttatgttcggatgaaattccaaggaaacggtccttaagtgcgagagcgggaaaaccgtacacccggtacgttccccggtccgcggttttggaaattcatttagttcgcaagcactgacccaggtgtcgggttttccaagtcttttgtaaaacccaagttttacccaagttgttactcagattttaagtttgaaggcgaccgtcggtactcgcacagagtgcacgattcccgaggcgcaactgggtggttacaagggaacatggtataacaattaacaaaggaaggatcatatgcaacaaactaggtaggtccgccaatttgccttgcagacgggacaaacagattaagtgcgatcctatcaatgcataatatttttcaagcaacttaattaaatttcaaatataggctcaagatgttcaaaggtggcttgccttgctcgagatctggagcttgatcctcgaaatcctcgcgctgcgggtcttcgggctccgaaactacacgcgaaacgggacaactcaacaaacggcgaaaaaataaagccctattaatgtcctctaagcatgccattagatagatctcgagatttgaggaattttggaagttgaacggagtcaaacggatttacggttgggaagatattgaatttctaagattattggatttttggtctaaaggaaaaggatttaattaaatccttttggaaaagaaaagaattgaaaagaaaagagggagggattatagacttttcctcgggcggctaaggcgcggcccaagggaaatggggtggctcggccgagcttaacgggccggccggcccaagaaggccccatacgcgcgcgcgcgcggagggaggagagagagtccggtggaccgggctcaccacgcgcggtcccgggtgggacccgcttgtcagcggctcggctcaccgtgcggagggagtacgcggcttatgcgcgcgggcgggggagggatgcggtgcacgagcgcggctcgcagtggacgcggatgcggcgggcccacgcgcagcctcacggctcacggtggaacgcgcgcacggggagggactgaccggggtcggctcgaccctggtctaggctgagctggcgccgacgtggcgcctacgtggcggccacgtgggctggcgggagttagacgacaacccggccgcgaatggacggcgggcggcggcggcgagcggcggagcgaaccacggcgatacgggcaaaagcgagcacaccgggcggttgttcgtgatgaggggagacgagccaacggctcggattcgccggagggagcttgacggcggcgaatcgcggcggcgacaaccggcggggagggaagagggaaacggcgacgaggccacgaggggtcgattcccggcggttagagcatctacgcggcttcgggaactcgacgctagcgtcggattggacggagctacgccgagcgaggctggcgacgtgcgggtgctacggagctcgagcggcgacggcagcgagcacacagcgagcgacggcaacggtcggggcggcgccggctaactacggggaggctactcgagctactaccgaaatctaaggggggaagatgaagcgaggaggaagaacggagggaggcactaccgtgatgaggaggggcgttgtgacaagaggccgacggcgcgggagtaatctctccggcctcgggccggggaagaggaagaagagggcgcggccgaagtccccttccgcgtcctcgaacgcaccggctctcccggcgctcggcgaaggacggcggaggcgagactgagcacgggggcggcggcaatggcgcggagacgaatgggagaggaagggaaaggggaggctggggtttaaatgggcggcaatgtcggtttgggaaccgacttgcgcggtcaaggtcgcgagctggcgctcggcggtcgcggccaaagcggcgacagggaggatgacgccggcgaggaggaaaaggggaaaaggagggggagaaaggggggcttgcccctttgccgattcgggataaaggaggaggggagcgggggcgatgcggcatagagaggaggggcgctgcctccgtcccttggcggcttgcgcgcggagtggcgggggctgggcggtgacgaccgcgatgacggcgggcggtttggagcggcgcgacgacacgggcgacagacgctgacgacggcggcgaccaggcggtcggccaccacggcacgtgcgcgcggcttgcaacgggaggcgcggcggatggagcggcgcggctcggcacgcgcgctggctgcggggccgagcggctgcaggcgcggcagggcagcggggccgggcggcgcaaacgcgacgcgggcgaggaccacgcggacgcgcgcgcgatcaacgcgcggggagcggcagtgagggagcggaaaggagggcttggct

SEQ ID NO: 8504 - DNA, 7321 bp, Oryza sativa
  unsure (1)..(7321): unsure at all n locations
aattagggtttttaagagataattttcccgctaggcgccacgacggaatgggcactacagaccaacccccctaacaagaatctcgaccctgagattcagcacctaagggagcagctccgggaactcggagcggagaagatcttctcgctcccaggttgcctcgtcttcaaaatgattgctccattggactttgtagaacttgatggtcttccttcgagtctgacgttctgcctcttcaagaaccttgatcgggctttccttgtaggtcagattcttttccagttcgatattacccagggggacttgctcttctggaactcgaagacatttctttagctgggatacgtggaacacgttatgcacatctgcgagaccttcaggtaactcaagctgataagccacttcgccacgtctggcggttatgaggtaggggccgatgtagcggggtgctaactagccggacatcccaaaccttctcacaccacggaggggtgatactcgcaggtacacatgatctcctttttcgaactcaaggtcacgccttcgattttcagcgtaacttttctgacggttctgcgctgtctttaaacgttttcggattagcttaacttattcttctgctgacttgagtatgtcaggaccgaataccagtgcttcgcccacctcattccagcacaagggagtgcggcactttcttccgaacattgcctcattcggcgacatctgaatactagcctggtaactgttgttgtatgagaactccgcgtacggcaaacaacgatcccaagtgccttcgaaatccaaggcacacgctcgtagcatgtcttctaggatttggtttaccctttcggtctgaccatcggtctgcggatggtaggctgtactaaattttagatcagttccgagggcttcatgcaactgcttccagaaccttgaggtgaactgagtgcctcggtccgacacaattttcttgggacagccaaatctacacacgacatgggtcatgtagagttctgctagtttctttccatcaaaggtggttttcactggcacgaaatgagctgatttcgtgagtcgatccacgattacccagatggagtcgtacccgttaggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtctttcttctcctgtattcctttttattaattcttttatcccttcgttgtctttctgagcctcccggatttgcgactctagggtaggctgtactgtcaagctggcagggacacctgactgtaccacggtcagccttaacttctccaattctctgcacaggtgatcatggtcaggccgtatttgagctacattgcaataggccttgcgacttagcgcatcagcgaccacgttggctttaccaggatgataatggattccaagatcgtaatccttgattagttccaaccatcttctctgtctcatgtttaactcggtctgtgtgaagatatacttaagacttttgtgatcggtgtatacttcacatctgttcccgattaaatagtgcctccagatcttaagggcatgcaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggatgcagaccagtgaaatttattttccttctttaacagctcggtcataggtctggctagcttagagaatacttcaatgaatcttcgataatatccagctaagcctaggaagctgcgaatctctgacacattcttgggcgggttccaagcaagtacagcttcaaccttgctgggatctacttcgacaccgtgggaggagatcacgtgtccaagaaatgctactcgatctaaccagaatttgcatttcgagaatttagcgaatagttgatgatctctgagcttttccattatcagccttaggtgttcagcgtgttcttcctcattcttggagtatatcaggatgtcatcgatgaacaccacgacaaactggtccaggtattccataaagattttgttcattaagttcatgaagaatgctggagcattggtgagtccgaaggacattactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcaattaccattctctcagagccatcctttttcttaaccagaagcactggggctccccaaggggatgagctaggtcgcacataacctttactctccaactcttcgatttgtcttttaacttctgctaactcattagctgccattcggtagggcctttttgcaattggagccgtgcctggtgccagttctatagcgaactcaatctctcggtctggtggcatactcgttaattcttctgggaatacgtcgggatattcacagactatgggcaccgactcaaggaggtgacttgtaaacaggttaggatagaccgacttgcggtaggggtgttaggggtaaagcggacttgctttcctccaggtccttgcaaggtgatggactttcggcacaatctatctgtcctttgtgcttagccaaccaatccatacctaggatgatgtccaagctttgcgagtctaggactatcggtttggctaggaagtcaacttcctcaattttaaggttaacttccgggcatatttgagttgcccttatattccttccaggggaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtttcagcttgaatatggttcacacgtcctcgaccaaagtggttggaagcacgtgaaccttgtccacttgcctgagagctgggacgagactgagctgtcgctggagtaggagttctggcagtgctgccattagcatgtactgagttggtgttggtaggattctgaggacactgtctggcatagtgacccatctggttgcaccggaagcactgaactgctgacggtccctgtggtgacttaaaagaggtaacactgtttggcgcagtattgccactaggggcacgctgctgtggctgaggtgccggatggttcatctgaggacgaggggcgtagcctggctggcggttagcctgagttaccgactggtgatattgcatgggctgaccgtagcgagggcgaggtgcgcctcgggaagaatttccctgatggttagacttgcgtttcttgtattcttcgatagcctcttttctggcatcctcaagtagaagtgccttgttgatcatatgttgaaaggtgggaaagtcatgagcaagcaactggagtctcattccaactgcgatccccttcaaaaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcatatgagctgcacggaaagccgtagcaaactcatcccaagcaatgttagtgggttcagggtgtgcattgcagtaattctcccaccaatctgcagcgggtcctcttagctggtgagaggcgtagagcgtcttctcaacaggagtacactgcactaagttgagttttctatccacatctttcagccaatcgtcagcctcgacgggctcgacggtctgagagaactctggcggacgagacctcagaaagtctgtcagcttggatctattgttgctcatgtgagggtggccatttccatgcgtattatgctgaaaaccggctatggctgcggctaatccttgcaagatttgtgtctgaactgccattaagtgttgcatgttgttttccacatgaggtggggaagggaggcgttcttctccagaattgtgactggcagtgtggtgagagcggtgagactattccatcttcgtatcacgggaagctgtacgatgcgagcggttgctgtggcggggttgctcaacttctgcgttgcgggaaacagtacggtgtgaacggttgctgtggtgagactgctcattagctgactcatgatttgcttctggctcggctctaccatcttcaaaaccaaagcgggctggtgcacgagctgcacggcgggggcggctagccatctaaactcccagaagagggcggggtaagagttagataagcacttaggagggcaagtagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctgacacccggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcggaccactgggagtgcgggcagagccacgggagctgtgggaggacaggtggctggcgtgacagagccggcctgagtcccaggagatagtgtcaactgaggtgacaccctcctcggccagacgggcctccaaagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggccacggtgaagtggtgtgggcgaaggccggctccgtgtatacctccacgggggtaaaggtacacagagagctcacagtgagggggaacacggtccacggagtaccccgtgtactcgggacacgagaaaccgaggaaacgggcgaggtcacgaagctgagcgacgtggtgaccctcaccaaaaccgtgggaactgaagctggagttcactgccatctacaattttgaaagagggagaaggatcagtaaccattttagaaacaaactattgaaaataaggaaaccaaaagaagccttagcttttcgcaagcagttttgaacttagtatccttagggtcgtcctaaacgtcgggtttcgccctagggccaagcctgtgctctgataccatctcttgtcacgccccgaactagtcccgaccggaactagcccgtgacgctccaatttaacctgttaatcgataccagtcccaggaaatagtgctggtatgacagggagacagaatatcacagcaacagaggtctctttattatagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttttttgaactcttttctaaaaacaactaagtgagtgcttctcaaacgacacggatgagacagtgcgtctcgtccggtcggagtatgtgcaatgtatcagtctttagaattaaaacaagattggcacccggccacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccacacaacattactaacccggatcacccagcccgtggggatcagccacgtcgggagacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8505 - DNA, 1105 bp, Oryza sativa
atggagtgcgaaagatgtgttcttgggatcctttttctgattattcccttcccgccctgttcttcgtggaggggtgtgtgttcttgaattcagcaatgcgcgactgcgcgtgttcttaggttgtactatgatatatatcggttcttgaattcgcttgtggacgaattcgtcggattgttagtggagcactcacttctgcaccaaaaattgtgcagaagttactttttttttcttgtccatgatggagtctgttagactgcatcggaatggggtacttctggaatttgtttgtgattatatcgattctttgctcactagtaaaatgcaaccttttttgttttgttctaattttgcctgctgcttactgctgcaccaaaagcaaaaggaacggcctttgagtcctgacaagatgtgcttcccattgttgttgtttgtttcatacgcatggtgaaggtatacacttgtttgtgtgacattgtctgtttgttgcttttggatggttcttcatgatgttatcaatcttgtctgaacatccttctgcgatagctgggtggttttgcaaaacagaagtatatatatgttcttttttttcactctatttgtattcatgaattttgcattttgtaggtactactccatgtatggccatgttgcaaagctagcagaggagatcgagaaaggtgcttcttcagttgaaggagttgaggtcaagctatggcaggttgtaccatgaaagtgattttgtgctttacctagagttatgattacccgcatgttttgtttaacatgttgataaaattatcatatgactaggtcccagagactctttctgatgatgtgctcaccaagatgggtgctccttcaaagaaagatgttcccataatcacacccgcagagcttgccgaggctgatggtgtcatctttgggttcccaactagatttggaatgatggctgctcaattcaaagcattcatggatgctaccggtgggctgtggaggacacagcagctcgcaggcaagcccgcgggaattttctactctactggttcccagggtggtggccaagaaactactccgtaagacgcttccaaattatgctgaaatt

SEQ ID NO: 8506 - DNA, 327 bp, Oryza sativa
aatttcaaccaacatgtaagctaagtagtaagtacgtctagattgctgtgatcagtgtagattctcggttcatctcacgtcttgtttgtgaggagtaacatattcctttttccccgaaaaataaaatgtagattctcggttgggtttgtccatcgttgcccatgagcacgattgtcgaaaccattaaacggtgttgatttttcatgaaaaaaatttatatatagaagttctcctacaaaaccaaataagtccaaacggaactggaagtaacacaaaagtaataccactgtattcatatttcaatggaaaaaaaacatattttacaag

SEQ ID NO: 8507 - DNA, 1413 bp, Oryza sativa
  unsure (1)..(1413): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggagctcgcgcttgcttagtaaaagttgcagaggtataccttgtgtgtagtgagagagtattttcaacaactaagctaaattacgtttaggaatgtatttcatacgaatgcttcaataaagttttaaaacaattagttagaaatattgtgataatataagttagtgcacaaacatactgctacaaattcgttctacactaaataaaaaaaataaaaacaacaaattatgtctgcactatatatatataatagtgcccagtttttttttatttcctactactttaaaaaagggatttcgcaagcgagccacattgaccatcgaggtggttcatgaggcaagtcgcttgtgcagctcgtgagaggtggcggtaaggaccaactaaggaaatagttagcctctaaaaatcagttttttttccatgcaatcaactaaactgacaactcgcgaaaataccatattttcgttggtggttggtttatgctcccctatgccgtaaaccgactgtctttgaaaatagccttcactatatacatcttcttcctcaaactcctctatttcagttacattgttcgtgtgagcatggatgaaaccaaaccatgcatgcattcacaaactaaaaggcttgattaatatttataaaagattctgagcgacctatggctaggcaggatgagtgaatatgcaagcacatatgtgggcttgggaagcgtcgagaacacccgtggcacaacgaactatccttttgctgcttgagcatttgtggtcagtgcaaagtcaccttcagcgttggtacggcatgattgtggccacgacgcgcgtgtccatcgaaaatgtgtttttttggcgtggctcagcttgtgttcccctgatctaatcttatcgaattgaagttggagttaccatttcgcgtcgatggtgtgatgacgatctatgaaggcgagttgttattaccggtgttcatcgataaaaccaacattgtgcttttgaggttgctagtcttgttcctgtggttgtatatgttgactggtagtgtgttctttgtgtccatggtaacttaatttagtctggtttttcctaagggaataatagctatacgaaacttagtcagagagaggatcaaaccg

SEQ ID NO: 8508 - DNA, 1474 bp, Oryza sativa
tttgatgaagaatacaatgaaaaggttacacaggagagtacaaagacgaatccttctaaaagaagagttacaagacgttttaaaacatctaacaaggtacttcatttattttactttccaaattcactcaatttagttttcacataaattatttaccatttcaatatggcactatgatataggctaagaaaggaaaatgttctgaaatgaaaactcagagaaataaggtacaattcttacttttctttcatatacaaaacgatttgtcaaactattactgacatgttatatacaattgatgggtattaataggaaccatatactactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttactttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgctttaggaactgctaaaagaccatcaaggaaatttataatttcagatagtgaggtactgcatgagacaatttatcaagttattaattaatatatattttttttgtaacaactaatttttttccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattaggtacaacatattacttctgggaaaatgttggttgctttagatttggtttgattagtaaattataataatatggtctttcgtctgcaggtaatttatcgtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttaataattcttaattaatacaaatccccgggctgcaggaa

SEQ ID NO: 8509 - DNA, 1714 bp, Oryza sativa
tgcagctgctttattcctgcttctctccagtacaacattgattgtgctacaacatactctagcgaaaggctgcaattcaaaattaccatttacagtgagtatttttaccagctgaaataggatgatatttcaaacattatatcttcctttcacaaacaatatatttcatctttgtactatattcaataattactacctctgttttcaaatgaatgacgttgattagtgcaattttgaactaaccggcgtcaaacaaaaagaaatggagagatataaagttataggataattacattttccttctattataacatttttccccagaaagtaaacatccatgaaccatttatttttttagacaatggattaaacaggcttaaacatccaaaatacatgtacacagccaatgagccatttaatcacatcataattccgcaatctttcgtattatgcacataccgtctttccatagagctgtgaacaacaactccatcgctgccaattgtcccctggcgaacaccccagcagctgatgccaaatccactaatcaaggaaaatagagaggacataaccaatacagacgaaggaagatagagaggtcgacacaccgcagccgccaacccacccactgagctaggagataattcaaggaggatgttgaggtgaggacggaacatgggaggtggatatggacatggcgctgcaagcctgcaacagccactggagggagggagtcgggaaactacaggagacccacgccgtccccgccactcgctgctctccgcccgcggaccacgccatccccgcctcctaccatatgaagttttgtgaaggtctggtatggtaattatatataaaattatcaaattgaaagcattttttactttgaagttacaagctttttttactacaattagttaactacgaaagctcaattatacagagccatacagacacccttcatgatgggccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccgcgtcgccgtccccccgtccacagcgcctgcagctctccgctaccgctctctgcccgcaacccacgccatccccgccgcccgccgccgtccccgccatctacgccagcaacccacgccatccccgccgtctgacgccgtccccgccacctacgccgccaacccacgccatccctgccgcctgcgccgccgtcccccctgcccaaagctctccgctcgcacctccggcccgcgccatccgccatccgccatccgccatccgccctcctcgtccgcccttcccctcagacctcatcctttccattttcccctcttctgtcactctctccttgctatccatacgtatactcgtatagcggaatagaaaagaagagcaaaaaaaattagctgagacagagttacagagtattaggtgcctactactaattagtattttagtcaaagcaaagcgatgcaaaat

SEQ ID NO: 8510 - DNA, 4025 bp, Oryza sativa
gattttacacatgcttctaaaaaaccctacgctatcacatgatttaaaatcttagacctattattttggaccattacattatatcttttcaaaataaaaaacatatataaaatataaaaaaaaatatgaccattgtaactttaatcggtaaaacaattatttacatccgatagaccaatccttaaaaatacaaatccattccacctccctcccgtacataatcactcgtctctccacgatatctgtacgtacatgcaagatatatatcttgcatataacagaattttaaaaaattaccatcgagacaatcgtcaagctactaatgcaaaggttgtttgattattatttgtccagatgataatttgatctaactgggttaatacattttaaattttttacactctatccaaacatccattctattccatactatattttaaacattcatttctatcatatttatataccattttcttttcttttctcaaaatcatttatataccattttctattcttttctaaaaatcctgtgttacaaaggaaaccctaaattctttctaataacaacaaaaattatgatagtttaaataatatgcccgcgcaactgcgcgggctaccttcctagttcagttataaacggcagtgaagacaccatgcacgaaattcagaatctttttcttagagagtgagctttgagctagtcttcttgagctataggaaaagagagtttttcaagtccatcgggtggtacctccaggtatcggtactgcatggtaccaaagtaaatctaaccgttgaatcaatagggtcacgatcggaagaacaaaatgaggatggataaggcctcgcgagccgatcctcccgcgccaatgcgcgaccctgtcaaaggcgcgaggccaacctatcttggcattaacgcgagtccgtatctgtatttgttgaaggtggcctacgaccctaattcttttcgacggctgcggtggcacgtcggagaggcgagcccgaccacatttgatccacacagcggcaccgaacagatctaaggcagcgcagccaccctagttgcatatttctttcttttgcatcgatgtctcagcctggtgttgccatcttcgccaccagtgccaagccgcagtagtcgagtaaactaagccaccactagcgaccatctgtacgccgagtccgcaagtgaatccaccgccactagctccgatgagatagtcttagattggttgagggtaaatgagcatgacggtgtcaggaggtcatgtctaaaaggaattttgtttcggatgagaagatctagatcgagaacctccgtagccatggagaagagcacaagcttccactttctctgttctcatgagggtgaggacaaaggaaaaaaaaagcggatgagggtgcagagaaatcaaacgtggaagagagagagagagagagaggggggggggaggctgaggttgtcgttgatcttgggaggaaggaccatgctgccggcgtgtaggacggatgcagaggaggtgccttcgggtagatggatagggaggagcgagcttaatcaacacaatacaaaattcgaggtttgcccttccacttaatcatcctaatgcggacagaggggaggtacaacccaatgggactatggtacctcgcggtaccaacattcatcagccatcggatcaggctaaatggacgtacatgatttggtacctcctctccggatggatgatagtaaagctcatagggaaaactgcatgagcatattaggcccatgcagtttttcccatttttaaaattagcaatattatatatttaaatatagaggtacaggagctggtttggactactatttgtttcaatgtttcaatcttgaatcaataatagcctgagtttacaacagaaaatgtgcatataaatgatttaatgagttttgagtttttatcaggcttgatatcccagagttattttcctctacttatatccaataatacaagactgaagatagatatgagcaggtgaaagcagagtttagtaggtttgattctgtttgacaggagcataaattattttctctgttgaatgttcatatatagagaaaccagagacaaggtaaaaggcgcatacaaaacgctaagccattgatcagagtgagacacaatgcatcaaactttctaagaaaactgcatgagatccctccatctctgtacagctataggcttggaaagcatcaagaatgtcttcgaagctgcatgtcattccaacattgccgaacgctccacatcacccttccaattcttagataggctaggggatctctgcttcactatcttcagagcatagggagcctgacaattcctaatttctggagagcatggcgattctgtgatgctgtgtttgtaacatatggacggctcatgctcatgaatcatgattgcagtgctgctgataggtttttttttttttgaaagaagggcataagctttgccgcttttatattgatagataaggagtaaatagatatttacaggatccgacaaaaatcgtgccaggagcaaacaaaaagcctaatctcccgccggtaaaatctcaattagtttagtcgctcccgctgtttttttagataatagaagctttatttagactcaattaattacaatcaaactgagtcacctccggcctctgcataaaatgcacacagccaaaaaaagaagaaagaaacaactagaacatctcccaagcacaaaagtttaacagaaacatatatcgctcccgctgtgacccaagtatgcgcctcctccttgattttggcagtgatggtagcaggcgtggatgtaacttgtctgaagattctggtgtttcgctcgccccataattcccaagcaatctggatgatcattctgaaaattgtcaagggttgcagcagtagcaatgttagatagagtaccactggaaagccgtagacatatatctgcataataatagctgggaacatgctgaacaaattagtattacatgttcttaaattaaaatgataaagctgccgaatttacagagtcaatgtaagactgccgactgattgatgtctgtttaacactatgcaaataactgtacacactaatttcatgtcaaactacttgggacacggttgagtattgaaactaggctatggcaaattattttcaccagaagtagctcgagctgttaaaacagctgtgagaaaaataaagagtgcagatcatgagccacgcccaatcatataagagagaatcacataatgaaccgtgctcacggtacagaattgcaattaggaacgtgttgacattgaagattgagattgaagacgcacatctatatatatttctggagctaggtagctcgtttggcaagaaacagatgaccatggccaactgaagtacaaaagcctagctagagcttctgcaagagatgccatgagtgttagaaaattgcaagcatgagaacggtgaaatcatataggcttgggaagcatcgggagtgcatctgacacaggagcagcgaaggactgtgcagcggtacagctctccagactcatggcattttcgatatgaaacgaacacagaatgaatcatgcatatgacagttcagtagtagcttaagaatctatggagatataagcagcaacccttgacaattttcaggtgttttgtgcagggtgttggagcgatttctgctggaaacgtttcttggagctgtcacttgattggccagtcttgcaggtgcacattgtgcaccggcgtcatgtctgatagggagaaaccgaatggacagtacaagaacgcaaggatttcgcagttcttcgatccatattcgagaagcaatatgtcaaactccaattatgctggaggttgggagtgaataggcaggagtagaagttgcagagtaatgttgagatggaaggaagaagatgtcaagactgtactagaggtgaagatgtgatcctgcaagagtgattagtgttgttgtaaactctgctattgttcgtagct

SEQ ID NO: 8511 - DNA, 679 bp, Oryza sativa
atctaccaaggcactgacttggatgccctatggtggatctagccaaccagtctttcagccgtcgctaccacaaggcattccctctcaaatcggctccgatggatgagtagtggaggagaaggtagtgatgagtgagctagatagattggagaagaatatatgttcagattctccgccgcctggccttcgccctcatgtggccattcgggacaggaagacaaacgcgaccgcagcgcagatatgtggccaggaagggcttgggaggagataacgatgtgcctgcaattttacactttggtcctgcagtggattttaatttataaatgagccctcagtctattatcagtacttcagtaatgaaacgtgtttagtatttaccaaaatataatgaatctccttaggatgattgtaaacctttggatgttctaaataaaaccgcatcaaaggaactttccaaatgtgtaatatttaaatggatttcacaataatttaattaacttctgtaaaaatcaggcaaaaaatatctaattagaaatttgacaatatatatatgcaatctattttcaagtacaataaaaaaaatataccatctattcagcttatcatccgtaccaataatttcaattttaaaactgccaaaaaaagccacattgttttttatataaccgtactaaaagta

SEQ ID NO: 8512 - DNA, 617 bp, Oryza sativa
aaagaaaccacttacttacctttcaaatctgatgtgcaaagaaaaaggaaagagatcgaggaactacatggacaatatcagagtatataactccatgtttgcatttacctccatgggaggaaaagttgacagagagataaacaatgggtctggaccatatgttttccgcatgaatggccagaactaccaccgaataggtactctactgcctgaagaaggcgataaacctcgctgggcgcaactttacatctatgacactgagaacgaagtcaaaaacagaattgacgcatcaacatcatcccataatagagaatcaatagattcacacattgtcttaggcctaaagaacatgctggacagagaaaacgtactagcacagacattcagaatagcaagagatagattcaaagaaggtgactatcataatgtaagcctacgacttataaggaagcgtggtggagatggcaggcagcataacatgccatcggcatcggaagtggcagcactgattgttaatgacacgagtgagaaccaaaaaggacgtgacataattgttcattataaagacacagggcccagaagaatatcagaaaaccatccaaaattgggctgcagga

SEQ ID NO: 8513 - DNA, 676 bp, Oryza sativa
tcctgcagcccctgaaacctgaatgtaaactctttgtgaatccaaacacatggtatacatatatttgtgggcttggggagcatcgagaacatgcgacgcagtgaagacatttttcaggcagcaaaagatatgacaaagtcgcctgactttccagttggacctgatgaacgtcgcaaggtttccaggccgacattgctacgtgagattgatggatgcttcacgcaggttgttctgattatgtttagtatatggccgagtggattaactaggtgacgaattaaccaaccaaaattaagctgtttgatctcactaccagacttagcacctagcctgtaggcacgaaacccacaggaaaatacattttaccgtcagaaattgtttttctgtggatggaccgacagaaattgccatcagaaaaaagaccacggaccgacagcgctgtgagagaagagacaagagagtgcagagatgatccgtgcatatatatgcaacatagcttctcatgggaagtgcatttttgtccatagctcaaggggatatcctctcgttatgtgcatggcgttcaaaaagttatcaaaaatttttaaaaaattatcaagatagatcaatatataatatatcttttcacaaatatgcaagttaaaattcgacttatacaattcgaaacaaatatagc

SEQ ID NO: 8514 - DNA, 21754 bp, Oryza sativa
  unsure (1)..(21754): unsure at all n locations
ctgcagccccaagacgggtataaggagagcagaattttattggacctagggtctatttgaaagagctccaacttctaaattaaatttagctataggatgggtctggagtggagttgtggagcagcctaaacccagctccacctctttaattcattttgtgagagtactccaccggccagctccactctcattttagctaggttgagctaaaactgtttggctggacttcatctctagaaaaagttgagctggagctatatatcaaacagtcccttactatgcgtacaccacaacgcacttatgttttcgttattgctttacaaatgcgtggacagctagctatatataatataacctagcctagctcttctattactagcaaaagtatatgacgaaatgatcctattcaattccctgctagcgcgcgcgcgcgcgcgcgcgcacacacacacacacacacacacacacacacacacacacacacacatatatatatatatatatatatatatatatatatacggtaaatttgtttggggctccatggggcctgggcaccattgttgaaattgagtatatatccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaatacagttaaaccatgggttgtctcatattcagtcacaaaagccaatataccctagctctcatcacaaacaagtgatgttctatctgaacaatccaatagtaatgggatcaattaagccatgactactctctgttacacgaactgatcatcctgtactcgatgttgggcaatataattcagcacggtggaaatgcaaaaggttggtcgtctggcaacgcggagcggccgtgcagggatgttgtctcctccaggaaagttctccacagaaatgatccatgtgaagaacgtgaantancaccanctgaaatctgccgttcccnaaggccaaactgcagaaccnacactcttgacaccatgtagatgaggtaggctcgccattcttgtggataatgagtcagaagaggaggaggtgcattttacacacagtccccatgcctcctactcccaaaagtgcatagcagaagaaggtgtgcctgcatgtagaactgaagaacagaagaagcataagggcatacacataaatacaagagttgctaccgtccagcaggcagcccggtaccaaatctaggcccttgattttgtccgatcgaatggacagcaaggtctagtacctccaggtacatttttgtccatgcgatggtaccagcactattgagagaggtggaagggcaatactgtattttcgcgtgtgaacggcaatattgcattgcctaaatctctcgtccttattgatctgattccctcgatatatggtggcggcggttacagccaaggttctggtgacagcgcaggttgtgctccaggtcgtcggtggtcatggagatacctgatgtggcggtggtgctccattagtcgtggcgaagagaggataaaaagagcgatggggttggatgatgagaatgcggcggtgcgaggaagaagatagggctcgcgcgatggggttgttctctctcgctcattccgggtcctaccccctcaagttggacagctggattagtttcagtaccacctggtactggtacctctcggtacaaagtgctggatggtagcaaatctctaatataaaggatttttgaaggatgtggcacatcctacgaatctagacagtctaaattcctagtactaggatgtatcaaatccatccaaaatctcttatattttggaatggaatgagtattataagtcgtttgacttttttctggtcaaacttttttagtttgatgaactttatagaaaatatagtactaatttgaacgaagaacaaacatattatcaaaatacatttaattttagatttaatgatactaatttgatatttcatatatatgttactagtttttctataaaattaatcaaacttaacaaagtttgaatagaaaaaaaattaaacgacttgtaatatgaaacgggagaatatttaactaggacgtagcccaatttcatgatcagaatttaacgagttgagtcagactagtccactaattaagctgcctttgtgtcagctcctacagtcctatctcctcatctccactgtcaattcgcttgctaagccgaatttgcggcgagcatggcaagaacaatctccgtggctatggaggggaaatccgtgatcacatgttggtactcctcgctcgccatgaccgtcttcaacttctccggcggcgacacgacgaggaacctcaagatggcctccttgagccgcgggcagccatggagctcggccaacgccagcgacgtcgccaccgtgccgacgtcgaggtgcctcaccatcttgtcctcgcacaccttcttcagctagcctgtccatgtcgtacctgtccgccgggacgagaaggtgcggcgccataatcaccgtgcgctcgtcgtcctccatctccggcagctcgtcggtgtagacgaagtagagcagcgcggcaaacacggggaccttcatgtcgtcgacgcggatggtcctcgcggcgtgctccttcatggaggagccgaggagctccgccctgaacaccggcgacgccgctccgcgaggacgcaccggtgcgccgggaacgtctcgccgcggaccctgaacctcacgtcggccgtctcgtcgtcgaacaggaggcgctcggcgaggtggcagcccaggacgggcggcgggagctgcacggcgacgagccccctcacgcggaggtcctgcacgttgaaggtgaggtcgcaccggatggcgaagcggttgccgacgacatggccggacttctccagctcatccctcttgatgaagctattgcaaacccatcgatcggtcttcttggagatggaacacttgtcgccggattggctgtaccgtgccacccgctcgccggcgagatcgagcagctgatcttgacactcgcgttgacatggacgctggcgcagggtttgaaatttcgccccccaccggcatgctcaaatttcgtccgaaattttcagttttttacagttttttgtgaatttggtcaaattttgttcaaaattcaaaattattcaaattcagtcaaattttcaaataattttggcttgaaattttcgaaatttcggtaacccccggcataatatacaatttcgaaattgaaaaccctgcgccggtgacgaggatgcagtcggaggctcggagcgcgtaccagagatgcgatgtgtagccgccgacttggaactcgtcggagtcaaggtgtttgccggtggcaatcatcaccgtcgtcctcgtgtaaccatcgattttgaggacgtggtagctagccaacggtgacggcacgacggcggcgtcgccgggtttcttcttggcggtgtgagggtgagaaccaatcgtacacatgattaaggtgaccgaggatgcaatagatcgatggatgtagttttgcgtggcgatgtacgtttattttctcctttatatgaaagtggttataactgccacacaaatagtcaagtaccaggtatcctctatagttcatcttcagataaaattttggtagaacaccaacatttgctttctctaggatcatagtaggatttgaaattttgctaaggtagctttaccaatccataattcatccaaggaatcgctatatagttgtcgacagaattttgcggaaaaatcattctatttctgggctgccggattgtgatgagattcattcgagggggagggaaacaaaaccacgtcgtgtgaggaaagatcgaaccgatgaccttatgcgcacaggcgcgcatagccaattgtcccacatgggtttttgaataattatgtactactccattaaaaaaaaaccctagctaggattgggttttttttttacgaagggttacaaaatacatataagttacagtgtggtcacaatctagttaaaaaaatataatatagtaacatttgaaagttttttactttaagaaaaactagtggtctactttagatttacaatatatagtttcacaatattattttttagtacaaaattaggtacctcgaaaccttttcttaagaccggaaaatttctcctgacgaactcacgatcatgaagcattctaaacaggagtataacataagctactaaattaatggcaaaaaataccgatcagaaaaacatgctccaaacttcacgaatttccccaaaaaccgtgcacgtcgctgcctacgctgtggatcatcaccggtcgtcgtcgaatcagtcatcgtcgtcggcgtcgacatcggcgtcggcgtcatgctagtgtcgtcggcgacgacacgcctgcttaatttgtcctcgcagaccagcttcagcctctccactttgtacttgtcagccgccgcgatcagctgccgcgccatggccggcacgtccgccgacgccatctccggcagcgtgtcggtgtacacgaagtgcagcagcgccccgaacgctccggcgtccatgtcgtcgacgtcgatgacgcgtgttccgggccttccggcggcggcgggccttaggaatccgccacggctatatagctcggccttgaacaccggcgaccgggcggcgagcacgcacctgtgcgcggtgaacgcctcgccgccggccaccctgaacgtgacgtcggcgccgtccccggcggagagaaggcggccgaggtggcggtgcatgtccggctccggcacggcgagggacgacgccggctcgacgcggagctcgatgccgcccatgacggtgacgtcgcaccggacggcgaagccgtcgtcggcgaggtgccccgacttctcgaggtcgccgtgggtgatgaatcggaggaatccccaattcttgaatccgtcggaggaagggaagctgtgcacgctgctgcggtaggtgcgcgacggcaccggctcgccgtccttgttgagcagcctgaacacgaacttcgccttgacggcggcggcggcggcggcgccattattgcggccggcggcggcgtcctgcagctcgagcatgacggatatggcgtcaggattctggttgctgcggtcggtgccattggggtagtacctgatgcgccacgcgtgatcgccggcgtggaagcgggaggagtcgatgctgtcgccggcggcgaccatggccttagtccgagagtagccgtcgatcttgaggatgtggtggccggtgggcttcgtcgtcgcgacgatcgtcgacgttgagccattagcttcggctgcgacggcgcagctggttgaagccgccgcagacgacgacgccgccatggtcgcagagatcgtctttgctgttctctatcgatcggtgagacgacgactagttggttatgtgattaactagaacatggaggagactccgatcttatctctgtaagcaacagatgttgcgatttaaattacatgacaaagatttccagaatataaactctctcagatcgaaccctgaaacgtgcaaaggaaaggattcctattagagtcagggttcactctatcggttcaggggtttctatcaggggtcaccgaaatcccgaaatttcagaaatttcggaaatttcggtccgaaatttccgaaattttgaacaaaatttagttgaatttgaacaaatattatccaaattcatgaaaaaattgaaaaattcaaaaatttcgactgaattaatatcgtatcgggggtcaccgaaatttcggtccaaaatttccaaccctgattagagtacgtcttgatcggtaataattttcctcccgcatgcatgggtcccactggtaatatatttttttttgagaactatacagtaaaacgctgacactcataatgcacgagcactcaccaataacataataaactatcaatttttacgtgccatatttgtcatagaagttattttgtaacgcaaaagcatatgtatttatcctctgtagataacatagaggctattcagattatagccaaaataaaccttaacaaattttgccaaatgccaaaaatttgttcaagttggtaaaattaccaaaatcggacgttgtttcactcaatagatcgaaaatgtttcatttaatagataaataattttcaatcttttaaaaagctgaaacacaaccaaatcacctcatgaaatattttgctacaacgtatgaaacaacggtttccaaaaaaaatctgacgatgtttcaacctatataaaaataatgttttagcaaatagcgaaagaatgtttcagttcttaaaaaaagtgaaacacgatcagatcactagatgaaacaatttagttcaacgtatgcaacaaacgatttaaactcattgcaacacttaaaccccgtgtacatcaacaaaccacgtatccatcaagatgaaattattaaacagtatcaaaagtccactgcaatatttaatctacacatagagaaatatcacgagtgcactagctgaaacattgttaatgaaacaaaaaaatgaaacggatccacctgataaggcgtttccgtgatatgccggcggtttgtagcaatgggcacgtgcgtgggaggatggaatcggcacgcattgggtgcccgatcgccagcatttccgagatagataagttttatcataaaaaatctaactagtagttaggctcacttcgccgattacaaagcatgattttatattaaaattttacaatggcacagatcttagtaaagcatctaatgcctaataatactctaccgttccaaaaatcctctatgcgctagctaggaactcaatgtgcagcaaacattgcaagaatctccgtggctatggaggggaagcttgtcaccaggtgctcatacccatcgctcgccatgaccgccttcaacctcgccggcgacgccatgaacctcaggatggccttcttgagctcagggcaatcgtgctgctcggccaacgccagcgacgtcgccgccgtgccgacgtcgaggtgcctgaccatcctgtcctcgcacaccttcttcagcctctccatgtcgtacctgtccgccgccaccagcaggtgctgcgccatcgccgccgcgctgccgccgtccagctccggcagctcgtcggtgtagacgaagcgcagcagagcggcgaacacggaggcgtccatgtcgtcgacgcggatggtcgtcgcggcgtgctccctcatggggccgaggagctccgccctgaacaccggcgaccgcgccgcgaggacgcaccggtgcgccgggaacgtctcgccgccgaccttgaacctcacgtcggacgtcctggcgtcgccgaggagctcgccgatgtggcggcgcaggaggggcggcggcacggcgacgagctccctcaccaggcggtcctgcacgttgaaggtgaggtcgcaccggacggcgaggcggtcgccgacgacatggccggacttctccagctcatccctctcgatgaagctcttgcaaacccatggatcgcttgccttggaggtggaacacttgtcgacgggttggctgtaccgtgccaccggctcgccggcgaggtcgagcaagctgatcttggctctcgcatggagacggacattgtcgccggcgccggcggtccggacgagagcgaaggatatcgagctcgagaactcctggtcgtagccgttggggtagtaccggagatgccaggcgtagccgccgacgtggaactcgccggagtcgaggtgttcgccggtggcgaccatcatcgtcgtcctcgtgtaaccatcgatcttgaggacgtggtggccgctcgcctcggtgacgacgatggtcgagcacgacgacggcgatggctggacgtcggcggcgccggatttcttggtagacatggcgatcgagatgtgaacgtgcaattaatcaatcgatttgttttgtgattgggtatgtgtatggccatgtaattaactttgttgttcctaaaagtggtttgagtccaactccaactccgatataaggcggggctgcttctgacaatacacatacgcattagtttttgacgtggaacctaagcaatttgattaatccaaacttaatatacacagaaactcaaaagactttctgattgtggcctaaaattttcaacgctgtttagtaaaaccttcagttaatattctgaaattcacaaaactttcgttttgattgcaaaactttcaattcaattagcataattttgagttatcataataaaaaaaaaatattcaactccatttgcaaaactatcaattcaagatcaaaaagttagaactcaattttcccaactttcaattcataatctgaaagattcaactctaaaaactttcaacaagaaactaaaatatttttatgcacaaatctctgaaaagtttcaattcataattaacctcagcttccaaattttctaaaaatctcaaatttccaactgagggcagctcatctgtttcctgtccggtggctatcgcacaacgctgatatctcgccagccggtaggagaaagatggtgaattgaagctccctaataaggaagagaaaaaggaataggcaagacagattttgggagatggaagaatggaatgccatcgaatcaacatctaggtagtggtggctcaccaacagccactactagaaaaacgatttttcatggcgtttggaaaatatttttcatagcggctaagtgaaaaaaccgccagcgcagaaattcgcgggggtcgggggtcacgggccgctagcggaaactcatcttcactagcggtcgccttaaaccggccgccagcggagatatggtattttcgctgtcggccctcttaacttggcagattttcgctggcggtaggttaagaagaccgccagaaaaaatagccctatttttgctggcggacttgttaccattttcactggcggataatggagagtgcagcctaaaaaatcacgccatcaaaaaatcagcgcgcgcatccacctacccgtccttatcctctctcctcctccctccatatccaaccctctcctcctcccttgtccctccagatccaacacctcctccctcagatccacaggtggcagcactggcggacacgggcgatcggaggagagggtggtgatgagcttggggtggtccaatctcggggcgtgggcggcaagctcgggcgtgggtggcaacgcatgggcgcgggcgacggaggagagggcggcggtgagctcggggcggtccaagctcggggcgcgtgcagcgaggttgggcgtgggcagcggcactcgggcgcgggcgacggaggagaggacggcggcgagctcgggcgtgggtggcccgggtggcggcactcgggacggggaggcgcgaggcgacatctccacaggtctctctccaccgctcctcactactccccttcccccgccgccaccaccccctctccctttctcagatctggcgtggcgtggctttgcagcgctggtggcgaggcggaggtggtggaggcctacggggctctgtagtagcgtcgtcgaggcggaggcggtggaagctgcggcggggctcgacaccggcggcgtcgaagcggaggcggttgaggccgacggggctcgttagcggcggcggtgatggtggaggggacttcatggacgacgatgacaacctcgagtgcgacgacgccagcggcgatggttctctgtatttgtgatgtttgtaatatttgtgatgatatttgtgaagcactatatttggattgatgcttggtgttcaaattttttgttaatgtgttgatatttgtgatgcttcaatgcttgggtgaatggaaattttttgctgtaaattgttcatgtaaatttatgtggatttatggatggagcattgatggaggtggacggagcagtgcttttttatatatatttttgcttttcaaatttcctcttcgctggcggctagggcagctacatggtttttatttttgctggcggtcgatttaacacagccgccagtgaaaatgaatttttgctggcggtcggtggaagataactgccagcaaaaatgtatctttgctggcggctggcttaagacgaccgccagcgaaaataaattttcactgccggtcgataaccgctagcgaagatcttgatcttcactggcctttactttgtggcggctctaaattctaccagcgaaaacctaaaatgaccgccacgaaaaatggttttcgtagtagtgagccaccactactttgataaggtgttttctaattcgctcgctagtgtatgtgagagaaatagtcttccagcctaatgcatgcatatgattttaaaaataaacagaaagtaattaacaatactagagaaacgatttttttatgctaagccccaaaacacaattatcccgactagattaacaacctgtattaaagatagtttagtactggttctaaaagcccaagtcacgcccaagtcactagaaacatctttagttctgattggtatcactaaccgatactaaaaatatatcttcagtatcggttggtaacaccaattcatactaaagatatttttaagtaccggttggtgttatcaaccagtactaaagatatctccaaggttaattcaaaacgaaagcatctttatacaagttagatgtgtattgtagggggatggtcacacgcgtaagggctcaggtgagagatatttcgttcgaatcacacatatttttttaacttagtatgcatctttagtaccggttctcggttgctactgccggtactaaatgggggtttttaaccggtattaaggatcgtttgagatctttagtctcggtttctacaaatggtactaaggccctatttttttcagcttgggattattataatccagattattgagagtaagctgaaagaaacagacaacttattgaagtagcttattataatctggagcccagcttattataatccgataagctcatttaggtgagctttttccagattattgggtgaaaaattacccaccatgccaccccactccctctttagacttgcaaactaataatctaggctctaataatctaagaaagaaacaactaaccgattattctactacagattataacaatctagcttatagtaatctgactcaataatctagattataataatcccaaactgaaaaaaaacagggcctaaagaaggtttttaaccggtactaaagatcatttcttcggcagtgtaaggaaaaactgacaagatcgtttctgaacaaatttagttatatttattcctatagatgtaaatcgaaattatccatgtacgtttgtatatggacttatattatcacaatatgtctaaccattttgtttataggtttaaactgcatacaagaaactagtgcaattgcatgtatgggcaaaagatccttaggacacccaccagaaaaaaaaacccagctctaacacatcatggctcaaaacgaaaatatctaacagctacccaaagaatcccctagtttcaaggatacgtcaaatgaaacatctactatcacaaactacggctcaaaactaaaatatattcaatagctgtctaaagagtccctacatactacggtacgtacctctaccaaaaaaaccattttcacaaacgtggatatttttttttcaggtggataggtccctcggaactaaacggccgcctacgaaaatggcaacgggggtgagaacgtctttcgtctacgaaaatagattctttgcttacagaggtggatctttcccccacctgaaaaaaaactatttttggttgtctgaaaaaacgattttttagtagtgcattgcaatctcgcaattcgtaatgtttgacattactaacttttggacatatatttatttttttttcatatttaaaagattgcgtaattatcatttcacaagtatacaattttagcacacaaggtaggtggtgttgaccatctatcgcattgtggaactcacaatcatgaataacaaaaaactgttttgtatcggccatccttgtatcagcgctgaagtctctacagtatgatgaaactcccagatgtgcaattttcaaagaactgagccttcgcatctagggttttcaatttcgaaattgatctttctgccgggggattgaaattacagaaatttcgaatttttttggcttaaattatttgaaattttgactaattttgaatggatttaaataaaacacgaccaaattcacaaaaagttgtaaaagactgaaaattttgggcgataaacgagcttgccggtggggggcacgaaattaccgaaatttcgaaatgaaatttcaaaccctgctcgcagttcgcacctagatcatgtaattctgggggtagaaaaagagccacagccgttatttatgtgagtgaaaacaaactttaaaagaacaaacaaccagctactaacttcaaaaagatccccttaaaccacggataacgctgtggcatatcacatgtagctgctgaatcagtcggcgtcacgcttgcgtcaacacgcctgcttaatttgtcctcgcagaccagcttcagcctctccactttgtacctgtcagccgccgcgatcagctgccgcgccatgcccggcacgtccgcctacgccatctccggcagcgtgtcggtgtacacgaagtgcagcagcgccctgaacgctccggcgtccatgtcgtcgacgtcgacgacgcgtgtttcgggccttccggcggcggccggtcttaggaatccgccacggctatatagctcggccctgaacaccggcgaccgggcggcgagcacgcacctgtgcgcggcgaacgcctcgccaccggccaccctgaacgtgacgtccgcgccgtccccggtggagaggaggcggcccaggtggcggtgcaagtccggctccggcacggcgaggagggacgccggctcgacgcggagctcgatgccgcccatgacggtgacgtcgcaccggacggcgaagccgtcgtcgacgaggtgctccgacttgtcgaggtcgccgtgggtgatgaatcggaggaatccccaattcttgaatccgtcggaggaagggaagctgtgcacgctgctgcggtaggtgcgcctcctcgtcgagcaggctgaacacgaactgcgccttgacggcggcgccgttgcggccggcggcggcggtggcgtcctgcagctcgagcatgacggatatggcgtcgggattctggttgctgcggtcggtgccattggggtagtacctgatgcgccacgcgtggtcgccgacgtggaagcggcaggagtcgatgctgtcgccggcggcgaccatggccttagtccgggagtagccgtcgatcttgaggatgtgatggccggtgggcttcgccgccgcgacgatggtcgacgtcgagccattagcttcggcgacgcagcttcttgaacccatggtggcagactggcagatcgtctttgctgttctatctcggcgaccagtttaattatgtgattataattagaacatgtatgtaataaatgttgcgatctaacacgacagatatttccgtaaacataaactgtatctgaactctgaatcgtatgagagttattagtccaagaaaaaggatttgtataagagtacgtttaattagattttttattttttccttgggaacacaatacaagcgcaatagcccatatactcgcgcacacacccatagttacgggcgcgcatacaccccgtactatagtttgccatatggaccacccggcacagcaagtcccggccctggtcatgcccgggccaagatttgttgggccggcatggcccgatctacacgccgggtcatgccgtgccagcccacgtgcttcacctgtggcccaggcacagcacaataagggtcgggccgtgccgggccagcccgaaggcacgggcagcccatcatacccgttccggcctagccacaacttgacatagaccccttcaacaactcagtttgacacaaaaatggtacataacacatcaaattcatgaaattcacatttacttcatcaaattcacaatcaattcatcaaatacatcaacatttcaatccaatctcatagtcctcaatgatgagcaaaaaaacttctcatatttcagtcaaagcagaagaactcaaagttagggcttggaaatagagaaaaaagatagataaaaaaagagttaaggtttgtgtcagggttacaggttaggtataccccttacccttcgatatgcgccacatatcgacatggcatacccgcgcatacacggacattatctgcatacactaaggaaatcttccacggtgtttgagtcctactcggacaagacagggtcgtcaatatatcgtgtagggtccgatgtctccgagttctacttggagaccacctgatctgcgatataaaagggaccccctgggaggacctaaggcatcgaatctcatagccaacacaaccactacagcctacgaagtcggagcctgcaggagctaagttgccgggagatctagtcgaaccaactcgattacgatcttgccggtttcatcgagttccatcgttccctttgtaacttgtggttttccatcatataatcccatatcaactggattagggctattacctgtcaaggggcctgaaccagtataatcctcgtcttttgtttgctcgatgtcgtattacgtagatccttgtaccaacataccccaataccctctatattcggtctacgggtatcacccgtcgacaatggcgcgccaggtaggggcacttggtactcaaggttctactactatgtcatccagctttgtcgacaacagcgtcaacaccaacctcaaccacgggtttcctgcttcaacaatgttagtgtggactcaagtcggcaaaatcgtcttcccggtctacaccatgatactgatctcagccggtccatcaatgaccggaaatgagaacgcaatggctgcaacccaagatgactccgtatcgaaggatcctcccgccgaagcgaagaacggaacatcgacaacatccaagctcgagaaggattctaatgcggccgaaccttgttgttccgacaagaaccacgagccgacgagaacaacttccgaagcgacaaggtcctggtgtcctatccacaaaaccaggaaacacactttgcaagcctgctgggtttttctcaacgtccgcgccgaaattcgcgcttgcaaagagcgtgaaattcagcgtatttgtccaactcgtgatgtttactgtcctatccacaagacaaagaatcacgacctcttaagctgtaaggtctttctcagcgccacgaagacgtcatctcctaaggaccaacagtcaggcatatcccttagagatgaagacaaggaacaacgaacgctggtctcagatcgattcgtcggcgtaatcgacatcaattcccacgaaccatcagtcctacatctactcgaagactacggctcatcaccaacgagtacgccacgcgaggtattagctatcgacgggaccagcacgtcagcacacgctaatgcggaggcggaaaatcaagtgactacaccggcccagcacatcaggacccttaacacaatactgagagagagaccttacgatcccgttctcaacgatgatctcgcgcggtggtaggaacggctacgggaatcagtaaccaacctcagccacgcgttcgaagaagccgctgctgctacgcatcaagaacaaccaccaactggcggcgtcaatggcgaaaatcctgaacagcgggagtcaccccctcgagctacctctccacctcgcggcaccggcgatctccgagaccacctcaatggctgccgagaggcacgacgcacacgagacgacgggaatcgctcccgacatcacgtctcttcccgacatcacgataataaagaacaggagggccgctcgaacgaagaccgagaccgtgctaatcgccacaatcgccacgatcatgatgatcgtgagaggcggacgcagggcgatactggtcgaggacgccgccataacgacgaggacgacagagatcggcgccgggacaacaacggagggcgacgataggattctcgagaacccagccgacgaccccgtaatcccacaccggaaccaagcgattcatcatcatcgtcatcttcttcttcatcctcatcgtcagacagacatccacgaaggacacacgatcgccgacaacccaccgcccccagcgctgggtgtagagctttcggtcgttccctgcgtgatgtccgatggcctgagagattccgacccggagcaatagagaagtacgatgggagtactgacccagaataattccttcaagtctactccacagtactctacgctgccggagcggatgacaacgcgttggcaaattatttgccaactgcattaaaaggctctgcacgctcatggctgatgcatctcccgccctactcgatttcttcatgggcagacttatggcagcagttcgtcgccaatttccaaggaacttacaagcgccacgcgattgaagatgacctacatgcgttgacacagaactcgggtgaatccctacgggaatttgttcggcgctttaacgagtgcagaaacacaatccctgagatcaccgacgcttctgtaattcacgccttcaagtctggagttcgagatcgctataccacctaggagttggcgacaagacgcatcacgactactcggagactattcgagatcgtcgagcgatgcgcccacgtagacgatgcgctgagacgcaagaacgacaagccgaagaccgggggagaaaagaagccagtcacggacgcacctgagtcaagcaagaagaaaagtcgcaagagtgggaaaaggaaagctcaagcggaagttctcgcagcagaatacgcgaacccatccaagcgcccagacccacagagtagcgacgcaaagaaagcatggtgccccatacacaagacggacagacattctttggaagattgcctcgttttcaagaagtcgctcgagaaacatatggcgttggaaaaaggcaagcgagtacgcgtggtcgaaaaagatgcggaggcggctgctcaggaatcagactcagcatatctagactccgacctccacgtctaacacattttcggaggctccacaacgtactcctccaagcgagaatacaagaaagtggaacgtgaagtctgctcgacatggcagggggctgcacccaagatgaagtggtctgaacagaagatagaattctcgcaagaagaccatccccagactgccgtcatcccaggacgctatccgatcatggtcgagcccactattcggaacatcaaggtcccgtgagttctcatcgacggtggtagctcaatcaaccttcttttcgccagcaccttggacgcgatgggaatcccacgaagcgagttgacacctaccgatcaacccttccatggaattactccccagtcctcgtccaaaccattgggcaaaattacgttgtctgtgactttcggccaagtaaacaacttccgaacggagcagattacctttgatgtcgctgaatttgacacagcgtataacgccatcatcgggagaactgcacttgtgaagtttatggccgcatctcactacgcgtatcaagtgctcaagatgccgggaccgaaaggaacaatcactattcaaaggaacgccaagctagcggtacaatgcgacaagcggagcctcgacatggtcgagcaaacgcccagcccacccgccacaactgagcctcccaagaaagtgagcaagacaaacaagatgccgaaaccagacggcgcgatcaagatcattccactctctagtcccaaccccgacaagaccgtcaagatcggagcatcactaagcgagaaataggaactcgcgctcatcaccttccttcgcgacaatgctgacgtgttcgcttggcagccgtccgacatgccggggatccctagggaggtgattgagcacaaactcatggtgcgacccgatgccaagccagtaaagcaaagactgcggcgatttgcaccagaccgaaaacaagccatccgagaagagctcgacaaacttctcaaagctggctttatcagagaggtgctccatccagagtggctagccaatccagtcatggtgcggaaggccaacggaaaatggagaatgtgcgtcgatttcaccgacctcaacaaggcgtgtcccaaggatcacttccctcttcctcgaatagatcaactggtggactcaacagccgactgtgagctgttgagcttcctcgacgcttactctggctaccaccaaatcagcatggcgaaagaggacaaagagaagacagcattcatcacgccgttcggggtattttgctatgttaagatgcctttcggactgataaccgcagggaatactttccagcgcacggtccagggcgcactcagcaaccagctcggcaacaacgtcgaggcatacgtcgacgacatcgttgtcaagaccaagacaagtgactcattgattgacgatctacgggaaacgttcgacaacctccgacgatatcgcctcatgctcaatccagagaagtgcacgttcggagtactgtcgggcaagctgctcggtttccttgtctctggcagatgaatagaagcaaatcccgagaagatcaaggcaatcgagaacatgaagtcgcccacaagactcaaggaagtacaaaagctaaccggatgcatggcagcactaagcatgttcatcgctaggatgggagaacgaggacaacccttcttcgctctgctgaagaagcaagacaaatttgtatggacacaggaagccgaagaggcatttcttgcactcaagcgctacctatcaaacccccctgtacctgttgctccccaacctaatgaagaattatttctctacattgccgtcacgccgtattccgttagcaccgtcattgtcatcgagagagagaaagtacaacgaccagtctactacgtcagcgaagctctccacgacgtaaaggtaagatatccacagatccaaaagctgctttacgcagtaatcatgacgtcaagaaagctacgccactactttcaagcccacagagtcacagttgtctcttccttccctctcggcgaagtcgtgagaaacaaagacgttgttggccgcattgcgaaatgggtagtcgagctaagccagtttgatgtccactttgtgccacgaacagccatcaagtcctaggtgctcgccgacttcgtagctgactggactatacctgataacaaatcagacaaccaaatcaataacgaaacgtggataatggcgtttgatggtgcactcaacagccaaggagcaggggcaggattcatcttaacatctccttccggagatcaattcaagcacgcaatccacctcaacttcagggcaaccaacaacacagccaagtacgaaagactactcgccgagataagagttgtagccgcacttgaagtcaaacgactgatcgtgaaaggggactccgaactagtcgcgaaccaggtgcacaaagattataaatgctctaaccctgagttatccaaaggttcgatgggatcgaggtccgacacgtataccgcaaggacaacatcgagccagacgatctagcacggcacgcgtccagacgagaaccactcgaacccggcacttttctggacgtcctgacaaagccatcagtaaaagaggtcagcggcgaagttaacctagacgcccccgacagcagctcggaggccacaaaggcagaacgcgccgttgccgatatcaaaaccacagacgattggcgcaccccactgatcaaattcatcaacagcgacgagttgcccgaggacgacgcagatgctgagaaaataacccgtaaagcaaaaatctattgcataatcggcaacaatctatacaagaaagcgccaaatggggtacttctcaaatgcgtttcgtccgacgacggcagacacttcctcctcgatatacatgaaggcatctgtgggtcacacgccgccggtcggacgttggtcgggaaagcttttcgacaagggtttttctggccaaccgccctcaaagatgcatgcagcatagtccagcggtgtgaagcctgtcaatttcacagtaaacacacaaagctacccacacaagcgctctagactatccctcttacttggccgttctcgtgctgggggctaaatatactcgggccattcccacgaggacagggcggctacaggttcctattcgtggcgatcgacaaattcacaaaatggagcgaggcgatacccacgggggaaatcaaggccgacaacgccatcaaatttatcaaagggatattttgcagatacggactaccacatcgcatcatcaccgacaacggctcccagttcatcagcgccgatttccaagattactgcatcgggctgggagtcaagatatgcttcgcttcggtctctcatcctcaaagcaacggacaagtcgagagggcaaacagcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcgtgtacggctccgaggccatgctccccagcgagctacgacatcaaagtacacgagtacagaagtattccgatgaggatcaggaggaacagcgaaacgacaatgtgaatctactcgaggaacatcgcaaatgagttgccgtccgagcagccggttaccaacaggccctccgacgttatcacgagaagcgcatccgagcacgcatactttcaatcggcgactacgtcctgcgacgggttcaatgccaaacaaggcaaaacaaactctcacccaaatgggaaggaccttacacgatcacacaagtcttgcggccaggcgcattcaagatagcagatggcgatggccgcgagttggcaaattcttggaacattgaccaactacgtaaattctatgtatgagtcaatataatccatgcctgtaagacaccttacagtatcaataaagcttattttcaggcacatattaaaatcacagtgttcctgcctgatgatcccttacccagatgacacctagcgttgaaacctatcctcatgtccctttacgccgtcctgacaaggcctccgaggaacctaagggatcttcggctggggacgctcagagccgataaggccttgccggatcctgtagagacgaaagaccatgtaagacctggtcatgtaagagttcttgccgtgcgtattaaccaagccgtgtaatcggaaaattaactttccaacatcacggctgggggctaggatcagtgctttctcaaccaaggcaggtcaaaggtccaagagccttgtcccccgagaagaatcctccgacgataaggctgggggctagggagagtgtacgactcaaacgactgaccaaagtcgcgaactgaggaaacactcttacacactatatccaga

SEQ ID NO: 8515 - DNA, 8753 bp, Oryza sativa
agatggtctatctccaccggagtcctccgagaacgagcaaaaccctcacggagaaattcgaggtccaaacgccggcgatgatctcgtaggcaagccaacacgtgccccccggcgtatcggctcgatcgacgacactcttgcttcaaggcctcgtcaatacgcttaccgatgccgtcgagttgagcacaggccccgttcagccacgagatgtatccggccgccgactcctcaggttctccgcggaccactcgaagttctctgcagactctggccatggatgtgcagcaactcttcaagtacgagttaaaccacacctcacgacctcggagcgtttccacggcctgctccttttttacttccaacatggctctctcgagttccgccacttcaaatttcgttttccaatattggatacgacgatcttggccagcaaatgcgtcctcgaggtctgtccaacatggaaacgactacgtcagactgcttttctctctcgagaacacagctgatcaaatcgggggagcgaaaagcgatgaagagaccacaaacctaaggaagtcgtcgctgtccctgttctcgcgggcaaaatttcacccacgttgtccagcaacgcttgtcccacaaacgcaagatccggaaggatcgctgacaattcaggctgcccacgctactggacatcctcgacatcgacatctctacaaaggacaaaagttcccgaggtcaacatacaagagtaaactagaatgataattgcacgcacgaaggcggtcagaattcaagttttacacagcgtgtcttggaagtacaagaagtcctactcttcaaatagggggagaacagactcccccagatcactgacttctttcatcacctccttacgcgtgttgctagccaccccctgatcaaagatctcgcgcagatcgagttcaggacgcgacatctttactcatgcgaggacatgacacgccccggtgtagatcccgttcgacgtctcctccgcgatcctggccgcatgcttggaggggatctcccccatcgccgtcgccagttccgcaagggaggatgtcagcgagaattcgtcaggattcactgggatggtagacttgatgccgcactccccagcaagctggtgcaggcctgtgtaggtgacccgcaacgagccccggatttctgacaggttgttcccgagttccgacatgcggtcctcaagcccctgccgttgtcgctcgttgccggccaccaattccctcatcttcgtgaggtcttcacgagcttccgccaactcgcgcaccagccggtcagcacgctcgttcgccaacgctgcttccgacctcgcctgtgcaatctcgcggccgatgccgtgagcaccagcttcgaggaggcgccccatttcgacttggagctcctcccaggtgaggacggcagctggtggaccatgacctaccgcgggatcgctgactgggccgctagacgtcgcctcccggctcccggctatgagtacgacatccattgaggccgcggcaggcgacgcgctggaagcccctccggacttgttttgcgcaacctttgcccgcgcctccctatgggacgaccacgtatcagacaacgcttgaatggaattacggaaacctaaaaatccatctacttacttctcgccaaccgttacaagacgttgtcgtcatggagacgggggagacgcgtccgaggcctgaaagacaaccaatgcgaagtaaggcaaaatccttctggcggcacgatctggcgacaggataacttaccgagggggtcgacgtcttgcgacgatgtccgcttacagaggagaacttcctcccctttgtcagaacattgccaccactagtagtggccgcagcagcatcagacgcctccttggcgaccttctcttttagagacgccgccacctgatggtccgtgagcggcccgatgatgtcagtcagaggaagagcctacacttaatcaagtcataaggtgatctcgaaaggaaaatgcgggattcctatcgagtacacttacgttgatagcgtcatcacgttcggccgcccctttttcacaaaggggcacggggatgttacttgccgttgtcggaccactgatcatcacctgcccgacgtggcgctccacggctttgctgttcagacctgtgaatcgagaaccaaatttcgataaatcaagaggaacgcaaacataagcatgtcaggataaatgagagaaagataccccgaggagagacccgggtcgtgtcctccggtccagaatagttaaaggctggatgggcccgagcctggagcggctggatccgcctacaaacgaagtctgcaatgacttcataccccgacaagccccgtactcggagatcgtcaatgatgtcgataaacgactgaagagagggggtcaaagggggctttgcggtccaagacgaaatcttgtttggttgttctgtgggagcaatgaagacagggttcgaatttttgatctcaaaatagaaccacctattccgccatttgctgcgagaagaagggcactggaaggggatataacgcgacttcaggccatcccgaagtcagaacccgacgcaactagataccctgttgaactccatccaacgcagctcgtagtagaagcgaaagagatcaagaaaaggctctaccccaatgtaggcctcgcaaagatgagcaaagatgctaagaaaggcgatagaattgtggttcaaatgaagaagagaaagaccatagaagttcaaaaccaggaggagaaattcggaaggcggagggagaaaaccgcagagaacatagtcttcgatcgcaacaatgcaacctaagacgggctggggattagtacctcctgctgccctctccatggttccacgaccaggaagggcgccatcttcctgaagctccttcagcgacgcattggtggaagatgacttgccaaggtccatcgctaatcgaagattgctggagaaagggcctagattgatgaactggggtttttgcgggagcagagaagacgagaggcgcttggaggctggagaatttttccacaacaggcggacttcaaatgaatccccaaaactcccttaaatagacgcacttccgacggtgcgaattccaaggaaaggagagacatggccgccagaaatttctgggtccgttacgcgcggcggtttttcagacttcagtttaaattcactcgtgaccgttgggcttcacatggtgttctcaatcatgtcctgtctctatggttcccacaccgagaacgacatcagtctcgacatcagaagtcgctattggtcgcacgagttcatttaagcagaagtcgggggctactgtcaggtttacgggttaggtgtaccccttacccttcgatatgcgccacatatcgacatggcatacccgcgcatacacggacattatccgcatacactaaggaaatcttccacagtgtttgagtcctactcggacaagacagggtcgtcaatatatcgtgtagggtccgatgtctccgagttctactttgagaccacctgatctgcgatataaaagggaccccctgggaggacctaagacatcgaatctcatagccaatacaaccactacagcctacgaagtcggagcctgcaggagccaagtcgccgggagatctaatcgaaccaactcgattacgatctcgccggtttcatcgagttccatcgttccctttgtaacttgtggttttccatcatataatctcatatcaactagattagggctattacctatcaaggggcctgaaccagtataatcctcgtcttttgtttgctcgatgtcgtattacgtagatccttgtaccaacgtaccccaataccctctatatctggtctacggatatcacccgtcgacagtttgtccgtttgtacctgtgtagccggtgcaccggagttgttgttgaagacaataagctcacggatctacgagaatacaatactcaagagggatattggggccttggggtggatctgacaaagaagaacaaaagggaaagagatggcgcatgtggccctcgatccagcagttggagatgaagagctgacagattcactggtggcccgtggccctcatgcccctagcaggacgccgtcagtggccctcatcgggcaagacatctatcgaagacgaagaggaagagaggcatatcggtgagcgcctgagcggtggtcggtggaggaggaccggtgggcgggagagggacagaggcgggattggtgggtggctaggcggtggctgatggttgtggcatgtggcggctagggttagggttgaccgagagacgagagcaaccactggggggggcggggggagggggagacgctgccgcttatatatgggggcacgcgtggccttgggcttggcaggctggcaggcctggtcgaccattggatcgggccgctgttgtgcctaccattggaccatgccgtgccgggccagtccaccgtgccgacctcggtccgtgctgtgtcaggccagcccaccgtgccgaggcataggcccaagcatgacccaacagctagggcgtgccatgccttggccgggccaaaacctcgtgccttgggccgagccatcgggccctatagccaactataccccgtaccctatttttgtgagttccgaaaaactggatcaacatatatttaaattgactaaatcttatttatgtaagctaccactgaaaaataattagttgtaaatatgagcacacgtgttaagtctagagcttaaacctagatatgtgattcaacaacaaggaacctaattaattgaactacggtcttttcaccaattacaaaagaacaattttgtattaaaagtttacaacggcacaaatcttcataaagcatccaattaatgtcttagaacaatactctagcgttccaaaaatccttaatgcgctaagtactcaactgagcagcaagcatggcgagaatctccgtggctatggaggggaagctcgtgatcagatgctcgtacccgtcgctcgccatgtccgccttcaacctcgccggcgacgtgacgaacctcaagatggcgtccttgagctcggggcagtcatgctgctcggccaacgccagcgatgtcgccgccgtggccacgacgacgtgcctgaacagcacgtcctcgcacaccttcttcagcctctccatgccgtacctgtcggcggcgacgagcaggtgcttcgccatcaccgccgccgcctcctcgccatcgtcgtccatctccggcagctcgtcggtgtagacgaagtgcaggaacgccgcgaacgcgtcggcgtccatgtcgtcgacgcggacgatggccctcgcggcgcgctcccgcatggagccgaacagctccgcccggaacaccggcgaccgcgccgccaggatgcaccggtgcgccgcgaacgcctcgccgtcgacattgaacctcacgtcggccgccgcctcggaggcgaggaggtcgccgaggtggcgatgcaggagaggcggcggcacggcgggcaccgtgacggcggccgcgtcgtcgacgtcgacgcggatgtccgggacgttgaaggtgaggtcgcaccggacggcgaaggagtcgccgccaccgccgccgtcgtcgagatgcccggaatcctccagatcaaccctcctgatgaagctcttgatggcccagagatcatgtccctcgtagaacgtgcacttgttgtcgctgtggctgtaccgtgtcaccggctcgccggcgacgtcgagcaagctgatcttgacgcgtgctcggacgacgacatcgtcgtcgtcgcggccggtccgcaccagagcgaaggatatcgagctggagaactcctggtcgtacctatttggatagtaccggagacgccatgtgtagccgccgacgtggaactcgccggagttgaggtgttcgccggttgccatcatcatcttcgtcctcttgtatccctctatcctcaggacgtggtgaccactcgcctcggagacggcgacggtcgagcacgacggcgatggcgatagcgacggcgaggcgtcgccggatttctcggcggcagtgggaggctcaggtgtgaacgcgtcgacgaccatgccaccgaccatgcgtgatgcaaacttgaagaaaagctgcgtcagccatggacgctggctaagctgatcgtcggtggtagctgccgaatccgtcgtcgtcgccatggccatgctcgtgtcgacgcgcctgcgcaacatgtcctcgcataccagcttcagcctctccacttggtatttgccggccgccgcgatcaaccgccgcgccatggctggcacgtcgcgcgaggccatctccagcaacgtgtccgtgtacacgaagtgaagcagagccccgaactccccggcgcccatgtcgtcgacgtcgacgcatctaccggcggccgcgccgccacgaccacagagctcggccttgaacaccggcgaccgggcagcgagcacgcacctatgcgcggcgaacgtctcgccgccgccgaccctgaacgtgacgtccgcgccgtcgccggtggagaggaggcggcggaggtgggcgcgcaggtccggctccggcacggcgaggcacgccggctcgacgcggagctccgtggccctcatgacggtgacgtcgcagcggacggcgaagcggtcgccggtgaggtggcccgacctctcgagctcgtcgtggcggatgaacttgtggaatccccacgaggaagaacccctggggctcgggaacctgtgcacgttgccaccgtacgtgcgcgacgccaccggctcgaggtacgaggtactaggagttaccaatcacatctgtccgtccatttgcaaggggtaagattggaatgggtaaaacattgccgccgtaataagcccgcaagtagcgattgccaagtccagacgatatctttcccctgttccgccatcttatctcttggcgtcgctccaccctgaaatttctccgtcgatgtggtccgccgcctcggcatggtcacaatttgtcaatttccaagcggctgtagagcttttgggaggtcctgatggagagaaattagcagagtgtgttggagtgcttcgtcaagggggcgggaggagaaacgtgcagtgggagctcaccggagattgattgtagccgaggaatggaaaggcatgcagtgggaaactgggagctcgccggagataaaataaatgcactcaagcagcccatgctgcataggaatctaatactgcatagaaggagataatcagttcatatcggtgtttcttaggtaagaaagatcatcgatcaacgcttatgttgattagcgttggtccaaatatgatcggttaaaagctgtcaaaatttaattaaaaaaattcacagaacctcgccagtacttacgaacattcacggcaggtagtttataagcaaacagtcataaactcataatcacatccagacacaaaataacacaactaactccaagactaaacaacacgacaagtacagatcaattatgtagcctgagattacatagtttcaaattacataatgttacatactgacaggcctaagcctcagataagcatacaaaagaaaggtactggccacgtgcaaatattcttcaattctgatcatctaggatcagctgtgcgcctgtgccacaatggattgtctacatgcctttccttttctgctgaacagagagaaaataactgcacaagtcagaaataaaacttctcatgcctaaacatagctgagacatttttattgagagaacagaaactaatctagaatttgagaggccaacatgtcgtttctgacaatgccaagaaacgatgagaccaccttaccaacatcatagatatgttcatacgtagctaatgtttaattatacactaagacaatcagtaattgtgtcatgggcattccgtcgaacgccttgagtgcaaaataaacaaaagatcctacgcacgatgttcgctgacctctgcgacccgagatgtctccctcacaatcgcccaaccacacgatcgctgcatccgttgcactcatagtggtcatcgccaggcccctcgcaatctcggggaggcctcctgctgccagcctgccaccattgccaaatctagcgccccaacctcggcagcgaccggatctggctgaggggatgggcagagtggatgctctgggggaagggggagaaatattgcacagaatattgcggctgcaagtgtcggcgctcaaacgggagcggaggaatcggcggccgtcggtgtccgcgctcgagtgcgggcggaggtggcagtcggtggcaactcgcgagcgaaagtagtcgaggcggcgaccggggatgtcaacgcgcgagtgggagcagaggacgcgatggtcgacgccatcggcaagctggagggagcagtggtcgctggtcggagggagaaggaagaggatacgatggacggaggacgaagggtggcggatcggggagaaaagttgatgcgaaagtacaattctaccctcccaccacctcatcacaattggtgccgcctctcgcggggacgcggtaccgtgaggtaccgaccaattgcagccgttagatcctgctagatcgacggatagaatttggtaccgcttgccctcaaggatggtaaaaagcctcttgtttttttggttgaatttcagcggaaagaggagaagatggggtcaattattatgtcgttgtagcgtaatggtctccggatgcataggcctgtt

SEQ ID NO: 8516 - DNA, 10669 bp, Oryza sativa
tgggtggatttcactaaatccaagccgtcccaataatttcgatggcttccataagccatctcttctgggagtggattttaatctctcgaggggatgtcccctcgttctttgcatatcactcaaatagttatgaaaaaatttaaaacaatttgaaaagatacattaacatgtgatatatctactccacaaacatgtaagttgaaatttaacttctacatctcgcaacgagaaaaacaaatcgaagtacagttagttaaggtatattgccagttaattttttttagttgccagatgtagaagttgaatttgaacttgcatgtttgtgaagtgatatatcacatgttaatacattttctcaaattgtttcaaattttttcacaatcatttaaatgacatgcaaagaacaagaggacatcttctcgagagatcaaaatagtttccccatctcatcttccaccatagttatcttgtagagcctattttctttttaaaaaaatattgtacagcttataaaaaaaattatctcaaaaacattatctctcagagaacatgttatcttcgaattttctaatagcaattagagaagaacaaacaagacacgaacattgcaccgacaaaagcttaggcatgaattagtttaacgagggcctcaatgccgttaattttataacagctcggttaagaaatgtttacagataatttcctatccacgatgctcttccgacacgctatatccgaatggacagacttcgcaagataaaataaatggagaatagaattgttatttctgtcgtaaatgtgtaactaggaagaggtgacatggtcacatctagcctgtagaaacaaagtaaggggtcagatcggtccaaatccaccaagtggagttggaaggcaactccaggggatctacgtccgtcgaaaattgttgaaaactttccgcaaacatatttaggaactttccgaaaacaaatttagttttaattcttgaaatcagaaacaaattatttttcatatataaccgattagtttcagccttctttacttcaaatgtatattcagtattgagttggttaattgaatgtagatattttttctattatggtgctttagatatatttttttgtcttgttatttttttaaggaaatgacatatattttgataatatgtttgttctgcgttgaaaatattgatatattttttataaatttgatcaaaattaaaaacgttgactaagaaaaaaaatcaaagtgacttataatatgaattataaaacgaagggagtatatgctttgcttatcaatttttggaggcacctataaattgggcgctcgattattgttgtaaaaccaggcgcagttttgatactgaacaattaaaatgttgaaacacggttggatcgtggactaaaacaatttgttctgacacataaaacatcaaggttcaattattgtaacatcaacaacaagagtcaaagacaaaaattgaaacactttacataaaatgtttcagtgctgacaatggtgaaacacaatcaaatcacaccatgaaacaatttgctacaacgtatgaaacaacgttttgaatgtattaaagcatgaaacaaattcgaatacataaaaaaaacaatgaaacaccatcgaaaacccactgcaatatttcaatctaactgatgaaacatcatggtacatggactgaaacatcaaaatatttaagaggaaaacccagatctacctcttcctctactcgactggccggtttgcaaccacatctgcgtcgacgccgtgccgagctccactgcatccgcgtagctgccggcgttgacgccgcagctcggccgtgtccgcgtgtccgccatcattgacgccacgtggagctcagccctcattgtcgacgccacatggggcatggcccctcgtcatcgacgctgcatggagctcggtccgccgtttccagcgctgcacggcgcgaccgagaaccccgggcccattgcttcgccggctccgcctccgcggaggctcagcctccaccgccgagagcaacgatgccgttctcccgccgccacttaggcgtaggtgcgcagcagcaacgagaaagggggaataggtgcggagagagaagaagagggagagagagagagagacaggatgaggtaatggatatggacgtgtgggacacggacgtgggtgcccgatattctccttccctatcaggtgcccgagtcaggtcgttttcgttaaatttttttacatgatttcagtgcatgattatcttttcttatttatttaatgtgaagcaattttcatgatcggatgaagcgagtgctgacgtgataaaaaatatcctataggtagtggattttaaagggaacattctctcgtcattttcatgtcatccaaatagttataaaagaattttaaaaagtttaacaagatatagattaatgaataagtggtaaatcactccacaaatattttcagaaatatactatgttgcatcggatacacgattttcagaaatattttgagagatgaacaccgggtgatcatggcacttccgaacggctgtcacatcgacctcgcattggactgcgaaacaatcgtctcgaagatattccgatcgctccaattcctccctggcgatgaagtccttcaatccccagtcatggccatggtagaacccatgaactccggcgtcccgcgacggcgccgccttgccggcgacatcaaccaggctgaaccgtggccgtcgctgtcgctagggtggccgccggcggcggcgagctggaggaagacgccgatgtggtccctgtgcttcttgttcttgccgttggggtacagctggggacgccacgagtggccgccggcgtcgaagacgcacgagtcgacgtgctcgccgttccggagcacgccgacgaggtgcgagtagccgtcgaccctgagcacgtgggaggtcgtcgacggcctggagacgatggcggaggcggtgcgcacgatacggcccgccgccgccaatgacatggctggcagtgtggactggacggatcgagagacggcggccggcgccggagcaggagatgcggcgggacgttgttgttgatctttgttgcaactttgcaaaagatcgacacggtagcttacaaagaaagaaggtataatacgtgattgaaatccaactcttaatacaattccacttaatttcactcaaaatcaggctcgaataaacctttgaaacgtgatgttttgtgatatctttcatatattcatattattgttattgtctaaaataaatattacttacaacttttacaataataattgtttattcctaataatatacccttccaacatcaagtttccaccaaacaaaggatatgaattccctcctaattaaacactctcttatttctgtatagcaaattcaaattcccacattaattcccttcatcatctccgacggttaatttacatgccttttcccaattgttgattttacattatcttagctagactactgtgtctgaatgtctatatatgtattctattagcacatgcggtgaggtccctgagaggccggaggcagaggaagtttgtgatttgattgatttgtattgccgatttcgaggagaggagagcatagggatttccaaactgtaaagatgtgcatccataatctaaaaaataaacttttacccacaccttacactgtccatttcaaccactggcttctaattatcatggacacaatttttaaatgttgattaaatggtgtgaattttaaagatagcttcatatatgaaagttcttcaaaaattcaaacaaatcaattttttcaagtttgtaatagttaatacttattagttttacgctaattgagtgtcttctcaaataagccatgaacaaaatcgcttgatcatctcaatcgaacagaggtaaggacggtgcgtgcaggtgggttgggacacatatcaatattgctctctccgttccatataataagtcattactagtcaaacttatttatgtttgattgaatttatagaaaatgtttgattaaatgttgcagtggatatttcgatagtgttccatatttctattttcgacacacggggtttgttgatgtttcaatggttcaaaagcaatgtttccgctagtgtactcgtgatatttctttgtgtgtggatcattttttacagtggattttagatagtgtttaatatttttcatcttgatgtacaggtggcttgttttgatgtacacaaggtttaagtgtttcaatggcttaaatcattttgtagtatatgttgaaccaaattgtttcatctagcgatctcaccgtgtttcacattttttttataaactgaaatattcattcgctaagtggtaaaacattgttttcataaaaggtgaaacaacgcccgagtttttggggaaaaatcgggcgaaaagggtgaaacaacgcccaagtttttgggaaaaatcgggcgcccgatttgtaggcgcttccctattagaggcatgttatgaggactttcgaccgagactgccaaaaccgctatagcgaagcgccgatcgacgagcaagatgcacacctgggatgaaaccataaggcgaagcctaggagattcgccaccaagccgggaggccttcacctaaaagggcatgttcgctaagtatggcctaggttaaggcccattaaggagttctaggcaaaatagatccttttttgccctcataaatgcccctatcataaaggtatccttgtaaattcctcttacctattaaccctagtatgcatgagcttgtactaagactataaataatcccctaattaaggcatgtaacgggggatccaaaaaaattccatcattaatacatattgttttacttttccactataagagtgaaccacgttcttcgacgaacgcagttgtcattcaacaacaaaatggatttcttttattatatcacgtttatttttttttcatgatttgattgtatgatttcccttttgtcatttaatgtgaagcaattttcatgatcggataaaccgagtgctgacgtgatagctagcacgtgaggtaacatcaatccataataatatccaaataatactatataagtgcaccatgttatatacataatcctaagtagctaatttcattacgacgcagtgaccatatagtatctatctactctttataaaatggtgtagagtggtggcggatccatcaccattccaactgtcaactcccaactttttgttgaagaaaaaaaaagacatatgagactaaagcacccacatatcaactactcccagtaattctatttttttatgaaaatatattaatatgagtccgaaaagttccacaaatgattaataacaaatatgcacatgcttaagttgctaacaacatattaatgatatttttttaataaagattccattgcaatgcatggataaaatgctatatagttacagcaaaagcattagatatactatgttgtatcggatacacgattttcagaaatattttgggagataaacaccgggtgatcatggcacttccgaacggttgtgacatcgacgtcgcattggattgcaaaacaatcatctcgaagatactccgatcgctccaattcctccctggcgatgaagtccttgaatccccagtaatgaccatggtagaagccatgaactccggcgtcccgcgacggcgctggcttgccggcgacatcaaccaggctgaaccgtggccgggcacgcacgcggccgtcgccgtcgctagggtggccgccggcggcggcgagctggaggaagacgccgatgtggctcctgtgtgtttggtcgttgctgccattggggtagagctggagacgccaggagtggccgccggcgtcgaagacgcacgagtcgacgtgctcgccgggctggagcacgccgacgaggtgcgagtagccgtcgaccctgagcacgtgggaggtcgtcgacggcctggagacgatggcggaggcggtgcgcacgatgcgacccgccgccgctgccaacgacatggctggcagtgtggactggacggatcgagatacggcggccggcgccggagcaggagatgcggcggggcgttgatctttgttgcaactatgcaaaagataggagatacggtagcttacaaacagagaaagtattatgcgtgatgaaatccaactcttaatacaattccacttaatttgactcaaaatcatgctcgaattaataaacctttgaaacgtgctgttttgtgatatctttcatatattcatattattattattgtctaaaataattattacttaccacttttacaataattgtttattcctaataatatacccttccaacatcaaattcccacgcaccaaacaaaggatatgaactccctcctaattaaacactctcttatttctgtatagcaaaatgaaattcccacattaattccctccatcatctccgacggttaatttccatgccttttcccaattgttgattatattttagattatcttagctagactactgtgtctgtatgtctatatatgtatcctagtagcacatgcggtgaggtccctgagaggccggaggcagaggaagtttgtgatttgatttgtattgccgatttcgaggagaggagagcatagggatttccaaactgtaaagatgtgcatccataatctaaaaaatataacttttacccttctcacaccttccactgtgcgtttcaaccactggcttctaattatcatggacacaatttttaaatgttgattaaatggtctgaattttaaagatagcttcatatatgaaagttcttcaaaaattcaaacaaattatttttttcaagtttgtaatagttaatacttattagttttacgctaattgagtgccttctcaaataagtcatgaacaaaatcgtttgatctcaatcgaacagaggtaaggacagtgcgtgcaggtgggttgggacacatattaacattgctctctccgttccatataataagtcattactagttgtttgattaaatttatagaaaatgtttgattaaatgttgcagtggatatttcgatagtgttccatatttctattttcgacacacggggtttgttgatgtttcaatggttcaaaggtggcttgtttcgatgtacacgaggtttaagtgtttctatagcttaaatcgtcttcgtagcatacgttgaaccaaattgtttcatctagcgatgtcaccatgtttcacttttttttcacaaactgaaaaaaaagtgaaacatcaacctaggcaaaatagaaccttttttgccctcataaatgctccaatcataagggtatccatgtaaatttctcttacctgttaaccgtagcgtgcatgagcttgtactaagactataaatagtcccctaattaaggcatgtaataggggataaaaaattccatcattaatacatattgttttacatttccactataagagtgaaccacgttttttcgacgaacacagttgtcattcaacaacaaaagatgggtttcctttattatatcaagtttattttttcttcatgatttcattgtatgattcccttttgtcatttaatgtgaagcaattttcatgatcggatgaatcgagtgctgacgtgatagctagcacgtgaggtaacatcaattcataatatccaaataatacaagtgcaccatattatatatataatcctaagtagttaatttcattatgacgcagtgactgtatagtatctatctactctttataaaatggagtagagtggtgacggatctgccaccaccccaactgtcaactcccaactttttgttaaacaaaaaaaaagacatatgagactaaaggacccacatatcaactactcccactaactctatttttttatgaaaatatattaatatcagtccaaaaagttccacaaatgattaataacaaatatgcacatgccaacaacatattaatgatatttttttaattaaaattccattgcaatgcatggataaaacgctgctacctccatatttcaatgtatgacgccgttgactttttgtccaacgtttgaccattcgtcttatttaaaaaatttatgtaattatcatttattttatcgtgaaatgctcttttaagcatgacataaatatttttatatatatttgtaaaaaaaataaataaaacgaatggtcaaacattcgtaaaaaagtgaacagcgtcaaacattaaaatacggagaggagtatatagttacagcaaaagcattatactactatgttgcatcggatacacgattttcagaaaaattttgggagataaacaccgggtgatcatggcacttccgaacggttgtgacatcgacgtcgcattggattgcaaaacaatcatctcggagatattccgatcgctccaattcttccctgctgatgatgctctgaaagccccagccgtcgccatggccgaagctgtgaaatccagcgtcgtgagatggtggcgccgccgccggcttgtcgccggcgctgtcaaccaggctgaaccttggccgggcacgcacgcggccgtcgccgtcgctagggtggccggcggcggcggcgagctggaggaagacgccgatgtggctcctgtgtgtttggtcgttgctgccattggggtagagctggagacgccaggagtggccgccggcgtcgaagacgcacgagtcgacgtgctcgccgggctggagcacgccgacgaggtgcgagtagccgtcgaccctgagcacgtgggaggtcgtcgacggcctggagacaatggcggaggcggtgcgcacgatgcgacccgctgccgccgccaacgacatggctggcagtgtgcactagacgggtcgggagacggcggccggccggcgccggagcaggagatgcggcggggcgttgttgatcttcgttgcaactttgcaaaagatcgacacggtaaattacaaacacagaaagcatgcattattcgtgatgaaatccaactcttaatacaattccacttaatttgactcaaaatcaggctcgaattaataaccctttgaaacgtgctgttttgtgatatttttcatatatccataatgtaattacttacaacttttacaataatcgtttattcctaataatatatcttctctgtttatccttgtttgacaccgttgacttttggagctagatcgaacctagggatgcacgtgggccgggtaaacccatgtacccaacgacctagcccacgaaacatggggtcacaacctcattggcttacccatgaaatttcatgggccatcatgggtcgacccaatggagcattatgggctgaccctagctaggttacacacacaccgtcgcacgcataggcaccagctgtgccgccgccgcctcctgactgcgaaacaagctttgcagggagacatgagatggcaacggggctgcacccgccgggtttcaccaccccgtcccgcacccgcattgaagggaatcgcccgtcaccctccccatccccgcacttgggtgcaggttctcccccgtccccgtccccactgcgggtacggggcacccgcgggtcctcacacccgacaacatcaccggaatacaaattgcagcagcaacaatccccaattaaccccaactcaggaaacaagcgagcaacacaatagcagtgagaccatcatcaaatcggctgatgaaacacaaaattgacccaaagaataggaacaacaaacagatttcaacttcagtgcctgaaaacaacgtcaagcttccgtgctgttaaagaacagcaagttgtttcagttcatttcaaacagaaaggcaggaacgtcatgtaggtaactaactcactcattcacaggtacaaatcatctagctggttggttggtgatgcgtcggcactcggcacttggatttcgtcctggacatggagccaagatgttagatgtctcgtcttctcggccgtatggaagtttcacagtggaaccttgcctcgaacatgcggacctggttcccttgactcctggaagcatgcggcgacgactgcggcctggatcccttgtcgtggtctcgtggaggcgtcggccgtcgatctggtgtcgccgtgtcggccattcggcttggactttaggcggcgaggtagggcatggatgtggatgggagcgaagcggcgaggattcttctccgtgcgcttgggacctagggttttggcgtgtatatatgtgaacgagtgatgggcctatagcagctgggcttttattttctatgggccatgaggtagtaggaatgtaggatgtgctatacagggcccccgtggggattcgggtacggggagcttgggaacgcccccgaacccagctcacctgatgggggaatatttttcccgttaagacccccatgggtagagatgttagcctattaagaaaccctaatggatgttttacccatcgggtattggggttcggggccccattgccatcccatgaggatcaggacgagtctggttctatggctatcaacggctgcccattagctgctactacatccgtttcacaatgtaagtcattctagcatttcctatattcatattgatgctaatgaatctagagacattagattcattagcatca

SEQ ID NO: 8517 - DNA, 1203 bp, Oryza sativa
acttacattgtgaaacggaggaagtagctcatgctgctagaagacatagttggccaaagaatactagtcgtacaacgggtagaatgattgagagcaagtactataagcatctaaaacacaagcccctagatgccacatatgcataaatggtgaggtggaggagagaagaaaaaagagaaaaaatgagccaccccgcatgcaagggacaacctctttacaaactttaaaaaagaaagagaaaatagtgatgtaaattggatgaaaatgaataaaacaaatagttatgttgtattggactagtatatattggaggcaatatataagtatatgttgccttctaattaactagttgattatgtgaataatattagaggtggcaatcacctctactataaaacttgctctaatgaagcaggtttcagcagcgtaaatgggagctcatctcccaaagaaaatctgcaaatatatgtgtccaggccgacaccccaaacataggactttgtctggaaaattaaacagagcgtcgccaaaagttcagttctttacgtggctcatagcgaaagtgaggtcatcaaccaaaaaaaatattgataagaaaataataatgtcgtctcctatgtgtgacctcgtgaaagagaagatgaagctgccctctacatatgtgcctccaatgccctttcttttgctagacaacttgcttctgttttgctaaacaataattcacttggcgtgcatatccagcccatcgagtgaactagaaccaaaaaggtaggaaacccatgttttcagaattttggaagcaacattgtttatttgaatcttaaactcgcctaaactgaggatttgattaatttggaaacatttttaatttcccccttcaattcccctttcaatcccctccgactctaggtcatatgttatgttagaaatttggtcataattcggcatattttaatccaaaatattaagaccataaacatgacatttgcaatatgagtagatctagtgacagtgctagatgtatacaacttgagtatgcttaatatgaaataagcatcaacatttacatagtaacgcaatgctgccattgcgaagagtattaacaaagaaacatttaatagaatcaggagaatgaaagtataccccgagaacgtcccaccgctggattttgaggcagtattgcctccgttgatgtcgttcatc

SEQ ID NO: 8518 - DNA, 833 bp, Oryza sativa
ccaggatctgaaaatgacgaaccacatcctccttgactacgtgttcgctcgccaggtctagcaccaagttctttcccctgctggttggctagacctcgttccttgccacggctgctctctttaggtttggtggcagtcgtctaggacctgcctaagcatatgtgtgacctcgtcaaacagaagatgaagctatgacccatacatatgtgcctccaatgccctttcttttgctagacaacttgcttcttttttgctaaacaataattcatttggcatgcatatccagcccatcacgtgaactataaccaaaacggtaggaaacccatttttttttcagatttttagaagcgaccagttgttcatgagaatcttaagctggcctaaacaggggctttgtttaattaggaggcgtttttcccccttcccccttcaatcactgtaaccttccgactctagggtcatgtaatcttgatcactctttcgtaattgaaaattcaagtgcggaactcttctctcccatgatttgacaaaaaaaatgcttccaaatttttgattcgacataatgtggatctccaagcttgtattgcggtgtgtgctcgttaaatggaatcatatgtgcgttcagaaaaacatggagacctatatcttgagacaaggaaaactcaataatataattgaaaatagaaagtaagaaactaaatctgggtccccagtgaagcctaacatgggcacagatatagcgctctgcttttttgaaatcattaagataaaacataaatgctataaattatcactacaaattaataagatatataacttcagggctgcaggaa

SEQ ID NO: 8519 - DNA, 10143 bp, Oryza sativa
tttatatatcgtatcaaacgtccagaaacacaaagacaccaaacatgggcacattttcaagctccaattattgctcagttacagaacaaagaaactaaaagcctaggcagcacacaacgaaacgtacaagaagtttgcatcccccagcactatagtagccacccaaggaaccagccggccaattgatacatcacaaaccaattaaaggaacaaatatatatgtgcttctgccaacaaggaaccggaagtatacataactaataataagataacatatgatcagatgagcctcagggaaaccattgattgttatcaaatactatactagttacgtaccttgaatagatgaaattgcagatgaactatgtggcaggggttattgtgtgctcggtatggggattagtgatctcttcttgttgctcaatcgagtggcccccttcctcccatccttcctcccgcgatatgtcgatatcctccaatccttcctcccgcgatatgcggatatgttgtatgtagcagttgggaagtaggcttgcttcgttcttgatggcggccacaactgcctccacctccttagctgtcgcgccttggcagtcaatatagacattgagtgccttaagggttgagaggtggtggatgcccagatttcgattggcacatgcatactttgtggaatgtgccttgattgtaaagttgatgtctacaagcgttggcatggctccagcgtggaacatcatatcactagccgaacaatccaagtttagagactctagacatctgaacttatttctgtatatgctaaacctttttgtgttgtcaaatgcggacactaacaaaagagaaagcaaggcaggtaagtctcctaggatctcaagggtttcttgcgtcacttgttggattctaatgtccagataggtcaggttggccagtgacgccggcctctcaggaatcccatggagaaggagaggacggatgtgtaattcttgcaggagataagacggcgaggatgaaaaatccaaattgatataagcagaacccaactgccagtaactatcaaaatacaaatatctaagattgtaactaaggagtttgttgagcgatgaagttaacgtatccaagtgttttgatttatgattgttctcgtcagtaatggacaaacttaggtgaagtatcctaagtttggtcagcgttcccaactgttccaaggagtttattgagctcaaattgtcctcttttgttgatactgctagttcctctagagcttgcatattcccgactccatccggcagtcttgcatcatgaacgtgtaaaaatttcaaccgccgcagtttaactatgcctttgggcagctcctctgtaccaataccacgaggtagatccaatatctccaaaaacagcagttctcctatttcttcagtaagatgtgtaactagatcaatccgtaagtaccgcaactgaagtagcttcccaattccacaaatctccatcatcttattaccactctctatatgaagcactctgaaaacattcaagtcagaaataggaagcatctgttccctgtatccaaatatgctcactgatctaacattacaagttaccatggaacacattggcatcacattttcttggccacggtagtcaagtaaaagtcgaccaacttttccttgggacactaacgaatttggatcactgaaaactgtaacaaagttttcttcaattgccttggatacaatgagatcaagaataatatcatgcacacgacaagtccttatacgatcgtcaaataacattttttctggttggatcaaacttctgttgataagttcatttaaatagaattccccttcctccattatgtttctcccacaatttaccttgatgaacccttctgctctccacctccttaacaactgctgcacatcgatctcacaatcttctgggtacatactgaaatatttgtaagcgaaaactcaaaatcccttatatcgtgggacggagggagtgggaaagggcagggcccaggctccactaagcctgagagaatattgtgctttattcacatttcacgcgcctggtgtgaactaacagcgaggctttctgcgatgctgccggccaatagtgaccctgcttgactaatggcataaaaagcttggtagggaattgatactgaattaccagtcactggataagaaagacatcgttataggcctgtacaagcatttgtctcaagagagcattataaagatcaaatgatgagataaggtagagaagtgagggctgatgagagagtggatgaacaatatctatataaactcaaaaacagtacaaaaacaagcactagattagtagtaagcaaatgaagtaaaaaatattatggtttattagggcaagtgtgctagaggtaatttgttgtgtatgttattaataaagattaggcgagaataaataccggatgttattatgtttagaaaaaatcactggtgttgtgggtggaaacaaatagatttttgggatcacctatacatttgtcgataaattttcttttaaaaatttgacagatataattatagtataatataatttgtctgtgattgtatgtaacatgcaaaaaaatctctctgtaacatgttatttcgatgaaacggaggtcgtgaaaacgaattctcacatatgtgcacatagtgacttttttccttctttacttgaacaaatcttgaaacggtttaaaattatatgcaagttacattgtagttacatacaagttacaatgtaaatgatgatgaagattagcccgtaatcgcatcacttgtacagatggttttgctgtattgggccttgtttagtcaccgtcatttttgcgggcgggccatcttctaattgggcccgtaggctgttcacgacactttcgacgtcgcaccggacggtgacgcattccccgcgctcgccggcgccgctcccgaacacggccgtcctcggcggtggctcgtactactcgcgcgcgcggcgcggccgtcttggtcgaccaggctaattttgcacttcagttggtcctgctgttctgttcttgccgaagagccatctagctccagcaatagatatatatatacatgggtgtcttcaatcttaatcttcaatgtcaacacttcattgcaattttaattatactttgagtactgttcatttatgtcatgttatattattcaacatggctcatttatttttctcgatcacacagctgttgaaacagcgagctacttctggtgaaaataatttccatcaccaaattcaatactcaactgcgtgacccaggttatttgttacaccaatttccctgacaactcaaaaattgtcacaaggtattccttccatttcaagttataaaatatattgattttggtcaaaatcaaactgttttaagtttgattaagtttgtagacaaatatagtaatttttataatactaaattagtgccatcaaattaataattaaatatattttcataataaatttcttgggttgaaaatattactacttttttctataaacttggttaaacataaaacagtttgactttgaccaaagtcaaaacgtcttataatctgaaacggagggagtagtaactgtgatgaaaattactatatagttacagtgatgatttttatcatcactgaaaagccaatcctgcgaaaagcacctagtcacttagaagcttcttaagtattccctcattccctaaatatttgacaccgttgacttttttaaacatatttgaccgttcgtcttattcaaaaacttttatgaaatgtgtaaaactatatgtatatatgaaagtatatttaacaataaatcaaattatacgaaaagaattaataattacttaaattttttaaataagacgaacggtcaaatatttttaaaaaagtcaacggcgtcaaaaaaaaaaaaagaacaagactagtggtaaagctctcagaatgacgccatccattatccatgagtgcatcgatcagagcacaacaaagtctcatttgtccaaaaaaaaaaaaactcaaaagctacaaagcctaccgctataccatggcataacctcccacaatgatggatcggtcggcaaaggccacattcagacgaagtaccgtcaccgatactgacggtaataattagccgtgtagtgtacaagagctacgaatgacagcggctttgacgactgcactaatcaaactcttacagggaaatttcggaaattttagttctatcggaacccccactactacggtaccaattctcccgtgcgggctaaacgatttttgcgtgcagttgacagcccacacgcacccagtcgtctgggaaaatcgcgattttcacgtgcgggtggcgcacccgcatgcaaaaatcagatttaagcgcccgcacggaaaaacaaaaaatagaaaaaaaataaaaaaaaccctaaccctaagccgccgctgcctagacgaggcccgccgccatcgcccccgcggtcgtcggctacggatccgctgcccgctcctgtcaccggcaccggatccgtagtcgcacatcgacacacaatagatctcacatcaattccaagaacacatcccacataagcaacgaatgaactccaagaatgcttctcacaaatcacaaacagtcacaaataacaaagagagaaggagggggagagttagatccgccggtcgtcgacgccgtcgcacctcctaccggcggccccacctccacgccggccgcttacgccgccgcacctccaaccggcgccgcacctccagatccggtgcgggccacctccatcccaccgctgagggaagcgggcctcctccctcacgccgccgttccgctggatatgcaaggggggaggggaggggccaccgtggtggcccgccgctgctgcctcccgctcccgtcgcccgccgccgctattgcccacctgcagtcgagggagagggaaggaggcgccgcgcgcgcctgctgtcaccgccgaccgaatgacgataggagaatgggagagtgggaggagaggagtcgagtgggagagagggaggtgggaggagaggagcgggcggaggggaaggtgagggaacgacaggcgcgtgatgaattaaaagggatgggctattttcgcatgcggctgaaaaaatgcttattttcgtgtgcggttggcttaagccgcccgcacaggataacgcgttttcccgtgcgggcgacggcccggcgccggtcctcctatttttccgtgcagttccacttacggaccgtatggaaaagggagcggcgtccaggaaaatagatcatgtagtagtgccccccacccccctacggacgatacgatataatttcagccaaaatttttatttttttcattttttttatgaattcggtaatattttgttcaaatttggtcaaattttattcaaaaattcataatatttcgaccacccccaatacaaatcagcaaaccgaaacatttaaccctgatcacatcttcagctcgatctccagcagtcttgacatcttcttccattcctctctacgttcagctgcatcttctactccagccgatcagcttgtaccgttctttcgcatttccccaatcgcagataccgaactggtgcacatagtgcacctgcaacgctggccaatcaagtgacatctccccaaaacgccttaagcagcagtcactcctacactctgcacaaacatctgaaaattgtcatggttgatgcacttcatgttgaaaatgcgatgagtcgtgagaactgtgtaccccggcaccatccatccgttgttgcgtgtcggatccactcccgatgcttcccaagcctacatgcatttcacccttttcccgtgtgcaattttctaacaatcgtagcagttcatgcagaagcttattatctcatctaagggcctagttttgcacttcagttggtcatgctgttttgttcatgccaaagagcaatgtagctccagcaatatatattcatgggtgtcttcagcctcaatcttcagtgtcaacactttattgcgattttgtactatgagtacgtacagttcatttatgtgatgttctattattcgaacatgccactggtggagaaaccatctttggtcggtcgacccaaatccacatataatcccggttccattaaaaaccgggactaaaaacgatttttagttccggtttataagcgtaacaggactagatgatctttattcccggttagggttaccaaccgagactaaagatcaagttgtctctatgtcagatcgtgtcaggcggctaggatcttaactgggactaaagatctaactttattcccgagtggtgttactaaccgggaataaaaatcaacacgtactaataatccctattacttatcctcttttcccgtccacacaacgaactctttctctatctcttttttcctctctaactccctatccttatcctttcttcttccttcttccttagttcttcttcttccttagcccgcttggatcggagcgagagaggccagccgcttggagagagagcgggctgggcagcagccggcgcatcggcgcggatggacaggcggcggtggccggccggcgcggaggggaaaccggcgcgacggcgggcagcagcgcggagggccgcggcggcggcgcgggggctggccggcgctgaggggaggcggcgcggcggcgggcagcgggcggcggcggcgcggcgtcgggcagcgccgcaggggtcggccggcgcggaggggaggcggcacggcagcgggcgggcgggcggcgcggcggggccgcgtggcggtggccggccggccagcgtggaggctaggcgacagcggtcggccggctcctctgttattgttttttcttttttttaagaatttgtgatttattgcaggatcatgtgatgaatttgatttgtgtgtgatgtgaacttgtgatgaattttgtagaaacttgtgatgtaatttgatttgtgtgtaattttttttaggatttgtgatataattttttagaactttaagatttgtgatgtggacttgagatcttacttcgatttgggatatgcataccacccatattcaggagaaaataaaaaagatatgcataccacccagattcgggagaaaataaaaaaggaaaaaaaaacctagtcccgttgttgttaccaaccgggactaaagatcatttcaaccaggactaaagatgggcatctttagtcccgaattgctactcccggttggaaacccgggactaagggggttcccaaccaggagtaaaaagatttctctaccagtgtgcatggctcatatatttttcttacagctgttgaaacagcgaattgaactacttctggtgaaaataatctccatcacctagttcaatactcaaccatgacccaggtagtttgacatgaagtttgtgtacatatacaggtcacgttcttattcgcataatgttaatcagatatcaaccagtcagcagtcttacacattaactatgtaaaaattcactaggttggaattttaattttaaaacatggaatactgatttgttcagcatatgttcctagctattaaaataatgtagactgatctcactactggagaaaccatatttgattggtcacctaaaattcacaatagtcctggttcgaataggaaccggaactaaagattattttttatcccggttaaaaactttttgatctttagtcccggttaataacactaaccgggactaaagatcatttttagtctcgattcatgaagttgtcgggtcaagtcaggccccaattatttttagtcccggatgatataaacaaccgggactaaaaatatatctttagtcccggttgcatataccaacctggaccaaatttcaccccgacccgtgcgcctcatctcagtcagttggtcgttcttatcccttccaccttcctctctcctcccctctcattaaattaacagcctcatctcagcctccacctcccctctcccctccctggccttcctcccccttcccctctcctcccctccccgcctcctcctctccaggcggccgagcccgggcggggacggcggccaagcccaggcggcgacagatggcacggcgggccgcgcggagggcacgtcaggcggcggctggcggcaggcggatggtagggcaacgacagctggcggctggcagcgccctcccctctgccggagggtaggcgggaggcggcagcggtagcattttgtcttttttttgtttttagaatttgtgatacattggatctgagaatttttagaagttgtgattcattggatctgagaatttttagaagttgtgattcattggatctgtgatgtaaaatatatgatgtatgtgatttgtgatgcatttcttttagaatttaagattttttgttgagaatttgtgatgtgaatatatgattcattgatttgtgatgatactttgattttgatttggggatatgattggcgatatgtagggagcaacttgatttgggaaggagcaactcgatttggaaaggaacaatgaaaaaaaaaagaaaaaaatagtgaccaaccaggactggcgctgccatgtttagtcccagttggtaacaccaatcaggactaaagatgaatttttagttctggttattttattcgggactaaagatatctatctttataaaatggggagtatagagggttacaaaccaagagcaaaaacgctttctccagtagtgactgtatgtcaaatattgctacgtacgtactgatcaatatgtatacatgatgaggtcactaatagatactaactaatcagatcaacatgacctgtccgttatatatatgtcactaaggaagcatcacagagtcatcatgctctgcacataaaaaattgtcagggtagaacataacctacggtcgtttagaattgaacatcatgcagcagggagatctcaatctcacgggaaatgagagcgctactaaaatatgaaacaaattgtaactcttcaatttcttatggtaactctttcaaataacgggatcgtcaaaaagttccaaaatcacatatattctaacacgtctaatgctacgtcatccaaagtggaataaatggtctttggctatcgatttcaagagtatagcaccactgcgcatggtatgcgcatggtatcctgttttcctgtaaaagcatcaatgaccaaaagtagagcgaactggaacacatgaaaatagcctccattatattagacatctttttggtgttaaaaattatatcattttggtaacaccagagcacgcaacaataaggcactaaccccgaacaaaataagttctttagtagatttcgacactcccgttagccaattaacaaaaatatttttggcaatacagggaggagggatgttaaagcaaaatggttgcatagccaagtaaaacgtgcaatatcacctccaatggcaggcatattctctttaactctctatgcaacatctgaaattttccagggttgatgcacgtatccatcctgatgctaccaactagaatgcaagatcgtcccttgagtctgtccgttcatatcaaaaatgcgactagaacggtgccactgcaagattgatgccgagctcttgtgtcgcatatgctccagatgcttcccaagcctaccatatgatcgattttgctgtgatcttatgcaatttcgctagtgctatataactcgtggcagatgttgaagaacccttctggatacaagaccttttacacttgtagtactgctggtcatggggttttatatatatcttgccaaaggaaagcaagctcctgcaacaacatgcatgcaggagcttcaatatcaatcttctatgtcaaacactagtcaattgtaattttgtactgtcagtatacgatcatttatgagaaatcttgtgcagaccattacacgagctggctcatgtgaactctttattttgtcacagctgtttaaatagcttcagctttgcatggtactctattcaccagcaggacaaggggtaaagcaaagcagttctaggaatgacaccatatcccatcatcggtgagtggatgtatatagcttctttaaagcaaactaggaaggtagcccgcg

SEQ ID NO: 8520 - DNA, 8817 bp, Oryza sativa
ccttttggctcgtggaacacagatataaatacgggcgcttaatctcatgcaactatatagtatttgctttaatgttcctatcaatctcttgcatctgattcttaatttgtaccgagagtacagttcaattaggaggaactaatacaaacagcacatggctcatctactccctattccaagcaagcagctcaatctgcttttgctatgaattcatcagcaatttctccattagttctgccaggatatataatccagtgcatacgtgaagcatcattcgaagaactggaatcacgcggtgttgagggaagacaggcgacttaattagatggggatatcgatcactaagcatgatcgtatgccactgtgaccagaaaagtgtcttaactgctgtgcatgctatcgatgcttcccaagcctacatatttcgccaaatggttcatattcagtctaattaattatatagctcgtgccatgtctagatgggaatctctaggaagagtttagaccttctgagtttgaagcatgatctcagagtgtctaagaactgaatttctgcatacacacacttgattgtgaatttgtagttttgtactgcgagtatatatggggcgtttacgataaactatatggcacacatcacctgcactcttatctcacatctgattaaacagctcgagctgctttttggtaattagttcatcagcaagatctccaaactgccatgataatcaaaacaacatgcctgaagcactgatcaatcttgcattatttttcttaggggtaaaaacaggagctctgacaatttcatattaggagaagagagaaaaaaccagatcgagttttcacaaactaggttacagaacgatcccacggaatctcctgcgatatatcgacgaccttctgaatcttgcattatttcaacatagaaacacgcaccatatatatcgacgacgaatgccacgcgactttggcctatcatatgcagtgcccaacaaaaataaggtgtccatatgggagttatatgagccgctcattttctcgatgcttcccaatcctacatctacatggctacatatatgctaattaactggattcattcagtctacctagctagctcgtgccatgtctcaaaatctctatgaaagttaaaccttctgaatttgaagcatggtgtttcatctataattgcatgagtagaactgaatgtctgcatatgcacttgtgcaccctctctaccttatctccacctcactatatatttacatgggtgcagctacttccattgattcatgttgtacggtttgatcctcatattaagttatttcgtcaattcaataataatcctagaatataagatacaactaccactaattaatgcaaggacaatgcatgcaccgataggattagaggttttaaaggtgatggatttaaaaaatgattttagggaagggagaggtactaaataattgcatgcatgtatgcgtgttttaaattatgaaacatgaaaagagtaggcattttttatatatatattaggatggatgaagtacttggaagtactaaaatatcgatcatataaattttgagaaggcaacaggacattaactttggaagcagagatggagtacaaaagaaaagaaaattaactggccaaaccgtatctaaagttgtaaaatatctatgcgtacgcttacatagttaattaattaggtgtatttatgagcaaaaagctagagatattttcatgctttttaaaaagtatagaaatattcttttgacacaaaaaagtatggtaatattgagacgtagggtaaatggatttctaactaaagttttacgaattataagttaatttaatgcagaatataaaatacaaaccaatataaaagttgcaatgcataaaaacaaaagttacgcttttttatattctgaaagttttaggctagttaattatcacattcaagtttaggtaaatgattgataaaaaggaatcaggcatagatacaagggagcacttgtagcttctgcaactatcttaacagctcgagctggttttttctatgaatgcatatcagcaagttatccatcctgccatgatatattcaagtgtgcagaggtgaagcatctatcaaataggtaatttcaaactggaaattcactcagtgttgaggaaaagcatgcgacttgggccttccaggtaggataagcaagtgagctcaaaagattttcccgcttgctagagaaaaaaatgagctagaagtagaataaccgggcaaaaaaatcctgcttgctcgcccgccgctcacatttactttcaggcagctaggaaagaatcctaaatgcagcacacatgttctcgatgcttcccaattctacatttataatcgttcattccactactttattccctccgttccaaaagaacccaatcctgaaaaccaatctctaggattaggttttttttaaaggacgaagggagtagattgaaaggctcctgtgtaccaggagcatgaaaaaataaataagtgaccttttacagtgtttgcattcctaaaatggcatagatctaacagctcacgatgaaaggtaccttatgaaaggtatcagaggtagaaaggtactaaggattaaaaggtaattgataacagggcaattatgtctaacaacgtatggacgtaccgaaaggtacggtgtaagtggatttaaaggtaccacaaggtactgcgtaagtagtttttaaaggtaacgtaaaatatgatttatgtggtggggacaaaaattacattctcttctattcggtttccaatcttcggtcgttctgtttgcgtcggtttctaaactttggtccgatttacgtggtacatatcatattcgcatgatcttgataattatttccagttagtcgttaattttcatagcaatttggtgatccatcgtttgatgaatgtaatcaaagatcgaaaggacaacaaattgagaagatttacgcacctaacaagaacaaaacaagttcaatgaggaagatttgcgaaaaaaactaaaccaatcgtctaatagatcgagaccgtgcggccgcttctagctccggcgaacataggcagtcctggaccacttcctccgggtcctcttcctccgccgcccctccctccaaccaccgcctccggccacacgtccaccgccagccctcaattctccacctttcaacttatcgaagaacacgtaaaccttacgtacgaacagaacgtatctaagaacaatgcaacgcaacaggctacaagctaattccttcgataccttctcataccttttcatatgtgtaaaagacacatttggcattctaataacatcatatttacattaatgccacctattacaatattttctttccataccttgcccctcgcagatcaacggctcacgtcgccccacctccttgtacctcacaaatatcgtaaaatccctcaacaaataaacacacggtaacaatattgttgtcgagtgccagcgcatggtaatagagacacacggtggcttcattgatttacgatgcacactttctcgatcggtctacccagctcatgctgtctctcgatcggaatatctaaaaatcaaaccttctgaattgaggcatatgtgtatatgtgcagtcaagcaccttcccaccttgtctccggtgtatggctgtgtttagttcacactaaaattgaaagtttggtttaaattgaaacgatgtgacgaaaaagttgaaagtttatgtatgtaggaaagttttgatgtgatggaaaagttggaagtttgaagaattattttggaactaagaccctgtttagttggggaaaaggaaattttttggtgtcatatcggacgtttgaccggatgttggaaggggttttcggacacgaatgaaaaaactaatttcagaactcgccgggaaaccgcgagacgaatcttttgagactaattaagccatcattagtacatgtggattactgtagcacttatggctaatcacggactaattaggcttaaaagattcgtctcacgatttcccccataactgtgtaattagtttttctttttatctatatttaatactccatacatgtgtccaaagatttgatatgatgtttttaggaaaaactttttgggatctaaacgggccctaaacacggcgtatatatattgacctgaattgaaacatcttgtcacattgattaattgctgtgtcagtacacactacaggttgatcctctgatcaagttatttcctgagttcctctaaaaaaaaagttatttcccgagtttaattatacgtggctatattagtttaatttggtttcctctcccatttagctaaagcaaattaatgtaaggagagttgttttataatgcttttcaccggtagtaaatctatctagaccacttttttttccaacttaatggattatacctacttatattaccacatcaatcgctaccactacaaaattgatatttaatttctggacaagaccctccttagattttagacggttcataagtgctctcatctgcgaaaatagtttccgtacgctttcgtagttattaattaggtgtatttatgagaaaaggctagagatatttttacgctttttaatacagaaatattcttttgacacaaaaaagtatagtaatgttgagacttagagtagatggatttctaactagttaatttaatgcagaatataaaatgcaaaccaatctaaaagttgcaacgtataaaaacaaaagttacacttttttatattctgaaagtattagattagtcattacgttcaagtgcaggcatgaagcgtctatcaaatactccctccgtttcaaaatatttgacaccgttaactttttagcacatatttgaccgttcgtcttattcaaaaaactttgtgaaatatgtaaaactatatgtgcacatgaaagtatatttaacaatgaatcaaatgatatgaaaataataaataattacttaattttttttgaataagacgaatgatcaaacacgtactaaaaactggaataaaaaatggaaggagtagtaggtaatttcaaactggaatcacgcagtactaaaagacatgcgacttgggactctaaggcagctagctagtactccctccgttctgacgccgttgactttttaccacatgtttgaccgttcgtcttattcaaaaaatttaagtaattattaattcttttcctatcatttaattcattgttaaatatatttttatgtaggcatataattttacatatttcacgaaagtttttgaataagacgaacggtcaaatatatgctaaaaagtcaacgtgtcaaacatttcgaaacggagggagtagaaaagaatcttaactgcagcacatgttctcgatgcttcccaagcctacatttgctctatctctcgatcgatcggaatctctgaaaattaatccttttgaattgaagcatggatcgattcatctataccagtacttgcatgagttgaactgaatgtccgtgtatatatatatatgcagttgtgcacctttccagtctaatattgatctcaattgagccaccttgttacaatattgattgccgtgttaattagtagtacagtttgatcctctaatcaagtaatttccttatttaataagtgattatttggttaatttggtatcaagtgattatttggttaacttggtattgattgccgtcttagtacagtttgatcctctgatcaagttattttcttatttaatacgtggcttctattgacaatagtattagtagagactaaagaagaaccctggcttagggaccctagaaaaaggcaaacggttcagattatgtgaaattcactcggtggagttgagtccaactccaagtctaactatagaaactgtgtttctactttctagctatctactacttatgcatttagtacttgactaaactcgaccaaacaaaaatatcaattagaaaacttttgacgacctgggaaagaatttaatttggattgacagagattacatatgagaaagaaaactcggccatgcattttctataataaacacaatgactcggtgagattactttgacactaacactaatgaccaattttgcagaaactagtttgacttaatacccactaattaaaaatctagctaaactaattgtttcatgacgagttcagtcaaaactgaaggacatgttgccttcagatgctcgaagccatcggtagccatggccgccttgaggttgcccggagaagacaagaactcgacgcaagcctccttgagcgcgcggcaatggtgctgctccgccagcgccagcgtcacggcgacgttgcccatggcgacgcggcggcgcagcctgtcctcgcagatcagcctcagcctctccatcccgtacgcgtccgccgcggcgagcagccgccgcgccatggcgtcgtcatcgtcgtcgtcgtcgggcagcgtgtcggtgtagatgaagtggagcagcgccctgaacgcgtcggcgtccatggcggcgagccgcagcgtcgccggcgacgacggcgaggcggagagcttggccttgagtacgggtgacctcgccgcgagcacccaccggtgcgcgtggaacgtcgtcgtctcgccgtcgccgccgtctagctcgatgacgacgtcggcgccttccttgctccagaggagctcagcgaggtgccggtgcaggtcggacggcggcacgacgacgccagcgtcggcgccggcggcgagagcctagtgatgatccagatcgacggtgagcaggtgttcgtccatgacggtgaggtcgcagcggacggcgaagcggtcgtccctgaggatgtccggcgacctctcgagctcgtccctcgtgatgaggctcctctggccggagaagtgcgtcctgaaatccaccacctccgacgaggcgtcgtcggtgcggcgcgccggcgagccggcgtggtcgagcacgctgaaccgggcatggccggcgatgccgctccggccgcagccgccgccgccggcgacgtcgacgaagagggagatggagtcggcgcagccgtcgtcgaggccgttggggtagtatcgcatgacgaagctgtggccgccgacggcgaacctcctcgacgtggcggactcgccggtggcgaggatgctcttcgtgttggtgtacccgtcgatcctgaggatgtgggacccggtcgccggccgcgacacgatggcggaggcggacggcggcgaggcacggcagccggcgacgccgcggcggatggcggcggagagcagcgaagcacacgacatgagacgagagtttggaacgtactacagatcgatcagccaatgatgatatgatatgttggcagcaaattgtagagatttttacggttcagataattttttggtggttatggagattctgactcaaagattacaactaaaaaaataaagattatgatcgtatcttggatttcaagtttatgacttcggtttccaactaatttactgatatgatattatccaacaaaaacttatcttaacctctatgtttatctgtagaaatgaatccttgaatcttcaggtcctactcgaacattttctcctgcatgtgtgcttcatctttcaccatcttctcttcattttctctgaagaaatgtggtgtcggatggttgggaagataatctttcaccatattttcttcattttctctgaagaaatgtggtgtcggatggttgggaagtagagcggttgcatctgcaatggcagcttccaacaccttcacctcttgaaccctagctccctcgcaattaatccatacattgagatccataagagaggtgaggttgcgaatgccaagatcaggatgatcagcgaatgcagattttgccttgtgtgctctaacaacaaccgagatttctctgaccttctgcatggatccatcctcgaagatcaggccgacgaacgatccatacagacggaagatcttcaggcatcggaatatgcatttgctgataatgagaatttccatgggatcatctgattctgaacgcagctccaggtctagcaatgcaggcaagtctccaaggatctggaggatttgctttgtcacttgcttagacctgatgcatagcctgtagagattattcattgaagccatccaatctgggatcctttggaaacagcatttcggaatgtataattcctgcaggagatgaggagatgatgaccaagaccaagaatcaaaggggatgtaaccagaaaaaggtccattgataatgctcaatgattcaaggctggaactgacaagtttgccaagtgatgaagccaagctatcagtataatgtgttctatccttgcgcgattcgcgaatgtaccaagttagcttgagagttctcaggctgttcaaatttcccagctccagcaaagaatttgttgagcattcgtcgtacacggttatacctgacagttcctgtagagattgcatttttccgactccgtcaggtaactgtgcaccattagcagaaaaacagctcaaccgtcgcaatttgacaatgcctgctggcaattttcttatccatgtacgacgcaggtccaatgttttgagaaactgaagctccccaatttgttctggaagatgtgtgattctactggctgcaatccgtaagtaccttaactgaaatagatccaccacgttgttaagatcagagttttgcaatttcacactgctctctagatccaacactcttaaagctttgaattctcaaataggaggcatttgttcagagtatccaaatatgct

SEQ ID NO: 8521 - DNA, 1651 bp, Oryza sativa
gttttttttctcgagtcctgaaccaattgaattccgaatgcgaacccattcttctcttctatctgatttatcagccaataggctagccatagtaataattgccaatggcagaccaccacacttttttataatttcagttgaaacatctttaaggttaactgggcatagatcttctgagccgaaaattcttctgaagaatagacacatggagtcagcttcacttagtggccttaattcataaactgtaccatgatcaggggagcaacatgacttggcaacagtaaaaattcttgttgtcactagtatcctgctaccacaagtattctcaaacaaggcaaatttaatggtcatccattcttgcgtgctccatatatcatcaattacgatcaaatacctagcaaatgagagatacaacgatttaatatggaacaaatcactgacataagtatggcctactgtacatacttattctctaatctatttatgtgcacaacatgtacatcaatcactgacataatgttgcaatgaaattacaattttgcctactggtagaatgacatgtaaattcaaacagagttaatgctaaatggcacgtaatttgaaacagagagcttacctcttgtccttcaggaaaaccctcagtatgtttatgagccactccacatcaccagattctgtgctactgtaatcttgcttcttgatttgagaaattacagctttatctggatttgtgctagcatggtatggttccatgatttgacaaattatgctccgtaaaatcttctttacatcaggcttctgggagaccgacacaaaagcctgacaatcaaatcgcccaccagtttttttgtaaacttcatttgcaagggtagttttgcctaagcctccaactcctacaattgaaatcaccttgaatgactgatcaccatcatctaccaggttaatcagctgatcccttggaatatcaataccaactagattcgatgcctcaacatagagtgcaggtaatcgaggatcaatgggcaccacatttgtggtttcagagtacaattcaggatcaatcttgtacctcttccttctgtggcttgcctcaacaatgtcatccttgagaacttttatctgctgagcgacctcgcgtcgagctagcagctccttcaccttgtgaacatagtcatggaagaatcccacaattccagtaggtctctgtggctcgtagtgtagctggtagatgtacctgtcgatgcaatcctcgatgtcgtaggccatctccctcacttggttcctccactcctccatctgggggtcaagcacctccatgccggccagtttctccagcagagcattcatgcagctcagctcaccattcaacaaggcgatgtcgcgctgtacccccttgtgcagcctgaattcctgacccagcagcgtggtgagcttgtcgattagggagttcatcgcccccgtggcgacgctcaccatgaacccatccatcgcctctgctggtcttctgcactcttggacgagtttgcacctgaggtcaatcctgttcagaaacaatgaagttgaaagcaattatcagttggcataacactatcttgtttatgccaaaaatgctgaaagtgcagatctctgaatattacaaacatctaaccat

SEQ ID NO: 8522 - DNA, 2219 bp, Oryza sativa
  unsure (1)..(2219): unsure at all n locations
aatttgcttataccaatacagttgagaagatccagtattaccaaaaactgcagctcacctatttgatctgggagagaaatattacttgctctaatccgtaggtacctcaactgaaataacttcccaatatcctcaagataactgctttccaaattgttatttccatctagatccagcattctcaaggctgggaaattagaaagaggaggcatttgttcactgtatctaaatatattcaaggatcgaacatgagtagtaaccatggaatataatgtcacatcttcttgaccatagttgtaaaatgagagtcggtgaactttgtcttttgagaccaacatttgttttctgtcagtaacgatagtaacaaaattttcttcagttgcttttgatataatgagatcaagtatcatatcatgcaccttacatgaataaactctaccatcgtactgggtatgtactggttggatcatgcttctgtttataagttcattaaaatagcattcaccttcttcctcaaaagttcttccaccattagccttgatgaatccttctgctacccaccttcttaccagatagtccctgttgatcacataatcctctggaaacatacttagatacaataaacaagtccttaaatgatgaggaagatcataataactcagagataatatcatgttcatctcctccacatcagaatttttctcaattcctgaaccaattgaatcccgcaccttgaaccactctgctcttacatatgatttagtagtcaacaaactagccatagaaattattgccaatggtaaaccaccacatttcctcacaatttcaactgcaatatctttcaattgatgagggcatttatcttcagaaccaaaaattcttctgaaaaataaccttttagagtcatcttcgctcagcactcttagttcatatacaagattaaggcaaggggaggaacatgactttgcaacagtacctattcttgttgtcactaatattctactgccacaattattctcaagcaacgaatatctaatggtcttccatgcttgggcactccatatgtcatctatcacaataaaatacctaagaaacaaaataaagttataattcaatggtgaggtttttgcaagaaagcctatagattaatatatgcatagtattatatgaaatgtgtgacaaattttgtttagaaatgcaaaattctttttttttgttttaatttgtttcctatcaagatagaagttctcaattacaggaaagtctttgtgattggtacatgggtggataccgcttttcatgttgtaaattataacagatagtctattagctggtggtgtcaaatacagataatgataaaagttactagtgtatttgaagctagagcggataaatttatcatattggaatacctcttgttcttcaggaaagccctcagttcattgatgacctgctccttatcccctgatctgattgtaccaacctcatcattgacttggtagagtatggtttcaaagatcattcccatgacaggatgctgcgaaagtgacacaaaagctttgcaatcaaattggttcccgattttttggtacacctgattagcaagagtgctcttgcctaatcctcctgaacccacaattgaaactaccttcatcctctgctccccatcatccaatgacttaatgatctcatccctcggaccgtcaataccaacgagagcatccaactccgcatacagcgcaggcaaccgacgatcaattggcacaacatgattacttttacagttaactgctgaatcaagcttgtaccgctttcgccgctgtcctgcctcgacaatccgagccttgagctcctgaatctgctcggcaatctcatgccgaccgacaaggtccttcaccttctgcacatagccactgaagaaccccatgatgccattgccaccgggcctctgcggccgcccatggcggagctggcgcgtgtactcgtcgatgcagtcctcgatgtcatagctcatctccctcacctggctcctccactccttcgtctgcggatcgagcgtcgcctccgtgtcggccagcccctcgaggagcgcgttcatgctgctcaactcatctttcaggaaggcgatctcgcgcttcatccccttgtgcatctggtagtcctcctccaccaacgcgnnnnnnnnnnnnnnnnnnnnnnnnnnnnnnnnnnnnnnnnnn

SEQ ID NO: 8523 - DNA, 620 bp, Oryza sativa
cacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaattgcttcgaggcgctagacagaagtctaagggacatactaaggtccaagggtgaagataacagcacaaagccattcggcggtatgactgtggttctaggaggagacttccgccagattcttcctgttgtgcgaaagggaagacgcacgcaaatagtaaatgcatcaataaaacggtcctacctatggcagcacttccacatcttcaaacttacaaggaacatgcgcctgagctgcatctcaagagatgaagacgagcaaaaaaggactgcagatttcgcacaatggattgtgaacattggtgatggcaaaacaacatcagcggatggagaggaatggatagaaatacctgatgacctgatactgaagaaaggaggtgatccaaaggaagaaattgtgaagagcatatatccaaacttggtacagaattataa

SEQ ID NO: 8524 - DNA, 9964 bp, Oryza sativa
ccattccccataccagcattcctgagtggcaaataaaattgataaggaaatagggaagacgatgacagtagcaccacggttaaaaaatttcactacttaccactttctccacatatcaggagctttacgcacagttccatcaccactacaaggcacatcacacaatacacgatcaaattccaacctctgcagtttggactcatccgtgcatgtttctgaactaaactttgcaagattacagccaggaaagttctgtgcttcatgattcgtcacaatcaagttggctgtgcacattctctttgtctgatgaataagaagattgcatctttgcacatcaacatcattagctaccacctgagtacaaagtatgaaacacaaaatcagaaaaaaggttttgattcaaagtttttttttctatcgttaccagaaactatagatatgtgtaatagaatgtgaaacatacaagggcatttggaagcattccaggctttgtagactgatggatcatctcaagtaactggaaggtctttgatcctggagcagcgcacactgcataggataataccacaaaaattcacaagaccaatattggagaagtcctcctctaaaaataaaattttcaaatagtccatgtgtaacctacttttaagctcaaatgcctcaaaagctaagtctgatataaagctaaagccaaacagaaaaggctaggtctaaatgataactacggggtattctggtgttctcatttttttcctttttactggtactaataaattaacatgttcctgagacttataaacttttattaggaactattgcgccagatgctttattgagcaattagttttaaacattacaagctggactacagaagagcaaagttaggtcaaacatgcaggtcaagagacagacagccagctgcataaatagcacaatatgaggaatgatggaaaagaacgtggatatacatactgtcaagaatatgatgatcaggttgcacattcagaaacaaaggaggaacctgtaaaaatattacatatcattttaacaagaagaatatccgcaatatacatagaccatcatcaataaacaatatactcatatagctcatcttaatatatataaggaacttaccatgctgacagcctcttgcctagttatattgccaacttcattctctcgcttcaagaattcatgaaaactggagagggaaacaaatattacaaaaaagtattatgtctcaatagaatattaaatgagcgcctccaatgtttcaatggcagcaattgttaagtgcaatttttttcagtttctttttcaaaagaaactagccctaaaaaatcttatgaaaaactgctaacagtgatataacactaaatctgcaacaaaaagccaaacacaaatatttgagaagttttggtgaacttttggtgatggtttagtagagaattcaaggcaatcactgatctataaagccataaattggttagtaattcatcatttaaggggcaaccatgttctcaataaattcatcaatttacacaaactagtaatgtgcccgtgctaacgctatggtgatatttagtaatgatggtatatacatgagatgacaaaaaccaggtgaagggagttttattgtaacaaaaacatcagtttaccacactcctaaaaaacaatcatcctatatactgcgcattgttgacacaattctcccaagataaacattatgcatacccctcaagtgcctggtttctcctcagctgcattcgagaaaaattcaaatgccatgcaagattgccagggtaccaaggcaaaggccgaatagcatcttcttcatgctcatcactaacctgtccatgcaaaaaaaaaaaaaaggattacaaaatagaattgtgaaggacataactaaaatttatgcacaaaatatagaagctacctcagtttccaatgacttcctgaagtcattttctaactgtgagcaaatatcttgataaaattgacagctggaaaggtaaggacaacattagcatactagaacagaataatcatcataaaacaagaattaattatgtgcaatgataccagacatgataaggtatcagtaaaatcaccagtgcatttcatgcaaatgcttttgttctaactatatgatcaattgcacatagaactggagatggttatatctgaagaatgaaccatggcagggaaaaaacaggagaatcaggatagagataatgtccttttcttttacaaaaggacagtgaaagttatatggagtcaagtaaaagattattcaaacagagcatggtttttatcaattcaaacaataggcagatatctagaacctatatatgattagagtttaaataacagcaatagagagttagcaagataagattaaaagttttgattgtatagaaaacagtataaaatctatatctatatctttttataagctaggataatcccccagattcatttttgttggaacaaagttttgagagcttatagatatttcacccagaacatatacaacaccaccaaggaatttttgccttcttggtgatttcgagcaatatcgcaagctgtttggtcatgaaaagctacattacacaatcatcagaactcaaggaatgattttctttaaaatgtgatgctgctatattgcaataatcaaggtagtgtcataaacaagctaactgcactgccattcaatacaatgtgaccaacaaacaataaatcattaggccaaacatgtggatggagtcatgttgcttcagatgaaaacaacattacctcgcattaatcctgaaagtggctggcagcggtttccggagcatgttcatgaagtcgtcccactctccctccggaataatttgctgtgcctataagccataaacatgtataaacattctaattcagaagttatgcatccaactgaaaaactaagctaataagcaacaacagtataagctaatgcagtgcgtccagttaggcttctcttatcgtaaggtaagtctagagatcagtactcgctactcagcatcacaatcaaaatagagcagttgcttcttgcttgaaagctataatatccgcaatcaacaagacaacaaatcatcacattctaaacgaagtacacatacctagagcgagaccatacgatcaaaaccgagatgccgctagctcagctcaatttttttactaacacaaccaaatcacacccaaaaaaagtaaaatattaagcaaccgcaccttgtagtagtcctcgaaggctgggttctcggtggcgaagggctgccacgaggggttcccttcgcgcccctcggcagcgcctccttcggctccttcgccgccagccgccggggggcgctgcgggttgtgcttccagacgttctcccgcccctgcttgaagtggcggcgctgcgtgcgcccgcgcttcctgccgcctcccatggcttcctccctctctcgcgcgagctgctcctgcttccgccgctgctgctctccctcccggtgacggcgcggatgcgggcggcggtggcgcgaggggaggagggggttctcttcgaggggtttaggagcggcggcgagtgatgcggggtggggaggaggaggaaaggcggctgggcgaggaggaggaggtcgtcgaggtgaattagttgggccgggctccgtgtgggctggagacgcgcggtagagtagttatgggcccactatttcacgccataaacctgatgtgctagttgtcttctacgcccaataagatgttgggccttgtttcccttcagttccataaataagttcatttatagatccttaacttgaaaacaagtttgatttcgttcctgcaccgaaataccggatacaatgggtccctgtccctcaactgttgaaaccggtgcaatatgtgtctcatggtagtatagcaggtggttttgtccaatgtgacaatttaacccgaatcaacagtgctaactcagcttgggacttggtgaagaagggcttttggtggggtgttggcaatgggagttcaattaatatcctcactgacaattggatcccggcgttgttgcgggacatctgaaaactctaatcccaattcctgaagataccaaggtgcagtcctgatgaatgatgaagcaaatgcctaggatagtgatactgtcaaggcactgtttgaggaaggggttaattgccaatgagatacttcaaatccctatcaatcgttttggtgacgaggacttcacgtcctggccacacgacaaacatggcacctacacagtgcgctcggcttataacttggcacggtctaacactttccttgcttcacagtgtaacaatgggagaggacttccttcttctctactggagagtcagaaaagctggaaagctctgtggaagatcaatgcacctgggaagatgaagataaacctctggcgtgcagtccaagattgtttgcccactggcttccagctgagaaggcgtcacattgattctaatgacggctacgttttctgtaatagggatgatacgttggaacatgtctttctttcatgcccctttgctagctctgtttggcaggaaattaaacagatatatgatatcaaattgaagagaagggggatcatgcacttgagaaattggatttttgacttcctggaacagaattcaagctttcaacacactgtccttatagtaactttttggcatatcagggaagcaaggaacaatgcaagaaatgggattagcgccctgcatcctcggcgcgtggctcagaaggtgtttggttatgtcgatatgataatgcaacattgctccaaatctcccctcctccattccaaggtggattccaccgccggaaggaacagtaatgatcaataccgatgctgcagttttccaatctactcgtcaagtgggaatcagatccgtgatcacacaggtatctgcttacttgtactgaatcatgcagcgaacgagtgaacaacatcgtcctccctgaaatggctgaggcactggctattcgtcgggcactagtactggcaacagaagagggtttccagcaggtgttggtagcctctgattgcatgtcagcaatacagcgaatttaggcaccatctcgagatcgatcaagggtggggtgtctgatccaagatatcaagaagattgcaattggtttccaagcctgttcttttatgcatgttaaccgtctctgtaatgcagtggcgtagataggatttagagtaaaagtggtccatctatatatataataggtcaattaaaagggtagtccactataaaatttttattatattaactagtactacatatactatagttttaatctcgatcaaatttttaagtggtccaggacccacagtgccacctagctagctacgcctctgctgtaatgtagcggctcacactttggctcattgttatgagcaattctcttgttctgtctatcgttctgtgattccggactgtatccgggaaacactctgttatgatgcaagttaatcaatagaattccaacattacctaaaaaacagagtaaatattgctagtgcaatacttctcaaacctctaagggtgtgtttttttagataatggattacattaaacccagcctctacaccttgtgaggacagcctaaaagtcacaaacatgagtacataagactctcccattacatgggtaaagcataaaaagtttttaaagacagacaacaagcaaaaggaactaaaagctaagcttcaatccttcttctagagttccacccaaagatagagaaaagctccatcatacgcttctctaaaagattgcatttcgcgattacttcaatgccttcgtcttccttaagaagcaaagaccaaagccttcccaactgagttgctttgaaaattacctgcaagaaagatacgtggttgtagccattaaagactaagtcattcctactgagccacaaagcccaacaaatcgttgctatgcccacccaagtttgtcttttaagtttagattcaaaacctcttaaccaatttccaaacaagtgtgagctattacggggttgcttgattccaaaagtaagatagatcgcactctaaatgtatctagctatgagcatatttcccatccttaaggaggtaccacgaggtaccatcaggtaccaatctaatctaactgttggtttaacaggggtaggattgtctaatgaaaatgaggtgcccgtgctaatgaccgcccactcggccaatagggagttcgtctgtgccgcccacttctcttccattctgccgcatcgtggttgcatcgaagcttccccggcgccgccgtatcgagcctgttctcccaccacggcgccatcgcatcgaccccggtgcggctgccgccgcaacgaggctgccgcatccagcccgccgtcccgcggccgccgtctcatcgagacagccgcggtcccgtctcatcgaggccgctgtgcaatttaaagaagagatgttgaattgattcattagttacaaaagctacaaagcaaactacgcttctatctatctttcttttagtaagattatctttgtgtatttagatggagtaacaggctcagatagaattggccgccgagggaccgggcgactcgcgcgcatgagggagagtgcgtgcactcgcatcctccccatccttttctctccctcttttcctctcaacctctaaattctcccggttgaatgggtatcatgtactactatttgacatgtctcaatcatacaagacttgacactcattgaccagtctccacaatgacagtactgcactgataagcttattgctactagacatcctggaagctagctctcatctcaacaaccggcaatccggcatggacttggagactagcgagtccctctgggacctcagaatcaattcctagcctgaatcggggaatttcttcttcttttttaaaatagaaaggcctgacagccttccccttttctcatatcagaaaagcagacagatttaaacttgcaaaatggaaaaggaagaaataaaaacatccagggaaacttcgcacacagctcatgatcaagtccatgccggtttagatccaaagtttggatccaaacttcagtacttttccatcacatcaacctgtcatacacacaacttttcagtcacatcatctctaatttcaactaaaatccaaactttgcgctgaactaaacacctaagcattatagggcacgctagctgaaatggtgaaaaatcctgcgtgtcaatggcgcacaccgacaaattaccccttcgtcgatgacgacgacgcgagtcacgcgatccgcctgttcctgttccgccgtgtgcgtgcgcgcgccgcgtttcgtcactcgtcgtcgtcgttgactcgttgtcgtatgcagcggactcgatcggctaagcgctctcgtctggttggctgcagggtggttctaataaatgtggtgtgtctcccgtcctgcgtgtaagtaatccatcatcatccatggtaatagactttggttttgctgggtcaatgcgcattatatattgatcggctgccagtatcttgggttcggcatgcaactacttatgctacagagcactcgcctctgatacagagagtaattgtgtgtgaccataggattgaggtgttcagcactacttcagcggttggcatggttttacagtttgtgtttgtgaatggtagacggtgaatcgggacagattcctggctgccggtgaactgtgactacaaacaaaattatgctcattcacacaattgatcacgtcgtcagttcgtcactgaaaattccctgtactgcagacgttgagttcacaagaagtgaccgatgtagtggacagactcaatgatagcattgatcttgaagatactactagtagtacatttttagtttctcgttctgttgttggcagttaagtaaactagaagtaacaattatgaagtggcttccccaaaaagagacaaatattatatttcttgtagtagtttgcgtttctcaaattatacaagtcatgatggatatgtcgttacttcaatctgtaaatttcgcctacaatttgtagtttgtacttcaatgatgtgatcaacaaggcaggggttgaggaaattattatcttggccctggctagcttgtcaatgcgaattattgatcggctgccgatattttgggttgagcaacaactcgtatacatggtacagatcgctcgccttgatacagagagaaattaagtgcaagtgtgtgacacgtctctcgtcatgcaagatttggacttattcatcagtctccacaatcgtggacagtagggcactgctagatgactgctacgggatctcttggaagctagtagtagctctcacctcaacaaccggcattgacttggcaagtctccctgggaccctaatcaagattagagagatgttgagcagcggtagaggaggagctgaccggttgaccggccggctgaggaagtgagaagagcttaattagctgacagttctgcatcattggcgcaccaacaaaatagtgttttgcccttttgctttctaagtcgcttccagcgtcgtcatcgtcgtccaattagacaataataaagtgattttcggttgtgatgatgcggtctatatataccgggattgatcaacgttgataactaattagttaactaatcgtcaatgtcactagcttctcaaatttgctgggccagggatacagtcagttagtgcattcctctcatctatttaacactcggcccagccccaggcccccagcagcatcacacgtactcagaattcagaaacacacaaccaccaagagagaattaaccaaatgaccaagcttctccactccgcctgccttctcatctgcatttcaggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgtaagtactatttcagtataatttagtaaatctgattttcacaaagttgtaaaaatgagtcacccttatttttattttacttttttagaaactagaaaaaaaatacccgtgtgttgcaacgggtgaaaactattttaatcatattattgttagatttttttaaacaatatatgggatttttattttgatagtattgatatctaatttggaacttttattagaatgatggctatatcctacgttgctattttttatgctttagcaagaattctaaagcaattagaagtccaactctcgtcccaagttaatatgcgagttttttaaaaagatttttatacgactctttatgtacttttaaaagtgaatgaacttagagcatcaccaacagtctatctatctgattttcaaaactgatttggagggattttaataaaaaaaatagctccaacagatcccctactcacctacccaagttttggagttctcttctcccgattcctcgctccgtttatatgcggatgcgtgttctcgcaaaagtcgctcccaatctcgcactcccgcatctctcctcccgttcccgcgtgtgggagatagcgatctttttgcgatggaagaaaaaatagaattttttgttagtagtttaacaaaagggtccattttaagttttagggatttaattt

SEQ ID NO: 8525 - DNA, 509 bp, Oryza sativa
tttgaatgagcctgatctaaattcgattgacatggaggtagacaatgacaatgtagaatgcaagtacgggaatgcaggcgattctactagtcctgaaaatggcaaacatattgaagatcagattattgattgcagaatgactgctttgaaagatcatgagatcaataccgatgtcaggataagagatgtcaacctcaattcatgtttagatgcaatgtctcctcctgtttctggtgcaaattatgaaacatctaatgccatagatgacaataatagatcatccatcattgcccaatgctttggtgctaattctgccgatgacaatgcttgtaaggaggaaaattttgtaaacaaccagagcagtgtatccaaggctgaaagcttcaaccagaacaatgacatgatatatcaacctaatttgaccatggatcctatctctcctgctcaaattaatgtggattgttttacttcttgttcaatgacatctgaaattaagaacaatagcaaca

SEQ ID NO: 8526 - DNA, 694 bp, Oryza sativa
ttcctgcaccccagattagggagttgaagtttgtgtttggcgcccccaaacattgggcatgataagccgaggaagctgtatagtggccgctgcttgtgaatttccaaacaatctgatccggctcctcgctgtctaagtgcacattccgtaccgcctcccataggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccgttaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttgtccaagcttaggacaccaaggcccccttggctggtcggcaagcatgtctttgcccagttgaccttgcatttccccccggtgatatcccccgtaccagcccaaaggaagcgacgtctctgcttgtcaagctgctccagggattccttcatcaccttcaaggcagtgaggagataaattggctgtgctgaaag

SEQ ID NO: 8527 - DNA, 663 bp, Oryza sativa
  unsure (1)..(663): unsure at all n locations
taatcacctaaagttgtcatgattcatcatgacccatcatcgccaatgagttctctctcctctaggtcctctatctccatcacttcgtctgtgagactgaatatgtctggctggaggctgaagacaatatatacactgtctagacagagagatatcatcacaacagggttagtatgtggtcaaatgacatatatcaacatatgtttataactttatattattgtgtgctgattgctgaacacacatgtcgcttttctggatttcctcataagcgatcaacttacctgtctgtatatgtcactgcagtgttgcgcaggttaagtaagattcaatgtacggtccaaagcaatcctgagacaacgaagactagccaaggaatgatcggagaagacacggtccaaattaaccgtgtgcatcacggtcagggaaaatgtgtcttcaaaagagaattactctggtctattctccgagaccactgtcaaaaaattaaaaccaaaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8528 - DNA, 4395 bp, Oryza sativa
ctgcacccccattccagagtagtcctcacgtgtcatgatctaataacaatctgaactgtggcttgtgctatctgtttacctgaaactgttaatataacaactgttttggtgaatgggtaataccactatttttgcatgtccacattaccagttcacaaattgaatcaatttatttgccaaaagtacctttttttttttgtgcgtaaagatcacctgtctgttaaaacttcaacgcatgctgctatcgatgtttttaagctgttatgtttaatttgtgttactccagatacaagcttttggggctgagggaatgacagaggaaatgctgaagtacttgaatgtagctgaaaatgtcttatggaacatggatccttatcagaaaagtgacctctattgcattgccttgcatgctctggtcaaggccaaagatgtatgtacctaccatcttttactgcttagttcgttgtgtccaaacgattaatgtttttttatatattatttttgatgcttgaattttgaatctgataggtccattccttgtttgcggacccacaaagcaataaaaaccttcatgaccatcagatcatacggacttccagcaaatgttgcaatttataatattatgatagagtgctgtaaattgttgccttgtgtcaaatcagctagcgctgtgctatcattgatgctccgagatggcttttatcctacaattttgactttcacatctcttgtgaaggttagtccagttagcgatgcaactgtgacttttgattcttttcttttagttgactttgattttttgggtccacttacttgagtttcatatctattatttgccatgacaggttgtattggcaagagaggattttgagggggcgctggatctgttggatgcatgcataatagaaggaattcagcctgacattgagattttcaatacagtactcttagaggcatttgaaaaggtttggctatgataatacacctttttcctgaatgatgctgatgtctaactcatttctgaacattctgcagggtcagattcatgtcgttgaatatatagttgagtgtattcaccgagctaaaatccgacctgatcaatcaacgctttggtacacattttgtgcctacgtggatcaggaactgtacaatactgcaattgaagcattgcaagtcctcagtgtgagaatgatatctgaggaggccgatgttcttaaggaaaaaggagtaattgtagaagatctaatcctcagcgaagagccagatgctgaattaaagatcatgaagacatttgaagcaactgaacatcttgcgacagccttactgaacttgaggtggtgtgcaacaatgggttccacaatatcctggtcacccgaggatagcctctgggcaaggaggttggcatcttcttatgacggtaacagaagaccacatatatttaccagtattgtgcctaaacagtttgtggtttgaccagttcttcccaaaggatctgtatatacatattgagtgtcttgtgactctctcctgagggctgaggcatcagttcacatccattgatggactggtctcatgcaattctcccagctccacctgctgctggcaatagcggtgttcagagcatcagcagcacaaattctgtaccaatttcattgatggtgacgaaaagatcgaaccgcacagcagcaatagttttttcctaagattttggagacaataatgagaggtttttacaagagcaagagttgagagtgctgttccttgtagcaagacctgctgcttatgagcctctgacgtgaattctttctgatacatgttgtaacaaaaccttagtctgacacactgataaaaatgttgtagtttatccctcttggagaggcccctaaaaatgagagctgcaccaagcatttttcatcggccattttgtcaagtataccatcaaatataatcatattttctttaggttgtcttttgacatcatatttttcttctaatttctgtaggctgttgtaagttgtaacatgttaattactccattagcatggataatcagataattgcttgttactggcagtcggtcctcgattatttaacatcaatcctggctcactatcatatactcagatagccccacgtatcatattcaaaagtgtcaatataatcaaatttagccaataaaaggtttagattgtcaaattttacttatgtgaaatttctcttatgatttgtttgtctgatactctgtctgatcggtttgtcatctggtgcccaccgcttggcctccgtgagatggcacgagcgctcgtccaggtggtcggctcgccgcctcctcgcccgcgctcgccgcgccgcgtgtcgcgccaccgcctccctctcttctcacccccccccccccctccttcctctctctccgctgcctacgatataggcatcggcgagggcgaccagggggatcggaggaggaggaggcccgatggcgttgggggcggtgttccacggcgcgcagctgatgctggatctggcggtggccgggctgtcgctggtggtcgcgctcggccttttcgccgttgtcaccgccgtgctttgctccgccgccttcctccaccactccaagcccgtcgcgtcctagccacccgctgctcatcaccgccgccacaacccccctcggtgcgtatcattttgggtgataaatttgctctagcgtcgtgttcccctgacgcggacacgcattagtttaattattttgggtggaattggggggcaacaattcgctcgagcgccatgttcccctaacgtagaggcgggtactggtgcaatggaatgatctatggatgttgaactggattccctggcattttattctgtcgcgccacattagaatcttcaccgtagcatttaccagatgccagtatccttgcccttacttgtgatttactgcttggtaggtggtccgtccagtgaaacatcctggattggtattccctgaagattgtgcctacctgttgtctctttggtttgaagaatatgtgttgtcagattacgcatggtggcaaaggctatttctttaggggccttttgagctgttccgtgctgttaggtgggcatatttttgttgctcagggaaaaaaataagcaacagacgagaagtggagttgataatcagaaatctgattctcctgttagatggataatctaccgctcattaaaacgacaaaagctaggaatttcacatttggcaactttgtgtttatttaggcaactttgctatatgaaggcgtcgtgttcaaccatatgataaaggccactctattagagtattagtaaaaggggcacgaactagcaatctagcatttgccatgatattcaacattacagatttgttgtaagccctgcaaaactgtttttagttcccatacttgtctgagataattcagcaacctttttgattcaccttgtttattctcgtttgatcaagctctgccatgtagtaaatagtaatcaactaccattcccttgaaatgttgccaattcttccttttcattttcaggaatgagattgttgttggaggcatgccttctcatgcaccatatgcatagcagaaggcgcaccatttgatgccagagcttccttcagacacttaatgtagatgcaagtgtagtgaatcacacgtatcaggtgatagttcgatgcacttgtagttgtatgaatgttatgtttacttgtactattctgccgatattagctgtttgtattgtaaatttcccatttagtcaaccttggcaacttttagggttttacatctcatataccttatgtacattgttttattcttatatggaagtatggaaggttcagctccttgaggcaatagatttcatctaaaaaggtaaaaatggcacattagctgagttagagtgctttttcttatatatgatcttcacgagcattagttcagcaaaagaaaacataaacatgacctaaatacatcatgctccgctgcaactatttgtcatagtagattttggattagattagttatgatggtcaaattatccacagaaacaaaacaaatcaggttactatgttctcttttctgagtataaccgctacaaatactggaaaaactgaatccattagattgaactatccttttgtgttggtgacttgaacaattcataccttgagaaagtttatctggacaaaatgtggctttctgtatagtagttttcattcttacagataaaagacaggagcatacaattttgaaagagataatgaaagtatgtcattgaataataaccagagggcctcaaatttgctttacttatgaggtggttaacaaatggacaaaaacttggaagacaattgcgaggagccgaggaccctcacaaggc

SEQ ID NO: 8529 - DNA, 9370 bp, Oryza sativa
aagtgtttcaaggggactgcggaaaaggatggcagtgcctttaaatgggaaagatggcctatccttccaactgtattcataactttctcaaccatttctgtactctctcttgtcaccaaagccaagaagagaccatttgcttccaatacagtgttacaggtatttccatctgtagtccatgtggccttagcttctcacacctcatggtgggggactagcagaggctggagagagatagagagaaagaaagggagatagatacacacacctgcttcgttaggcaatgatttgttaggattagaaggttacaattaggctggcattgctcaaaaggcttcttgtcgccgctctgtcaatctgcctgtcatacaaaatgcttagcttgtttatgacacatttccctcggattgcaggaccaggagaacatgtcttttgtttgctttagtacgtgtgtgcagatgatgatcaactaaactcaacgccgctggattcctatgctgtatttttatttctccctgtggttccaatacaataataaccctgcagttcaagcgacgatattatattttgctgcagttgcattataaaggtgagtctcattcctgagatgttgcggttcatggagtagattaaaccggttgactctgctctttgttttgccattgcatatagcagattcttagcttgattatgtggcattcctttcctccaagtcggaggaacgaacaagcctgacttgtttctgaagatttcagtaagggctttgagacaggtgagaggccagagcttgcggtccttgtaagaaagttcttctatctagttgtttcctgtagtaccccgttttctgttgctgatgtgaattctaaacctgcttacgcggcaacatgcatcttaggtttcctttagaaaacaggaatcttaaaacaaagtaacaggaaacaaacattttaaattgataatcatacaagattagaatatcctaacatcttaaatcctatggaactacgcgctggataaatataggaatcagaagagagataggtacccatggttttcctttttctaaaaggttgaagctcatattaaaattcctccaagattcttaagttttgagccaatctaaaggaatttcataggattcttacatagctgttcctttgatctaaagaagtatgtagaaaaattttaattcctccaagaatccttggttccaaaggaatccttgaaagtgaggatcatttacccccaattgcttaaaataatttacaggctacatacacaacttgtgacaaaaaaaatccctattcccatacgaattctagatcattgtattttctttgagattcgtgcgcattgtaaccttatcctttcctcctcttcctcttatctccctgtacgcacacgagcaaggtctccaacatgccgccttcatacacagtgcgctgcctcctagccttgtcgattagctagaaggcaccaatgaggccctcctggctggtctccttcccatctcctcctctcctctttctcaagctagaggcggcgaggtgcttccgccatctccagtgattcctactcagtcactctactttgctccttccatcgacaccggtcaaccgggaacaaaaatgaaattgaaaaatggaattgtagctgaacatgctgacctattgatcaaatcgtgttctagaagtatctgcaaaaacacccatcagtcttgaacccgttcctctcaaaaccctagaaaaaaaatagttttctcttctataactcgtacattatctctttcactatcttttatacaaacccacaatcccataatctattacgtagtacaaactaaattaccggttcactcccattacgtccaaacaccacaaacccaattgcgtacagtggcggcgctaggggtatgcctgggtattccttggaatacccaagatttcagtagacaaaataaatacatattatagtacacatgtatattctattttttaattggaacagaagcccacaaacgagctagtagcagcgagcaggccaacctggccaaggcccaaacggccagaattcctactgtcggcatccattcacaagtcacgactcgcgtagtcgcgttcttgtagttcttaaaaaaaaagtcacgactgctcccgtcccaactcccaagcggcggcgccagcacatgtcgatctactgctgcggcctcagccgggctgccggctgcagcggtgggcggcggcacatctcgatctacttctgcggcggcggcggcccgcggccggcctgtgaggtggtgtccagcaggctgcagcgcatcgtcgtcacaatttcagcaggcagctaggtaaagatttctctaatttatttgtcttgctactgctgtgctgcgtgctactttgtttagtaattttctaacattctattctttgtgaattgtaatctagatgaggaagggtactaacagcatatttgcattatgggagaaagctgcaaaggcaaaaaaaaaaaaaaaaaaaaaaaacagcttccacatctacaccaaatcctcctcctgttgagattgagaacaatctgcaggtagcacttgtgcaagcacaagatgatggtgaagcacaggcacagtccgctgttgaagcaaatgatgaagcacatgcacattataacttatgatccattataatccattatattgcatacttgctttgaattttttatatgttggcatacccagccacaggatcctggctccgccactgattgcgtagaacatccccattccacgtcgtccatcatcttatgtgcctaagttagagcatgaccatccaatgacatatctcgactgactctaaccttggaaatctattgtagtttcggtccctcgtcattcaccatgatcaactcctcctagcttcacctgcacatcaaatacaaaggaaacatattttgaaaacaatttttttaacttgatccacattaaaccaaacaaaaatatcttttctcaactatttatacatatatcacatatatatttatcaattactgacaagtgtttgctcaacattcaaccaattatcattttatcccttataatttggtattttcgttggtccaaagtattccccagtagtaaaaccgtctaccactgtcttttttctcttttttcgcaatcgtttttggctacttgaaaatttaaggtgtggaaagctaattatacaaaaggctcttcatctatatacataattcctgcttgttgtttctccatggcaaaatatagggcacaactatactttttttttggatgtttcataatacaagatgcgcattaactagcacccccctcctaaattcattgtttctaaaattcccaagatctctaattctattgattacatactttgaatttattagggcgacccaaataaagaggtgacagtaatttttccttgatctttatgttaggagtattttggaatagagggagtactttattttgcctagattgctcatcttaaagatcttaaaagcaacataagcaagtaatttttggttcttaacaatatggcactctggtgctcctagcaacatggcagatttggaaacagataaaccagagagtgtttcagcacgtagaactctcaactttatcactttctgcgaagataaaggaggcggccgagacctggactgccaaaacgaatagacttgcttagatcatcccttagttttatttctcttatagctttgtacattttttctcatgctatatttaatgaaatgagcacacccttacaccgattcgttaaaaaaaaacaatacaacacggcataaaaaaaaatacaacactgcatggtatgcaccggacaactcgaccgaagaagcagtggagtgtttgttgttgggcaggaactcaaacaacttccctgcggacattttttccacccagactgcaccaaacttccctgcggacattttccacccgaactgcatcaggaagcgtctgttgctgaagaaagaaacagtgcccgaagtgtaacggtgaagtttagtagaccgcctattaaaacaattataatttttactcttttatgtatttctttttaataatgttgtgtgggaatattaataacatttgagccaactggcatatttatttttcctgtcagaattttttttctatgaaatatcatgttggaacatgagtttgtgggaagacatatatgttgttctgcctcttatattagggcaacctcaatgttgggttgctgaatgagcaataggggtgggcccatgtgcagatagctttagctatatctatctctacaatggttatggccttggatgagaaacaagccgggtcccactgggtcccatcaaagaagaaacataccaccaattcgcaaccatttgctgataggctccattagatatcattttttaatctcttaagttcaactgtaagcttagagctgtttttaagcatttaatgccttatgtccatgtccacaatgtatatagctgaaaaaaagtcttaaggctcactcttatggtcacattgtggatgcccttaagggcagctaactttcttagcattatttaggctgtcttcaaagaaatcttcctttgcagtacttaggtctttttcagaggtaatttgagccctgttagaccaagtttcatgggatgtatatctgcacttttggttcatattttagcggggtgtcggggtgacatctttttggatatcaagcaccatgtttatagtataatgaattttgatgctgataatgctatggtgtaagcaacatgggccaatctaggggagatatttaactagggaaaattgcaaccatgccattataattttgcaaaatttgagatataccatcctgacccacatgtcattgactcatgtgagttctacatgtcattgagataccgatggtatatctcaaactttgaaaaattataatggcatggttccaaattacccatttaactattagcaaaattgattatatagcatcaaaagttcacgtatataaccaattttgccttaactatttgccgcaagaagtgatcataagtgaagaactgatcagcgttacgcgactgaaaccaaagctgaacccagtaaattcagataaattctgcaagaaaaacgtcactagtaggcagtagcaatgctctcactggaatccatcttggtcatgcacgcgtagcgccgcagcttctcgttgaacagcacgagggggtccttctccctgagatcgccgtcgccgccgtacgcgtccctgaggaacacggcccagttcatctccgtgccggcgaggtagaaggcgcggctctgcttccgcagcgacgcgtgcatgtgccgcgtgaggccgagctcctccttgaactcgaagatgtggtggatcagcgcgcgcttctccagcgtcaggctgaggaactcgtgcaccacgccgacgcggtacttctccgcctccggcgtccacggcctcagcagcgcgccgctggtgtacggcgagaccagcgggaacgtggtcgccgcgtccaggcggtcggcgtcctccgcgtccagcggcatcgaccggctgtgcgggacggcgaagcggaacgtgcgccggacccggcgctcgtccaccacgaagtcgcgctccagcgcgctcacggcgagggccgggtcccaccgcgccagctcgaggacgtcgcggccgtcggggtcgacggcgacgcggaagtcgccggggaactcgcggacgcggtcccggaagtcgtccggtaggccgagcaccgcgcggcagtggtggagcttcgcgagcgggatgcggcggtggtcggcgagcatcaggagcttccggacggcccgcaccctcgtcgggaggagctggtcgtgcaggcggcgctcctcctccaggagcgagcacatgagcggcgtgagcgcgaggtgcgggacggagtccaccctggggaggtggaagagcagcgggtggcgcgcggcggcgcgggacacgctgcggccgcgggggaacccgagctcgcggtacagcttcccggcctccgcgagggggatccggtgcggcggcgggagggaggccaggaacgacctcgcgcgggcgaggaaccggaaggcggcttcgcggtcgaggacggcgtcgagctccggcacgcggcgcgcggcctccggctcgatcggcgcgacgcgcgggctgctcagcttcttccggagcttcctccgccgcttgcagggcagcagcggcaggagcgaggccgccgcggccgccgccgccgcagaagaagaaggagacggagatggaacggctcggagtagcgctctcgtggcggagaagaggcggcgcgccatcggcggcggcggcgccgtggtggaacgaacctgaggcgagttcagtctatttcgatcaaccccacgcacgaatattaaagcgacagtaaccgttggatctgaaagcctagtagcgttcggcgttagcgtagagcacaccacatcacactcccctcccctctctctctctcgtctcctccctctgaatccatctgtaaatctgttcctctcccacgcgccccgcccccaaatcccccgcgcgccgcgcgccgccgccgacgccgccgtccgccgccatggggacggaggtggccccgatggtggacatgcgggcgctgtcccagtcggatctcgtggcgctggcggcggggtcgccctactccgccgacccccgccgcggccgcgacgccgacgtcctcccgccaccgaagatcgatcgcgccgtcttcaatgagagcgccggctcccgtaagcagaccttctcccgccaccgcgtcgccaccaacctctcccacagcctgaccccggccaccgcttccgccgccgccgcccccgcccccgcccccgccgacgaggactccgagaaccgcctcatcgcgttccacctccagcgcctcttcgcgggcgaggacccctcattcgcatccccgccccagattgcaccgcaaccccagccgcaaaccctaatcacgcccgcgattgccgctgccgtgacccccgcgccctccctgccgacgccgcctccctcgaacgccgacatggaggtgatgaatccgaatggggtggcggtcgatctggcgaggctcgcggagctggtggatccctacgaagaggagatgcggaggcggacggcgggattaggggcagaatccgagctattaggtttcatgaatgggcttgagggtcagtgggggagccgaaggcggcggaggaaattcgtggatgcctctatgtttggtgaccacctgccccgtgggtggaagctgctacttggcctcaagcggaaggagcgtgttgcttggatcaattgccggcgttatgtcaggtttgttcatgttgtgtatagcttgtttcggtagtggtgaacatcagttgttaagtgtcttttgtatgcattgatgatttgggttttgtgtttgaagtgtgaaatgcaatgtgcttgtcacaatcgtttttgctgtctatgatctccttttaaagcttagtttgtaaagtgagcctcatgatagcaacattaagctgatcttagaaacataggaaccacaacaatgggtatttgaatgtgtcgtaatccaactatttgagtttttctttttcttccttgtttttggctttgttttcttccttccctggcgtaggccggtctggccgattgcattgtgtaacaaacactctattcctctaatatattgacgtgcaatccttttgcgcattcgcaaaaaaaaaagatggtgggcacagcatctggacagtgttgcaagatactttgtatccagatttaccttgtctgtggtagtaactagtacgtgcatagacagtgagcatatatttcttctaatcaatagttagttgatcatgtttccttccccacacccatccacccacctacgctgttatatccagttgtcatttctacggttcagtaactaaaacataatcaagtgctcgccttaatatggctgcctctattaaccgtcatgcctgaaacatgtatgatgattcataagtttaactttgtttaaagtaaggattcaacggcattgatctgtttgatagttcgagcattctcgtcatgctcatttgttggacattctttctttgcaaagatatattcttactcatcatgctctacataataggtatatttgctctctagaaaaaaaaacgtactatacatatttcgttattaatcattacattttcagacatgttgatttctagtcactgaatgaagaggctaccttgtattagtaaatgtctgttaggacagtgcaacttcttaatattgtcttcatagtatttattttgaacttggtgccatgttcttcataatatgtgaatatctgctggacttggaagttggatctcatttattggaagattgtgtgtttcatatttttgctcactaccattatttgctctagctaattgtccatgatgtacttgccagccccagcggacatcagtttgctacttgcaaagaagtttctacctatcttatgtctcttcttggatatgtggaggcaaagccaactgccattcagagcagcgatgcagaagtgcttgaattaaacgctgttaatgtaagtccttttagtgcaccttatatgcacaactacctttcatggtttgactaactaaaatgttcaattagtctgtaggccattgccagcctaattcaactgaggaaaagcagagtgcgcctccagttacatctgtgcctttctccagtcaccatggtgatcctcagaggcaacttgataagaatgaaactcaggtggaagcaaatggaaaagagtgccaaaagtgcaatttgacttttcaggaccagagtgcctatgtgcaacatcagttgtcctttcaccaaaggaaggctaaaaggcgcaaggttaataagtctggtgaagtgggagccaacaaaaatgtaacaattgtgactcaagaatgtcacataacttctgaagataaactgggcaatattgaccatagtttagccaccacaaaatctcaaggtcaaacaccagaaaaaatgcctgacgagaccatttcaggagagttaggtggtcgaccatccatggcaccagagccagttggttttcaagagacgaatggcttaactgaacagggaaaagaatcttctgctggtgaacttctctctggacattgtgatcctcttcacaatatggctggtgtacctgagaaggaaaaaggatttggtggagaacctgtccctgggaatcacgaggaccccattgaccatttcagggacccccaaaacccatgatggagcatgtcataatgctg

SEQ ID NO: 8530 - DNA, 6544 bp, Oryza sativa
cccgttcaatctagtagagctgtttgtactacttgagttatcgacactgcaatctactgcaatctactcaagcaattgcctaaaattgctcccgttcaatggcatttatttgaattctgactaataatcgttgagttatgtgggttcattggacacatttgaaggaacaagaatggcagttattttcttgatagctgaaaacatgtaaagtttaagatcacataatgtatgttcatgcaactattgcagtagatgaactaatgctatttattactaaaattttattgtaggatccctagatgactctttaatttaattgtttcacttcaattatatgattgcacgctggaatcagacatgctaatttgattgtctttcaacagtgtgatttgcagcttggatttggtgttcagaaaccacagatgtatcctaccttcgaggagcagctgaggatggcctcagctggagctccacagtttgggactatgaacaggcataatcatgtacctgtacccgaaccaacactgatgttaggttatgcgccgcacattggcagctgccctcctgtccagttaggatgggacatgtccatgtcaaagatggttggcgggtgtgtgctccagtcgtccatgtgtgtatggtgcaacactcagttccagcattttggcaccgttgccgatcagcaggctgattcacttggcttcatctgtccggcgtgcaaggagaaaatctctggtcatcttagcatgctcaacaacagttcatcacagctttagcattcagtttcggtcgctcatttgatcttgcagcccgatctggcactgaaagcgattgttctcccgtttatccagaacaactaacttgtccacctctaggttctagataccctgcctcaaaattgcacggttatttatgtaggaattgttatgtatgtatccgtttgactttatgcaatgcatgaactcttcgagaaataacacttttaacactacaaacgtttaacatgttaaacaatggttatcgtaccattggttttcatatccgagcaatttatgaacacgaatgtaagtgtagaaagaactcctttccatttggtgtttgttttcaaacttcagcaagatcaggcctacagttgcaagagaacctgatctgattcccttttctttcattctgcttgatagtgccagatgttttgccaacatgcatcagacaactgagacaaactgttcatgaggcatccattgtgaatcacaaattaattgtggatttccaataaatgcctgatatactagtacaagcattttctgtattacaagtgtttgattagtaagggtctgtttggcactgctccagctcctcctggagttcagccaaacagtttcagctccactaaaactgggagtggagttgggtggagctctattacaaaatgtactagagttgtgaagctggatttaagcagctctataactccactccagacttaactcctggagttatatttaggagacttaactcctgaagttatatttaggagttggagcggtaccaaacagtcactaatactccaaaactagattacttgaatttaaatctaatgtctcagacgtatggtttcttctcaaccacagtggaatcgaggcatcctttattcttcccttaaatccatcttatgctactgatgaccagaaggacacacgttcgcttgccttcaagccatcctgattttgatcttagaccctgcaaatgagcacagcttatcgtgaataaatctgataagaaaaaatcatcctaaaatgaaaatgaggcgtaaaattaagttacagtctataactatgatgatcacgtactcgtggtattcgacgaggatcttgccggcgtcggggttggcgatggcggcgaaggcctcctgcgagaggtcgatggtgccacggcaccccgcggggcagtagtcgacgatcttgacggtgacgctccggccggtgcacggctgcggcaccccctggttcgtcgcgccggtgcaggtcaccgccagccgcttcccgcacgccgcgccgccgttccagaacacgtcgctcgccgccgcggtcatcgtcccctgctcctggaacccgaagcacgccgacgctgcacgcatgcacggccagccaaaatgttataagctcgcacgataattaaagctactgaattacagacaaatgttatacacgcggtttaatcagtagtaaaaaaatatatatctctctgaagaatgaaatgcaactggacagtggacacatgccctcccttctgagaaagaaaaaaaatatatctactatatatctatgcagcattgcgtgttttcgtttacaggttggagaaattttagtttcagaggagtattaaggatcgataagaagctcaacgtgtgtaaggaggcgtgtagaaagtcgcagtccctgaactccctgcgaccagcgagaccatggcaaggctcactacaatcgccacaacaactgagcctatcttaggcgccataacactagcgatcggctactaactaatcacccttgcacaaatgatcagtgttaagcccgtgcagaagatggatttgtgcaagaggtgtagtagtgaatgttacactggttaagccacattatataggcgagagattttactgtgtgcacttggaagttacttccacgatgtaccagcatataccacattctattaaggtgccaccgtacaaaccatctgtcactattactgaagattgctatcgctattgcagtttcttagcatcgagattaactaaccatcattcgtcagtccgcccccatctcattcatccagaggatgatctcacacgagcatgacatgaacgacagaggtgtacatagatagtgtaaacacacttgggacagggcacatcaccagctaagcacatgcaagatttggtaggttgtcctattggttcatactaaaatgcaacaggataggacagagaaaacgtccaagatgctactcctaatatccacactctgctctaggttgatgacagatgttagtaacttggtcgtcgttgtgagttgtactactggatttctcaggatcccagtactgttgtttgcttgacaagtagagtaaaatactaatctcaacattctagtggtacaaggtagcaagcatgcacacaatgtttatcagttctcttctcatcatggagaaattctatgcgttgctctgctctgcatgccccacgattgtgacgttatggccgggctttgcagcgattaaccgtgtagaaattgcaagttgcacgtccttggatattgccggtttggcttctgcggcagaaacgtgcaagagctgacgccgcgggatgctgatcatatcgcgcagccggccggctcggcgaaagttaagttcacattgttttgtgccaatgcggcaatgctgacaggaaagatcccacttggacacttggttattaactttgtcctaactagtgatcatcaaagcgtgcatgggctcatacaactagattatagtttatttacaagtagagttgcattttaatttaataggcaaacattgcttctatttcttatacaactattttttaactagctagcaaaatacctgtgtgttgcaacgagctctaattatattagatgagctaattaaactaaatcatcactctcaagttttgattaacgatgataggataaaacagtgtgttgtacagtgtacatgaagcaaatagagtttctcacttgaatacattattggtcaacaatgataggcccataagatagatggtggcctctacttgtcagatagacgggggtagcagaatcacggatagagtatatagtaaatcgaaggtcttcgcggaagccaacgctgtgcgacccgccctcgcgcacagcgcattgctccgcgtgagcgtgaccccgcgcgatatggttcgagtcgcctacgcgtacgcgatccagagttcccctcgcccgcccggcgcaagtcgcaccgcgcgtacgcgatcccagccgtatacccctgggcggggcctgcggagtttacgcacgcgtgcatgggcgcatctggcatccgcgcacatacggctgcacgtacgcgcggatcaggccagcgcgcgccgcgctatcgcacgtttgcacggggctataggcctccacgcgccctccgtacgtgcgcagagcgcgtcgacaagtacgtactcgtgtttacgccgaggcgccaacactactacaaaaatcgtttttctgtacgagggggtcggtaggttccatgcgggccgcttgtggcggcgcctgcaaaaaccgcccccccgggggcgggttgattagccgcatgcgaagatccattatcgcatacggctgcttaagacacccgcatgcaataataggtctatcttcgcatgcggctggcttaagggaccgcatgcgatgatcggccatatatgctcctccaggcccgagcttgaccatttgaaaacgaagctttctctctcctaaagcaagcaccaattaggggggaggttttcaactcgaaatttttacttgaactctatacgaaaggtgaagaactctctatcatgcttcatttggctccatttttgttatatttcgttggtggaaagtggagtttttttaatattttgacaaggtttgttctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtatcatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgatatggcatcaagagagccgaaaaatagatggtatgattcgacatcccgtcgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcaaaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccataagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactacgtcgcctttca

SEQ ID NO: 8531 - DNA, 1301 bp, Oryza sativa
gcatggaaagatatttttccatgcggtcccttaagccgcccgcatgcgatgatctgcgcctatatatagggagcgcggggagccaaaattttttaagtcccggctcccgcgaaaccctagctgcaaggctgccaaaatttcccaagtcgcggtcgccgtcgtccccgccaccgccggctcctccccaaagtcgccccgccccacgccgccgccgccgccgccgtcaggacctctcccccctcgccgttgccgtcgccgccgccaggacctctcccccctcgccgtcgccgtcgccgccgccaggtcgccgtcgccaccgcacggaactctcccccctcgccgttgccatcgccgccgccaggtcgtccccgccaccaagtcgtccccgctaccgccggctcctccccgaagtcgccccgcccctcgccgtcgccgacgccactgccaggacctctcccccctcgccgtcgccgtcgccgccgccaggtcgccatcgccgccgcacggacctctcccccctcgccgttgccatcgccgccgccaggtcgtccccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaagttgagacttatgttatattgggatttatgtataattgtgatgtttgtttgtagcgcccgttccgtcgtggcgcctagcgggaaaattatctccgaaaaatcctaattgcgaaatttgtttctttgattgttgtctagtgtccgtgccatctcaagatctcaattcccgatctatcatcgagttcaattccgaatccaattccttccaaatcgaatccctccgcaaaagtctagtttgcctcccccgggttcgatgggccgaattccgctcggcccatctcttccccggccctctctctcccgggcgctctctctctctctctctctctccccctctccccggccctctcccctccccggcgtgctccgctctccctccccccgctcagctccgctccgcctcgcccgcgcgccgcgcgcgcgtgcgc

SEQ ID NO: 8532 - DNA, 4823 bp, Oryza sativa
gccgcccgttgcaaaccgcgcgcgcgtgctgagtggcctaccgcccggtcgccgccgccgtcagcctatgcacgcgtatgtcgcccgtgtagtcgcgccggtccaaaccgccccgcggtcatcgccgtcgtcatcgcccggcccccgccactccgcgcgctagcctccaaggggcggaggcagagagcccctctccctctgccgagtcgccccgctccctcccccttttcccgaatcggcaaaagggcaagccccttttctctcccttctttttccccttttcctcccgccgacgtcatcctcccttcctcctgtcgccgttttggccgctagccggagcgccagctcgcgccttgaccgccaaagtcggtttccaaaccgacattgccgccccctataaacccaggcgccctcccttcccttttctcccattcttccctgtttctcgcccgcgccattgccgtccctctcgccgaccgcagccatcgcgtgtgtgccggaggagccggtgcgcactaggacgcggaaggggactccgggcgctcgtcttcctcctcttccccggcccgaggccggagagatcactcccgcgccgtcggcctctcgtcactgcgccccgtcccgcacggtagtgtctctctccgttcttcctcctcgctccatctcctcccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgttggctcgcctccccttgtcacgtgcaaccgcccggtgtgctcgctgttgcccgtatcgccgtggttcgctccgccgctcgccgccgccgcccgccgtccattcgcggccgggtcgtcgtctacctcccgccggcccgcgtggcagccacgtaggcgccacgtcggcgccaacttagccagaccgggtcgggccgaccccggtcggtccctccgcgtgcgcgcgatccaccgcgagccgtgaggctgcgcgtgggcccgccgcacctgcgtccaccgtggaccgcgcgcatgcaccgcgtcccttccccgcccgcgcgcgtgcgtcgcgtgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccccaaatctcgagatctatctaatggcgcttagaggtctttaatagggctttattttcgccgtttgttgagttgttccgtttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgatagatcgcacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgtcttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtatcgactttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttaaaaagttgttggcccgggtggccgtttaaaaagctgttggccgggtgccaaccttgttgcaatcctaaagattgacacattgcacatactccgaccggacgagacgcactgtctcatccgtgtcgtttgagaagcactcacttagttgttttcagaaaagagttcaaataaaatcaattgcaaaaactacagccttcccttgaagcctgcattaaacacttatttcccctggcttgctgagtacccccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgtttggcccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggctaaattggagcgtctcgggctagttccggtcgggactagttcggggcgtgacattgttaaactgagatttatgtataattgggacttttgttaaattggcacctatgtcaaatggagatttctgtttaattgtgactgatgctaaattgggacatatgttaaattgtgacttatgtgaaattaagttattgggacttatgtgaaaataagttaaattgtgacctatgttaatttgagatttatgtataattgggacttatgttaaattgagatttatgtataattgggacttatgttaaattgagatttatgtataattgggacttatgttaaattgggacttatgtcaaattgagacttatgtgaaattgcgtaaaattgggacttacgtaaaattgggacttatgtcaaatttttttacgtcaagttggaagatgtcgaacgaaaaggttccatcgaacgcaccaatagcgcctcaagaaggtaacgctcctcaaaatttcggtagcaataagcagccagacgcttctagtgaataaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccgtcgagccaccgatagtgcggttcaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaatagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagact

SEQ ID NO: 8533 - DNA, 5052 bp, Oryza sativa
cacatcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtaaagaccactacatattattccttgtatatccgaaagaccaattgattatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgtcgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatacttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgcaagccgagcaggcaaacctcggttgggtcgtagccgccgccgtttagtttctaggcgagtcgactccacgaagacaaaggccgcgcgcgcgagagtcgtcgtacgtcatggacaaacggttttcagtcctcttcatgttcacaatcacgtgacaaattcttccatagtatgggtaaggagtatgtttctttctcaaccacaaggtaactttatagatcaggagagacattttttcactctctcccagttacaatctgttatttttggtacgtactaattaattaattaaccataattatggaacacacaagttcgctccaatccaagctagcttgcccttattttaatttggagatgcactttattatatatagtgacacacgtgcggtcttcatcacctcaaccgtagaattattacaccctgcaaaccacacacacatcgatcgaacaaattaattaggaacagcattattcagtcgtcgtctgatacttatataacagcagcagagagaaacaaattagaggatttatatagagaagttgatgagtgacgtactgttggtagtcgatgaagaccttgccggcgtcggggttggcgatgatggcgaaggcctcctgcgagaggtcgatggtgcccgcgcagccggaggggcagtggtcgacgatcttcacggtgacgctctgcccggtgcacggctgcggcacgccctggttggtcgggcccgtgcacgtcaccacgtactgctgcccgcacgccgccccgccgttccagaacacgtcgctcgccgccgcgatcatcgtcccctggtcctcgaacccgtagcacgccgacgctgcatatatacattgatttaacacacatctctcttatcaattttacttcacgtatggatgatcgacgaatgaaatatgtagaaaatttactgtacgtacgagtgtaagggggcgtgtagaaggtcgcagtgccagagtccgcagcgaccagcgacaccattgcaagcgctaccacggctgcaatgacaaccgaagtgatcaccttagccatcgtcgtcatcgcgatcaattcgatcgatcaggtgtaatctctgggagtctgaaagatatattaattcttgcaggagagatgcagcgaactgaagctgacttgcagggttcagtttgcaccggccgttttatagacaaaggttgcgtaggaaaacacgcaatggcgggccgtgtttccaacgtcgccgctgcatgtacagggcgcaaacctgagatatcttccaatacggacgcacgctagggaactccaaaccaagaagatccacaaaaaacacacattgacacgagaatcgatcataattactcgatatcttctcgcttgttcgtggaccgattgcacgcagtttactgttgcctgtggaatactcctggaagtccgcgaatacgaccggcgaccggtgctatacgcgcgcgcgcggctcacctcgtgttgaagcttgcacatgaacgtccttgtagtgtgtcaccgcacgctagctagttctccgcgaaactaacacggcgcagcctgctcagttgtctgacgcgcgcggcccggcggcgagagaggagacagccaccgaacggtgatatgattaccaactggggccaagtgcccggccgtccgttcgatcgactgtgtgtttggcgccgccgtacgtagaaatcgatcgcgcgcgcggctctccgagtccgaggtccaaaggcagccgcgatgcgagcgtgtgctgcacgacacggccgctcgaggctgctgcacggacgggccgtaggtcttcagcgcgcgcggccggaaggcttcgctgctatgagtaggccacgtcacgtacagagcggtctgaaagcctagcaaagctgcaagggacgacgggacgacgagtggtggtattgaatgggaatatccagtttgattcgttcaaatataagtccaatctggttcaaattctttacatatttttaacctagctccaactattaaaatcggtacaaaataactcccttggtggtatttagggtggttttaattaaggctgtgaactcacctcccgcgtacgtaaaacggagcgacaaatatctatctaataaggactaatatttatccacggggataaatatgtacattcaaggtctttgtaatctatctctcaatcaatacatctcttggcatatcaccaccctcttttccaaggtttttatcactggcggaacttagcacttgacgcagggttgcatcgtttcgatctccagcgaaggggtaagtcctaagttatgttggccctgataattgtataggctatatgacattgttcaagactgcgtctcttcgatctcttcgattgttctgatttggttggtatatttgtctacatgatatttcaattctatgtttaattgcattgtgtttaaagatacatcggtttagctgggactatctcggttaggtccgatcttatgtcttagcagatatatctttacaatcataatgatgttttaaatagattttttatattcatcactttaatatgatttatcgactttactagtttattaggtttatttgttgatgtaaacttatgcatcggtttggtccgacctattagttaggtttactgttgattaatagatctaatctagctagcctggtaactcacgtatattgttttatcggaatgctagcagataagttatctttacatcgatcttccaaccgatgtattctttaaccatcgagcctacgtttaatattttgtttcaatattgtccgattggttcattggacatctacttcatcatattatcatcggtcgattggattgtttattcaagttcttccattatttttatctacatgtcagaatctacatcgaatatatagccgattaaccctattgacatgggctaatatcgctacatcggcttattgacccatggactctttgattattagtttatctatcttgtcaattgcagaatcaaactgactggtacgtgcatacctc

SEQ ID NO: 8534 - DNA, 1463 bp, Oryza sativa
gcatctcgaatagcctctccatctcacttctccaagtcaaagtttagcaactttgaacaaaactcgcactccaatagcctccccatcccactctccaaaccatttagatggccaaactccttccctcactagccaaacttgggcccaacctactccacttgccattcgttttccatccgcgggacctaccaccttccattcacttttcctctgttcgggagcaacgtggccgagggggagagccgatggtcgagccgcattggtggcctccgcgccggtggtcaaggcggtgccaagatctctggaagcggtggcaccttgcagtacaagctggtgaagaagcaactccgccacggaccactggtgttgtcctttggcccagcatcgccgtcgcccttgccaacgtgagcaagaaggcccacaccacccgtccacctgaatcctcaccgctgcctccatgcgatctccgtccctacgtggatttgaccgacggcgtggattcgggagttgcgcggtctccgccttcattcgacgggtcgtcgtcgaggtcgttgtagcgagccgccgctgtcgtcgtcagcctctgcacggtcgccgtcgcacgagaagaggaccgagagaagaggaagagggagagaaagaggaggaagaaagtgtagtagaggctggcatgtggattccagtgtcaaaggcttataatggagagtgtagatagagactgttggagtgagaaatgagtttggcttgactaatcaattggagagctgactatataggtgtttggagagactgttggagatgctcttagttggtgggtcaaacaagcaggacatatctgatttaatcgggcctgcaattggcccattattattgatgggtcaacatgactatttgatagtacaatatatatcctagatttatgagctgttataatggaatatatgtaactttgtgtcactaagaaggaagagcaagcgttatggatgtagcatcttcaactgattcaaagtaactacgaattttttaaagtttcatgagcttggtacgtgtcgagaggtcgatacttgagtacaatgattgtccgtgcgtagagaggcatgaaaaaattgttgaagcgttcctacctccaaagaggccgctgtacgtgtttatatagcaaaaacaggaagagtacagatcagattacaatccgagtctgaataagttctttacttctatctaccgcaccaacctatagcaggagtacatgactctatctctgaaacagtcagacaagaaccaaactaagactcgacaacaagtctgaaaattatctctatgtttaacactccccctcaatcataacttacacaagttaagattgtttctgaaattattcaacttgttcaatgactgggctttggtaaaaccatcagcaagctgatcatttgatgaaataaaccgaatctctagtgatttctcag

SEQ ID NO: 8535 - DNA, 11133 bp, Oryza sativa
tacacggccagaggaaatatcgaggcacttgtatcctttgtgttgattactatagccaaaaaaagcacaacgtttagaacggaattgaagcttatgtgcattgtatggtctaagattaggccaacaagcacaaccaaatactcgtaggaagtgatagtcaggtttatggccaaaaagaagttccaaaggagtagaaaaattgataactctactaggaacacgattgatcaaatatgtggctgtgagaaaagcttcatcccaaaatttaagaggcatagaagcatgagcaagaagagacaaccctacttcaacaatatgtctatgtttacgttcagcagagccatttttttgatgtgtatgaggacatgagatatgatgagcaatgccaatcttctgaaagaaggaattaagcttctaatattcaccaccccaatatgtctgcatagacagaatcttcctattaaactgtcgttctacaagatgttggaaatttgtgaagactgagaaaacatcagacttattcttgagaagatagatccaagtaaatttactaaaatcatcaataaagcttacataatacttgaatctccctactgattgaggtgcaggaccccaaacatctgagaacactagatctaaaggagcagatgaccgactagtagatttaggaaaaggtaattgatgactcttagcttgttgacaagcatcacacaccacatctctatgaggctcactaacagtaacattgttttctctaagaattttgctgacaatattaaaagaaggatgacctaaacgactatgccatctagactctgaagaatttgtagttgcaagaacttgacgtgtttgacgagcatctattttctcaggaagaggatagagacgtcctcgagctctaccttgaagaagtgttgtcttcgtgacctgatccttgatatgaaagaaatcacgatgaatttcaacaaaagcatgattatcagaggcaagacgatgagcagagatcaaattctttttttgctttggggacatataaaactttattaagataaagatcacgagtaggggtatgaataatagtttttccaatgtgacttatgctcatacctgtgccatttgctgcatgaacttgatcactaccatgatatttctccttcgttgtcagcttatcaagttctgaagttatgtgatcagtggcagccgtgtcgacgtaccaatttgtgtcaacaccatatgatgatgccatagcagaagaggctgacctctgaacttgtctttcatctcctctgtaagatcgatcaaatctcttccaacaagattgaacagtgtgtccaatcttgctgcacaattggcacacaggacgtgtatcttcgccaccaccatgacctcgtccaccacggccgcgaacaaaaccaccacgcccatggccacgattctgatagcctcctcgtgaggcagtatttgcagaagattgatagcctccatcagcttggagcttgagatgtgcctcgaacgagagtagttgtgcatatagatcactcaatgacacataatctttagcagaaactgatgcgacaagaggattataatctgcatctagccctgcaaggatatatgagatgacatcgtcatcatctagcttcttcccggccgccgccatctcgtcggccaagctcttcatcttggtgaagtatacagcagccgaagaatctcctttctgctctcttgctagctgcgaacggatctgaataatccgttcccttgattgcgaggagtacatctccccgattgcagtccatacctccctggcactatctagatgtgccacttgaacaagcacctctcgtgtgagagatgagaggagatatcccaggacttgttgatcttgagcaatccaccgagaatacgccggattgtcgatcatctccttcacgatcttgtcatcgactttcttgacgacgctgatcatcggtgacggcacctcctttgtatcgtccaagaaaccagtgagttgtaccccacgcacagccggcaaaacttgcgcacgccataccaaataattgtctctggtcagcttttctgagacaggatgacccaacacgctcgaaaacgatgaggaactcgacgacgccatggctagatgaactatgtggaagggaatggctctgataccatgaaaaaattgttgtagcgttcctacctccaaagagaccgctgtacgtgtttatatagcaaaaacaggaagagtacaaatcagattacaatccgagtctgaataagttctttacttctatctacagcaccaacctatagcaggagtacatgactctatatctctgaaacagagtcagacaagaaccaaactaagactcgacaacaagtctgaaactatctctatgtttaacaaggcatatgtggtacgaagatacgtacgaaatcacgcagcacacatcacattaatttagatctttgttattctttcatgttcgtttaccgatttaaattgcggggccggttttataacatcgaagaccccgtgttcgtaggccgtgtgacgatgtacgttgttgtcagtccttttcagtgttcaaacaaatataatccacaggacaaattcgttcatatatactatattattatgtttcttcttttcgctctctcatacaatctgttttattggcaccaaccggaattcagctggaacactgaacacacacgttcgcttcctgtctcgtttggagaagcactgcactttattgactatatactccgtagatatgcatgtattgtcttcaccttacaccctgcaaaccacaaacacattggtcgaacgaatgatcagccgacatgcattctatcatcttctgatagtagtaccagataaaaattgaaaaatagaagtggatcgatgagattgagaatttgagatgcatgtatgcgagtatatatgtaacgtactggcggtagtcgatcttgatcttgccggcgtcggggttggcgatgatggcgaaggcctcctgggagaggtcgatggtgccctggcagccggaggggcagtggtcgacgatcttcacggtgacgctccggccggtgcacggccgcggcaccccctggttggtggcgcccgtgcacgtcaccacgtaccgcttcccgcacgccgccccgccgttccagaacacgtcgctcgccgccgcgatcatcgtcccctgctcctggaacccgaagcacgccgatgctgcacgcacgcacgcatttcacacacatctccacttttacttcacgtacgtgtacccagtggatgcatggtggagagagaagaaaaaatactgaacatacgcgtgtaaggaggcgtgtagaaagtcgcagtgccagagatgccagcgaccagagacaccatcgccaggcctaccacggctgccataacaaccgaagtcaccttaggcatcgtcgtcgtcatcgtaatcaattcagggtgtatctggaaactggagtacaagatcagagtgtctaaaagattagttctgcaggagggttgcatggtttagtgtgcaccggccgttttatagccaaaatcagaaggtcgatcgggtagaaaaacacgcaagggtgggtcgtgttttcaacgtttgcgtctgcatgtactgatgtacatggcgcgaagatgcgatatcttccaatgcgaagagaagacaggcgatgtactgttgcccgtggagaaaaatatgtgagatagcaaatacgaccggttgctacgcgtgactcaccacctctcgtcttgaagctttgcacgtcgttgtagtgtgtcactgcacgcttctcctcgaaacacggcgcagccggctcggttgtccgatgcgtgcggcggcgagagagagcaggcagccacgatgattaccaactgcaaactggggcgtagaatcgagcgcgcgcgcgcgcggctctccgaggtccaaggcaagccgcgacgcgagcgtgtgccgcatgacttgcaatcttgcacgagctacggcccggctgcttggagtgctggaggcttcgtcgatgggccggaggccttcgccgcggcgcgcgcaaaggctctcaaaagtccaagaaggccgatcaatgacagcgcgccgtcggacggactggatgtcttcgcagctacgagcgggccgggtcaccgcacggtctgaaaagcccaggaaacctgcaaacgagcgccgaaggaataagatcactttgactccctcaactgacaactgaatctaaattgtatccctcaactgtaatactagaaattttaacctctaaacttaaaaaaccggtgcaatttgactcccttagtggttttggagggcggttttgctgacgtggcgcacacatggcagtgttgatttactctttgtcccacgtggcattgacgtagggtttatgtggcattaaaataaaaaaaatatgcgggcccatttgtcattaaaaaaaagtgtagggtccactgacatgtaggccccacatgtcatattctctctcactacccttcttcttcctcctctctcctctctccactaacatgtattttcatccatctcatctgcatttgcatctgtttctccctctcactcttgcttcgtgttcgtcctcgtttggtctctgtttcttctcgatttggtttttctgctatggagcccatgaagcagcgagcagcagagctcctctagctcagcccctaacaacctaaactcctgaagaaggcacttacgtctgcgccgagcgtccatctgtacacacgttctttgttgacgatttctttgcctgttgctgaattgagcatcttgaggatgttgttgattcggtaggggtggagatggatgaggagtttgcagatgggtgggggcgtcaagccggagttgtcgggggcggagacggacgagcggctgacgggtgactgcaaacataagggcggcgcaaggaaggtggttcatggcgagcggggacgccacgggcacacatgcgctggtccttccttggctcgacggcgagcgcctcggcgtcgtctgtctccggcaccaccgggagcagcagtacggtgtacgggggaagcccacggcggctgcctcctcctcggccatcttcccattggtgaagcccacggcggcggcggcgtttctcggcctcgaggcagcagcgcgaagcgagtggtctccggcgacgccttccaccgagccattaccatctccacccgtcgtggccgattcggagttttggatctgggctggtggagcttggtgctacgccgcggagtcaccatgccctcctgagctcctcatgcatggctgcgcgacgccgtcgacggcgccaccaccatcgtggtccaccgcgacaagccaccgccgccgccgccgctcctgcacccgcttgccgcacacggccgaagaggtcaccagtgacggtcggtggcacagcggcggcggccatggcgtggctgcccgccctcccgcccgccgctgccgctccgtccatcggccaccgtcgccgccgccgatccggacgccgctccccacgtaggaagagaaaaagggagagatagagaagggaggagagtgaggaggaagaagggataagagaggatgacatatgggagctacatgttagtgggtcgcacacttttttttttttgtgaatgataaatggacccgcatatatttttttattttaatgccacctaagcgctacgtcaatgccacgtaggacaaagactaagtcaacactgccacgtgtgcgccatgtcagcgaaaccgccctccaaaaccaccaagagagtcaaattacaccggttttacaagttcgggggtcaagatttctggtattgcggttgagggataagatttagattcggttgtcagttgagggagtcaaagtgatcttattccagcgccgaacgcgtggctaaccctcccagcatttccacgcggaataagttcacttagtgactctcaaaggtgatcgaaatctaatccgtgaccctaaactataaaattggatatctcgacacccaaactctcaaaaccggtgcaaattgattcccttagtggttttggagggtggttttgctgacgtggcgcctacgtggcggtattgaccgggtctcctttacacgtggcgttgacgtggcgtttaggtggcatttagaattaaaaaatatgcgtgagacccgtttgtcattgacacaaagaaattgtgggacccacatgtcccttctctctcccctccgtccggttccttctccctcctcgccgctccctctctctctcccgctgcgggcggagacggcggcgagcggtggaggcgcggacgtggcgcggcggcctgcgagcggcggagacgcgggagtggcgggggcaggcactggagtggagacggtggcggcgcccgggccgagctctaccgcctcgtcactgacggcgaccaggtgttctacgccacgcgccgaggcacccgcatgctcaacatgtccgacttctgcgaccgctcccgcaccgacgcctgggacttctccgcgttcgtccgcacctacgccgcctacctcgacgaccggctcgagtaccggatgcaggccaagcacggcggtgccgcgcaccagggacgaccgctccgcgagcagctgtacgcgtcccccgggaaccgcttcaactacgacgacttcatcatgagagacgacgaggccacgaacgccgaggccgacaaggcgatggcgctcgtagcgagggagacgccgacgagcgagatgacgctggagcagctcctcgcgaaggcacaactcctcgtgtagtaggacaactttctttaaggatggccgcttttcactaaccacccgattaatccattacttagttaattactgtggttgcaatattaaaaattggagttaaaactaaatttagccgtgattgaatttggcttgcagctggcgccgcattgtcttttgctgccagtggcgatggtggtggtggttcttgctcttgagaagaagctgctggtggtggtgcttggaggagcacttgtagaagccggaggggtcggaggacatcaggcttctcgaggagaaggcatgcgtgccgtcgtcgtcggagatggtgaagccataggggttggacgacagcttcggcttcttcccaccattgaaatgcccatgagaccgtgacggtgggagcaatgccggttatgctcttcttcttctctggaggaagcgggtggcggaggaggtcaagcgtcttagagaagggtcgacgcgggggaggaaggcggcggcggtgacggtggaggacgtcgttgtcgtcgaccccgccgcgtgtgcctcccgccgccgccgcccgccgtcctcctgcttgaacgcctggtcgccgtcggcgaggaggcggtggagctcagcccgggcgccgccgccactcccacgtctcccccgctcgccaccgtctccgcccgttgcgggagagagagagagagggagcggcgaggagggagaaggaactggagggaggggagagagaagggacacgtgggtcccataatttttttccgtgtcaatgacaaatgggtcccacacatatttttttaattctaaatgccacctaaacgccacgtgtaaagaagacccgatcaatactgccatgtagacgccacgtcagcaaaaccactctccaaaaccgtcaagggagtcaaattgcaccggttttaagagtttgggggtcgagatacccggttttgtggttttgggtcacggattaaatttcgatcacttttgagggtcactaagtgaacttattcctttccacgcggcacacggccgggtgcatgcggaagggccgagagcttgctactcctccatcctcctataaaaaacaatcaacaaaaatagtacggatcgtgatgtattctaatagtataaatttgaataaatatctatctaaatttatagtgctataatatatcacatctcatatttttttatagacgaagggagtagctggcaccattaataacccaacattttcatgctacacatacataaacgacatagtagcacacatatataaaaacgcggatatcactacgtaaatatgtataagcaaagctcttagacacctttaaatggacgaaagcctagctgtactaaccttaatatggggtagaattatatttcaaagtatactcatatatgtgtaatatttaaaggcatacaaattttaaccctaatatattgaatcatgtccccacaaacttaacaccacataaactattacatcgtttccaagctaggtgcattcccatgtcatagagatcttcaacattatcaattttatagtgaaaatgtattcgcatgtgtatactgtaggtgcatccaaatttaaaaccacggacaaataattatatcataaatttttttatgtatttaaaagagaccttcctaacacctatttccatcccggaacttttgtgtggaaccaaaacttttgatccgggaagaattcaagacaaagaactcccgctggaactaattattagaaggtgggacgtggaccggaacttctactccgggaatgattcgaggcggagagcttccacccgaacttctaggtgaggagtgaggaccaaaacttctagtcaaagagagatccacttagagcaagtttaatagtatagcccactactagctccaattcatctatagccaatctaatagccaattcatacaataattgcttactatactattagtatatggtcccacctgtcatacatacattacatcttggagtccgtgctgcagctggctatagatctgtaacccgctgctcttctctctcatcttatctcattaaaatatgcttgtagctggctaatagtctgctaatagagacattggatcgactgtaactttaaaaagacattaggtcagttttggataaatcagagttcaaatttgatggggttttaccctatatacgaggcaagatcacccctcttataaatataggaggagatttattgaacccctaaacaatcaatctactccctccgtccactaatataagggattttgacattttgcttctactgtttgacagcacgtcttattcaaaaaaatttgtgcaaatataaaaaacgaaaagttatgcttaaagtactttggataataaagtaagtcacaaataaaataaataataattctaaaaatttttgaataagacgaatggtcaaacagtgcaagcaaaatatcaaaatcccttatattaggagacggagagagtacttctttctctttctaggtctaggagtaatttagctttttttttttgctgttttatatgagtaaatcattatctactcagggtagccgaaaattaccatgtattgttttgtcctataaaccatcctgaatctccaggaaaaccagaaagctatttaccactcgaattggcgagttcttgctgatgtcttgctggtccgaaacttcaagaacttacggtccatccagagttcgctagggggctcagcttatcggtgtgctactgtgttctcgcgctaacagcaagtactagaataaccctaacatccataacttgaccaccatactaaagttgcttccccgtgtccgtgtgtatatatctcaactattataaaaattgataaaaattgaaaatgtttactttgttacgtcactcgtataggagtcggtttttaatttcgttcgctttttgaaatgcatatccacatttgttcgcttttagaaatacagaaggagtcatataagaaatcttctttaaaaaaactcgcatgctaatttgagataatcggactcctaattaactacaactcatgattatatatatatatatatatatgtgtgtgtgtgtgtgtgtgtaaattaactggtgctacatggagtatgggctccaagattcaaattgagtatatacccaatttaaatgagtatgaattttttttaaatgtttaggtatgaacattaacttctttactaacaagttcaaacaagtttgaactgagtttgaacttttttttttggttagattttggttctaggtatataacatccaaacatataattcgctaggtatgtaataatgaattgtgaaataaagttgagtttgagttattttgttttaggtattggtatgaatcaaattcatatacctaggtatatactcacaatttaattttttaaaaaaatttgagagattttgttttatcacggtgaattttattttaactaaaccatatgataataataaggttaaaatagccttcacccgttgtaacgtacaagcatttcttttctagtggagtatatgtgtatagagctagtatatttctttggtcaaagtcagactgctttaagtttgactaagtttataaaaaaaaattgtaacattttcaacccaagacaaatttattataaaaatatatttaataattgatttgattaaactaatttaatattataaaagttattatatttgtctataaacttaatcaaactttaaacagtttgaaaatgtcttataacctaaaacggagggagtataatgcaacttgattttaatttattggataaatgatccaaaggtataaaaatttacaacactatatacgctcttgcacacagtgatcattatacatgagctatacactaaatacactaccatatgtatttaatttcgtccaaaaaaatacactaccagaacatttccagtatgtagtttactaccgccatctgcgaatattttgcatgtacgtttaccccaccagggcacaaccgcctccacacgtatcatgagctgccgaaaccctgctcagtgacctgaactgacggcatgtcgctcctgaaccggagcctctgcaccatgggcttcatcttctcgatgagctttacgatgacaaagaagagcaccctgtacagcaccaccattccaatgaggatggcgaggtcggcccacttgctgtacccgagctgtacctgccagtagttcgtaaggatctcttcaccggtgatcacggtgccggcgccggcttgatcgttgtatttggggaaggtgaggcctaagaactcggttttgtagaatccctggttgg

SEQ ID NO: 8536 - DNA, 7099 bp, Oryza sativa
  unsure (1)..(7099): unsure at all n locations
atgagagctaggtacggtgtagacgacagcgtgttcgcgatcacgaacgacgccacaccgtaatggccgttgagcctctccctcccaaatatctgcatatcatatcaaaatttatggagtgaacatttggttggtgtatatcttggctgttcaaaatatatcttggttggtgtaaaagtgtccttaatttgacattcaagaaaatcagtgaacaaaccttcatgtcctcaacgaaagaggggaagccaccgatggccatgaaggtgaggaaggcagcgacgaacatgagcatggagccacgggcctgcagagattttcagacggtcatgcacacacaattttgccaatgagtaatagatattaaaccgcgaacaaattaatatggaagactgtgccagagccatgcatggccagcaaacctggatggatccataggaatggccgacatcgtagtagatggtgccgacgcagaggcagagcgcgacgtaaatggcgaaacgcagccagtagtagcccaagtccctgtacatgttgacgaaggacctcttcgtcagcacccatgactgcgtcaggaaagttggctgcctttccttcttcaccaattgcccttcctgcagagataaagaaaattacaggatgtgtaaagcatgcatatattatatatatatgtagcagaaaatgctttgcgagatacattattggcgcgtatttcttcgatctgatgcatcactttcgccaagtgaacggaggatttgtatgagttgacaagtgtgtcgattgcttgggtagtggtcatcgtcttcccgtccagacctacctcaatgtcctgatgaatgcatcgtatagaagggagtaatttatttaggacatttagtcactttctttttgagaaaaaggatatttattcactgattcagtgcattggctagcttgctctcccatgatttgcttctcaccttgtcgaagtccttgttgatggtcctcagaaaatggtcagaagggttcatcagagacggacaagggaatccgctcagagcggagaactaataaacagtgaaatatagtcaataaaaaaaattaggaagtgcttagctagcaaccggaataaattctcatgatattagtcaatacaaaatagcatgtacagtcaatactcaattcaagtttgttaagtgcttcacattcagatcaaaatctcacaatatatatctctgtttcatttttaagaaaaacaatatatatcttggaccctcccgagatttttttttcgaattggatgaaaatttctgatccattcaaatttctttaaatctagttgaattttttgtttaaagtggttcagattcagaaaaaaaaacattgcatatgtattccttttcttttgtttaaagtggcggggatgctgttttgttcaacaaaaataagcggcatagaaaattttgctatacttgttcaacactgttttgattttgttccacaaatgctgttttgttcaaccctattttgattttgacagatcacagatttgctagggaggagaaatatgctttccatcacgaaactagtgtgacatctcacggtctaggttactccaaattagggatgaaaacggttcagaaagtttctgatttccggatgtattttcgaaaacagaaagtgtcggaattttttcggtaagtttcagaaatggaaacgaattcggattttttttcttgaaaatgaaaatggatacgataaggctactatccgtcagaaaccaggatcgatcgagaacttttcataaacaaattcggatttttttcctcagaatcagaaatgaagtacttctcacatacaactaatttgctctaaccttttctactctaaatgtttagatttatactgagtacactgagatggttaattagttgaatggagatattgttttctagttcagtactttagatctgtttttcttttttcctaattactatttttgttttactaggccatgccaaacaaaggttgtcaatttcagtttaaaatttcagtaatttcgccacccccactggcaagtaaatatgtcagccagaatttttgttttttcccatttttttgtgattttggaatattcaatcaatttttgttaatttttcaaataattttggcgaaaaagtatgaaaattcctgaaattttcagaaattttgagccatactacttacagttacagtatagatgaatatagttcttgttttcatgaaaagtgaagtgtgccactagctgtattattattaattgataaaaaatagataatgtcgatttgttgttctaggaaaaaaaaagagctacatcactttgtcgatttgagaagttcaatttgaggaggttttataatccgataaatatctgttaccatattagcttcgatttgtgttcgctctgttttcatattcaataataataaattcggttttcgtatctagagtttctgattcctattccgatgcccaaaaaaaatataaaatgaagtggtagagatgatttctgtttgtttccgagtcgttttcatccctactccatatcatagatataatgatccttgcttaattagcaaccagtaagttcagtttgcagatctgagcctagagtgatgctacacgtatgatttgccgtttacgatatttgtacgatgaaacagcttatgtgtttattgacgctgatgctggtatgcagcagtcgactcagtgccatgcatccatgtcatcccgttagatcgtaccatgattgtaagtccaaatcatgcgcacaacatttttctattgtcttaagcgccgatcaagccattcgccacaaatcccattgtaaatcagaaaagacgtttgttttctacttaacttcatggttttcttttgctacatatagtaacttctgcctatgtatattaccaacttcgtcccaaaatactaaaatttatgtgtatgtatcagttagaagtttctatattttggaatgactgtactacttccctactctaggccaggtcaagtatttaggtttaatttgaaaaaccaataaccggtgccgataactggacaaaagttaatttaaatccaaatttctgaattcacaaaccggttcccggcggttgcagctttagaaatctcgtggtgacctagtgcttcctaatttcgacttcaaaccacacttgaatacctgatacctttgttgtatcaggaattcaggatttgtgcagtgtgtcttacctactaactgtattgtaggatctttgcatagtagtatagaacctgatttgcagctttcagaactgaaattttgcccccaaaactgatgcatctgcaccactgtatactagatatgatgctggcacgcggcagcttgcagccggaagactactactgcagctgcgtcttcctgttgggatcaatgaatccgtcagaagggtaagctacagaaagcacaagaaggtgcaaattcgcacgtcaccgactgattggagtcactgtgcgagtgtgtttncagtgcatttggaaaaatgggttgggtctgttgcttctgttcatgagtaagctaagtcagcgtcatctacagttgcaaacggtatagggctagggctttcggatttcttaaccggtctcatctcatttaagctatatatcggatgtggattttcatcccttgagagacatctcctcgttatttgcatgtcatctaaataattattaaaaaaataaaaaaatgacagtatagattaatatgtaatatatcactccacgaatatgcaagactaaatttaacttttacaagttgcaacaaaaataacaaattaaactgaaaatagttattgcacattcgcaactatatttgttatttttgttacaacttgtagaagttgaatttaaactttactatttgtagagtgatatattttatattaatctatgttaccgatttttttttttttataattatttaggtgacacgcacaaaacgagaggatatatcccctcataaaataacttttccctatatatccgaattctgaattctgatacagtatgtttggtaacaattctcattttgccgtacaactttgcaaatacggatgcataatttgtatttgggacaaaatagtttgtacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgtggcgcgatccattcatgcgttccacgacacgagatctcaccatgcttgcatcattgctcgaatctttatcaaagaaaaaacgagatcattcgtcgccgatcgactcaccgacgtgccgaacgccagcttctgtctccggccattgatcaggatgtctcccttctggctcacgctggagcctaaccttcctgtacccagaattcatgcaattcgatcggtgatattcggtgtctcggaacacacgcaagccgaggtgatcagaagagtggcatgcatcatatgtaagggaaactattttaatccctcgagggatattctcttgttatttacatgtcacttaaatagtcatgaaaaaaattgataagatgtattaacatgtgatatatcacgccacaaacatagaagttcaaattcaaattctacatctcgcaaagaaaaaataaattaaactacaactaacgtatattcacagttaaatttgctttttcgttgcgagatgtagaagttaaatttgacttgcatgtttgtggagtaagatatcacatgttaatatatctttttaattttttttcataactatttaagtgacatgcaaataaaggatcaaaatccactttctcaaatgttacctgctaaggagtcaagaagagtggacttgccgcagccggaggggcccataatggcgaggacctcgccggggcgcgcgtagccattgaggccacagaggatgggaacgcggcggcggctgccgccggcggtggacacccagaggtcctcccacgcgaggacggcgccttgttccggccggcgcaaggacgacgtctctcgagcgacgacgaaggcgacacggtcgttctcgtcgttcctctccacgctaatctccggcgagggctgctccgcctccgccgccggcaggaacggcggcggctggaacgatcgcccgctgccgaagggaaagccttcggtgccgcgcatggaggcgccgagatcggagaccatgccggctgcccccttgcgatcagcctcgtcgtcgtcctgacgccgccgcgggctcggcgtccacctcggcacggcggcgggctgctgctcggacgccatgcacgcgggaatacttgctggtagtggaagttggcgggagctgatcttgtgctgacgatcgatcaaaatggaatgcttgagcttgagctgatccgagctagtgagcgtgtatgaagaagaacaatgagcatgggttgcttaaatagaagcttgagggactacagatgaggttactttgtacacttgactattcctaactcaaaaatcatgaattagtaaataattttcacctacattgtaacattatcatttcttcggggtatatatatatatatatatatatatatatatatatatatatatatatatatatatatatatatatatactccatccattttaaaatacaaacatttctatgctttttagtaaaattaaggtagagagaaaatttctcttttagtcacttcagtggtcaaattttaaatgattatagctatatatatggcgctatatttttcaaaaaaaatatttaaatcattgttacactataaataacttatgcttattacattagaagtttcaatttttcacattgtaatttttctatatataatacacaatttattagagagttctgattaagaatagttcattatctacttgaaagaagagataggagagatagaagaatactagtatatgtatgggagagagagcaacctgaaattaagtaaaaaaaatgtggcgccattgcctagatttcctatttcccttcacaagcttcttattagctaaaaaatgtatagatttccgtgcattggaatcagtgccccaacaatgtttatacagagaggtacacattataaatcctcaaaatacttacattttagaataaaggaattatatgtcatgtaaatgattatttactcgcttgtcaagcactagatgaatatccaattacataaacttttttttgccaaagaaattatgaatgttctaacgaaagaaaattataactggatcttgattcctgcacaaaaaaaaaagatctaatatgtaatcatagaaatgtatataaattaatcttggaaatgaaacaacaaaataaactaaacgttgtaatttgtttgtatcaaagttatagctatttatactattcaagttcaaatgactggtagacaagaaaaaaagataatgccaaaatgacaaagtcgtctttaaaaaagtgttaagtaagcgtacttgatattatttgcactggtaacaattattataatatttttgcgtggtaccgaggactacaataaaacacgagatatgcctctcgatactgtgtagggaagactatgacctcaacatcttcacatgtgcatcgacatcggtcgtacccatgcaatcatatccattcgttccccctttcctcggcaataacggcgataacaacacaagt

SEQ ID NO: 8537 - DNA, 13463 bp, Oryza sativa
ggaaggtaattccactgcaccaccaatcaatattaattagtatttgtgatttttttaaaagtaagtgctccataatgtttttacatgaaacatattactccatccatttcaaaatatagcaacctaccaaattaaacatatcctagtaccataaatcataaatctgaacaaactaatgttgtactaggatgtgtcatttgtacatattcgttgtatcaggatatgtataatccgatactaaattgatatattttagaaagaaaggggtatgtactaagaatattgtatggtaaaagccgacacatggacattcctttactcactacctatctcaaaatatagcaacctagtactagatgagacacatcctaatacaacaaatctagatagacctctgtccagtttatattattgtactaggttgttatattttaggatggatatagtacatgtcagtctaaaaaaaagcctctaaggtttatacttattgttttttttaaaacacagtagaaatgtagatgcttatatacacgtgcatgcactcgcccctatagatacacacgcgcacaccctcttcgatgattagaccggcatatctaaagattaacgaagtcaccacaggtgcttcgatgtctacatgtatgccgcctactactaaaaaaataattagtcataaatacgagtgctcatgctaagtgaatccggataggcaagttccaccatataatgaacctaactagctgagctatgcttacttcgtcaggtttctaatactataattgtttcatattataagacattttaacttttttttataatcaaacttcggtcgtgtttgtagaaaaacatagcaaaatcgacaacaccaattgtttcattaattgcaacatcgaatatattttgataccacgattgttttgatttgaaaatattgttatatttactataaacttggctaaagctaaagaagtttgactcagaaaaaaataaaatgtcttataatagaaaacatagtgagcatttttatatctattgcaaacgaagaagcaagcggtcagttcaactatattattcttctctagaggtgtttttcctcctcaaagggttatccctcgttttatatattatacttaaaaagtcataaaattttataagatagattaatatatgatatagtagtattactctacaacatttaagttaaaattcagcatatacaaaagtagaaaaaataacaaatataatgtacatgagcacaatatttactactactagtatatttgttttctttaattcatatagggcgattatgaccttgtaggatactcctatattacatattcattatcttgagttgattattttttaacaaatatatgcaccctctcttaataagtgatatatacacaagggacatcttaaaagactcttccattcttgtttactgacacatttgttgattgcgtgcgtgctagggcgtgtttaggaaaaggtttgaaacttctctctacctctataacgtgtataacggagtgactcattaactcgtaattaattatgtttagctaaaaataaaaaaaagattaatataactttttaaagtattaatatcgaaatgagcgcagtcagggtcatccacattgagagatactgactgctcaatcgctttcaacatggtgagctagctagctgccatgtactccctccgtactcgtaaaggaagtcgtttagaacaatatttaagtcaaaccttggaaatataaatcataaataactctcaagttgttaagtttgaaaatgtaaaaattatatgaatagatttgtcttgaaaaatacttttataaaagtatacatatatcacttttcaataaatatttttatagaaataagaagttaaagttgtgttttaaagaccgtgtcgctatactaaacgacaacaacttcaacgagtacggatggagtacgcatatacccatgtggccatgcctacctgacatggttacggcgcagcgactagcgagccaagtcgtctagactcgagaggagcaattattgggccaagttccttctcactgtgacccagtttactgattaggccgagttctctgcctcattggccatttggcctgtgtgccaatgaaaacattgagttggatatcaaccaagtagaactacacgggagtggcactgatgcacgcctcttatgtaggagtagctacttaactgcaaacgatctatataatgtctacatcagagatatatttttctctttcaaataaacaggccaccactgaattttctggtatactctattatcaccaaaattgtcctccatccattttcacaccaatcttatcattttccatatgcatgaatgtgatggatgagaaaaaatgtttgtccagaatgtctgatttgaccaatttgaggtaacaggtcatgcattttcttggcaaggcattttcattttcatagtactcctataaattttgacaagattttgggaagcttgatatggtggtggagtcatatgtgcatgactctatctgtcatggtagaaatggtgatatccactaatattacacacataagtacgttttaataggaatttagtgggatcatggatataccacctatttccatctctttgagagtggggacgaactcatgtggtgatgagcgtgcatgtgtgtcatctatgtaaatgaaaaaaaaagattttaattggattatgaagttaaaagttgggctcaaccccaagctggctcatcgttatcttggccccacgagtgaattttcacctatgtatttttggtcaagaaaagaaaaacgtgcaaaattgtgataaaatgggctgaagtggtatacacagagatatgataagtcgttttgattttttcctaaatcagaaatctataagttaaacctaatttatggagaaatgtagcactcttgtaacaccaaattagtctaattaatcctaatatgtttgttgatattaaaaatgtttgctctgtttttctataaacttaattacacttaaacagtttgactaaaaaaaatatcagaacgtcttaagatatgaaacaaagggagtagaatgttagtgctaccaaagttaccaagatattttcagtaatatatatatatatatacataatctatattgggtagactctcgagtagtacaaaaacatttttccttttcttttctcaaacaaaaaaactgacatcatctcacccttgcatatacaatgttcacatatatcacaccactaatatatcagatgcctatgggtaaaaaccactgccccaatcgatgttggatcaaaggcttcctgccgagccattctcggcgatgtgcaccgacggcgcgtcgctcctgaacctgagcctctgcaccatgggcttcatcttctcgatgagcttgacgatgacgaagaagagcaccctgtacagcaccaccatcccaccgaggatggcgaggtcgacccacttgctgtaccccagctgcacctgccagtagtctcgcaggatctcgtggccggtgatggtggcggcgccgccggcctggttgttggggaaggtgagccccaagaactcgttcttgtagaacccctggttggcgtacttgtggaacgcgatgtagtacatggggtacttccacaccggcttgggcaggtcgtcggggaggcggaagaagccgccgttgagcatcatgacgccctggatgccggcgccggtgatgatgcccatgaggaagtccggcacggcgctggccacgatcatcatcagcccctccaccaccatcatggtcgtgaagagcaccaccgcgaagtaggcgaagtggtcgatgctgctctggagcccggtgaggtagtagccgatcgcgcccggcgccaccgagatgagcgccaggtacggcgtagacgacagcgtgttcgctatcacgaatgaccccacgccgtaatgcccgttcagcctctccctcccaaatatctgcataaagaaaacaatgaattaagtgaacattgatatccattttcagatataaaagtatgttactggggtagaagttaaattttgttataacttgtagaggttaaatttgatcttagtgtatctcatattaatttattttattgatttttttaaaaaaatagtaactatttaaatgacatacaaataataagaggtaacattgtatggtacattcaagaatataccttcatgtcctcgacgaaagatgggaagccaccgatggccatgaaggtgaggaaggcagcgacgaacatgagcatggagccacgagcctgcagagatgttttcggacgtacggtcacaaacacagtaacactaaagggtaatgaacagtagcagtgtaatgaacagtgatgggtgcggctaatagaaagcaacaaaaaaaagaaaagaagaaaagaaaatgggacactgtgagtgatggccatggctgacgaacctggatggatccgtagctgtggccgatgttgtagtaaatggtgccgacgcagaggcacagtgcgatgtaaatggcgaaacgcagccagtaatagcccaggtccctgtacatgttcacgaacgacctcttcgtgagcacccaggtctgcgtcagaaagctcggtctctcctccttcttcaccactgcccctccctgtaaaaaaaaaaagaaatcacagaaagaaattttggtgaattttacacgcagtaattaaaaagcagaagcaaggatggattggcaaagctagaagaattcagagatgatttgtgtgacgtacggtggcgcgtatgtcttggatgtgatgcgtcactttctccaagtggacggaggatttgtaggagttgacaagcgtgtcgattgcttgagcagtcgtcatcttcttcccgtccatgccttcctcgatatcctgattgatggatcgtttagaagatactaagttattcgggatcattttatttattcaataattcagcagctttcatatggtttaattgccatcgtcttgatctcgtcatttgctactcaccttgtcaaagtccttgtttatagtcctcaggaagtggtctgaagggttcatcaatgatggacaagggaacccgctcaaagcaaaaaactgcgaaaaatacaaagaaaaattaaatgaatttgtgcagttacctaataatcagtcaaaaaagttcagaaggattcttctgagttctgatttctgaactataaatgttttccgtagtgctagctagagagtcaaagaacagtggccaagtgcccaagtctgaaatttctgacgtttgtctatggacctacatacatggtacgcgaccgcagctgtagatcaccgaaaacgcgtgtttttcttgatgatttgttcgtacggtttcctaacttcgacccaagtgtggtcaaggtcaagtaatcagcatggtaggctattaaaatgtcaaatgggagacctttgccttcaaaaactagttaagtggtgtgtgacgatccaattgcttcttagtttcaccttcaatcacacctgatactttgttgtatcaggactcttttccaaagttgtttacctacttctagtactactaaaaaaaatgatccttgcagagtaatctgggactttcagctttcagaactgaaaattcgtcaaactgaacgaccgttgcagagtaatcgctgtatggatgcatgctgcagttggcatagctaaaatctgcaggctttaagtcaagctgaattattaagtgccaccgatgcagtgaaacttaatactcctactccataattaggtggatatgttctgctgctcgtgccacgctattggattcgatgagatatcagaaaaataagacacgcggctctcgccaaagaagaacaaggagacaagttcacacgtcaccgaactatcggagtcactgtgtcagactgtcagtgcattaaattcgttctgttcttctgtttgtgagtaagctagtgtcacaattagttggtatactaaaatgaatatgcatgtatatatgcagttcatatatagtagtggttagatctagtgtctcctttcagctatagttcagttcctggttcctcctacgtactacccaatgtttgagaacagttctcattttgtccttactaattttcaggcacaaggttccgatgtaataatctgtagatttgtttctttcaaaaatagtttttagatttgtagtaatggctgaaataatgtgtactttctgcatatgtgaattgttcatcagtatcttattagaactatattttctattcattgttcaatgacaactaaggatttcagttctacctttgatatagaaagatgcacagctcctgcttattgtcggaaaataaaaaatcttttgcaactatcagctttcatctgactttgcccaaatcttttatttccaactcatggttagctgatgtagcccgtcaagtgtgactaaacaaactcggcaaaaatgattctctttccgaaaacatctcgcaaaggattgactaatcgcagaagagtagtagtagtactggtctaagtgattcatcgacaatatgataatatcatagacagtatgaatacacagatcgaccaggctggctgccaattttttttcttaaaaaaaggtataattaagcaggtggccggtgaatgatagccgccagcaaaaatattattctttttttaaaaaaggcaaaaatgtacgtattaattaagcaagacatacgtatagatatacgagtacgtatttgtacagtatacggaagcgtagaagcgtgtagaatacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgatccatgcgttccacgagatcatccattattcaattattcatcgtgcatgcagcaattaattctgtacattcgggaagaagacgagtccatctctcgctgacttaccgacgtgccgaacgccagcgcttgcctccggccattgatcaggatgtcccccttctggctcacactggaacctaaccttcctgtacgtacgtgcacccagaaaacatggagctcggtcagtcggtgtcagagttcgtctcagctagcatgcaactcgatcgatcactccttctctattcaatgaaattggcagcttgtcgattcgttcaaaaaaaaaaaaaactcgatcgatcgctatttgcagcgacagggatcgtgttcgtcgggatcgggagattaattgacgtgcgtgtacacgttacctgccaacgcatcaagaagtgtggacttgccgcagccggagggccccatgatggcgagcacctcgccggggcgcgcgtagccgttgaggccgcagaggatggggacacggccgctcttcccgccggcggcggacacccacaggtcctcccacgcgaggacgacgccctggtccggccggcgcaacgacggctcgcgggcgacgccgccgccgccgccgttctccgccgcgctgatctccagcgacggctgccgcgccggcaggaacggcggcggcgcgaacgaggagcggccgctgccgaaggggaacccgtcggtgctgcgcacggaggcgctcatgtcagagacggcgtcgaactgcggcggctggtccacgtcgtcggcctcgcggccctgcggccgcggcgggctcggcttccacctcggcacggtgggttggtgctgcccggacgccatgaacgcgagaacgcctagctcgagcttgaccggaagcgatcgagctagctagcgaggaggtaggtggtgtgcttgtgaagctagcgctgtgtgaagaagaatggcgagccatggctcttgcttaaatagagccaaagcttcgcattgcgccttacagataagatcgatcgcttcgtacaattgacttttgataaattttaactgacaattggattatacggtcaaaagtgcatttgaattgttattctatcgtagtttctcccatctaagctgataagatcgatgtccacgtaattttagacagtaagcaatcaattgaggcataagaatatgtacaagacgaaatgaatagcatcaagaaattttcaaaatcgttttttaagtactatagggtactgttattaaaatgttgagacattcaaaagtacgtacaagcctcttcggtcaaaaaaagaagaagaaggtacaagccttcaaatttgctagttttcatgataaaatagttcctaaatttggaataattcaaagataactcagtttggggagtcattaattgtatttcttatgatttaataactttaaaattctgaattaataaatataatgttgtattggtcttgggggctctcgctttagcattttattaatttaatactaaaattcgaaaattaataattagcaaattgaagttgatagacccttgcttaaatttaagccattatgattcgatcccacatcgatatatggctatatttattcatttcttagtgtggtcataatttcaattttccatgatgaaacaaagagtaaattttgctttgggcctcttattaaaaacaaggtgtacttgagtccaaagttgtagtttttatttttttatttagtaattcttacattgagaattgataataattataaagttgtaactgtctgggactcttgaaccgttatatagccagatttatttacttattctctaattttatacggttacaacatatactaattacaattactcctataaagaagcacatgcatgagaacgcttcttcaagaagttgagctaatagatttgaatttgataattgccgcatgctatttatagtcatttgctcaaactgtttatttgcttcatacaaatttccgcagcaatatgtggatgttaatatagctaagaacacctaattaatatagctcggaatgataattaatacagaaaactccatcttgaaacacattattaaatgatgacatcttgatcatgtgattgttttacatcaataaataaacatctatatcaaaaagtgactattttgtggtatttttcttccataacgatgatgaaagggagcgagtactggatttcgttactatcaatcacccatcaattagcatcccctcttaatttgtcttacgtgctgccatttgctgggtttcgctgtacacataaatatttatcaagttcttttgtcaaaagattataacagtgaaaattgcttaatataactgaatgatgtacatgtggaactgaaatagcacgattgatatcgtctctactaccaaaacaacccatcaattaatgtataagcctgtccaagacatgaagaaaaacaatagttcatctgccaacctctgaccatgctacaataactatatcatccacatcaatggcatgtaaatgtccaaaataataatcaaacatccagaacaatagcatctccaactgcacgtgaataaaatgcttgatgttgtagattttttgtttgtgctttatttggatgacatcatcaaatttttatagttgtcttctatctatgttgcttttttataatttaataaacaccgtaagattgttttatgcgctaaaaagattgcactatacttctataatgataacatatatctttgctttcaaattaatctatagaacaattatgacttatagtttcttttggattgctagattttttttccgtgatcaacaaaattctccgtagcaatgcacgggcaccctactagtatccaaaataataaaaacaatagtagcatatatagcatatccaacaatttccaacttttgaaagcatttccagcattacgaacgcggaggagaactcaactaggccggtcacccggcggcggcggcggcggcgggcggtcagctttccaacgataaaaatggatggcttctctgcaacttgcaatagcaaattggcagcgccagaggtggtcaattcggaggctctagatttttcacactttagccctttcagagaaaaaatttacaaatagatcctccagaaaagtttccttcaaatcctattgatttgtagtcaattaattttgaaatgaaaatgatagatcaatataccctaactcatttctgctactttatttttatttataaaatcttaatatgggatgagcatatataggtccctccctcctctacccaaaattacaaatcatataccataattcgattcccctacttccttttcaaaatttgataacaaatcaataaatctaggaatggggaggagctagtacgtacccacgtcctctatttagatggagttttttataaataaaaaaactagtaaaaataaattaggatacatttatttattagtttttcaaaatgtgacgctgagtcaataaaatttgaaggaaaacaaaagaaagagttattcgtagaattctaagtgggagagttcggcaaggactcctaacgcgcgtgtacgcgccaggaggagaagccggcgtgcgtttttctgacgctaagagcgcttagccctaactaatagcgcttagcgctaactaactttttttctttttttttttgataaaaattcatcacgtgtctttcttcctttttagttgactgaaacaaactttcaattccagatttgaacttagatttaaaaatttcaagttaagatttgaatactttcaacttagatttttaaatttgagttaaaagtttttaaacctgagttaagttttcaaatattgacttgaagttttttaaatttgaattgaaagttttaaatcttcatttgaaagttttcaagttcgaactgaaagttttcaaatccaagttgaacgttttcaagtttgaattgagagttttcaaatccgagttgaaagtttttaaatctaagttgaaagttttcaaatccgaattgaaagtttttaaatcttgaattgaaagttttcaaatttaagttgaaaatttcaaaaaatcttgagttgaaagtttcaactcatattcgaaaactttcaactctagattcgaaaactttcaagtccagatttgaaaactttcaacttgagatttaaaaattttcaactcaagattggaaactttcaactcgagactcgaaacctttcaagtccagaatttgaaaactttcaacttaagatttaaaaactttccaagtccaaaatgaaaatttttaagttaggatttaaaaataactagtaaactaatcactagtaaaattagggacctaatcactagtaaactaattacgattttttttcctatccgtggaatagcaaattgcgaaaaaaagaaaaaaaaagagaagaaaaagcggtagaaaaaaactgcgaaaaaaaaagaaaagaatagaagaacgtgtgcacgtaccgtgaccttgtgggcggaagtaagcgcgggtacgcgcacgcgaatagccatcttggaggttggccaagtttgggtgccaaaccttaatgtcgacggccggcaaaaaattggagccaagggttgaaaagggggtcaattcatgaaatacattttcaaaaaaggactaaaacgtcaaaaatccagatcagatcgttggcttctctgctgtttcgttttctgctcggaaagagaggtagggaatggtcgcgatgatcaccatgcatgcacgtcgacagacgttgaccgcaccacattgatagtctccagcttccgtcgttgtgacttgtgtgagatgccacgagagcatacattacacatgcaatttgggattttggggacacatgcaatttggggttgtttccacgcagctagccaagtcatgggctctcccaattagtctgacccgaatttattcgctcgctgccctaagcaagaatgcatgaagacttgtcaaaggaatatattactgtacgtaattactgtaacgtaggattggtcgatatataggagtagccaattgtcaagtcctatgcaagctagtcaggtcacaaaattcttgaagagatactctgaataatatatgacgtgtcaagttgctatactagtattgttttatactgatctttctcacgttacgtagtagtagtatccaataataaagaaaagataagtacgtagctcgacattcaccggagcatgcatgcagcgacttactacctcccttttaaaataaaccaatttacgtattaatatgataaaatctagtacaataaatccggatagaagattgtccagactcactatactagattatattatatccttatcaaaattgatttactttacgacggagtgagtatctagctagatcagagcaagtaccataaagatttactcctaagagtagagatgtttgcccctagtgccacataaaattaggtggaggaaaaaagtgaggagatagagaataagccaactctcatgtaacgcgtaacctctatacaaaacttcaagaaaaatacaaagagagtgagatagtgctagagcgaaccaaccaaaaagttatcaaggtttatttattagagataaatatattatatatacatgatgcctcttattcctaattcatgagtagatgatataactaatattagaagcggtagccacgccactaatataaaactactctgagcagacatgggatatattctactctctctctctctccaaatatataacaacttctagacataaaggtctgtcccaaaatataacaactttttcaccaacattctcttcttaaccaatcgcaatcctccatcattcaattttctcacctatcttcacttctcaaccaattacaattttatcctatttaattttacctactttcttaatacccgcgtccaaccttaaaaatccttatattttaggacggggagagtagattaaaggttgggttctttattactttttttttctcaaacttctactctctcatttatcatgaacacacttcacgaacttttaaatggttttttcaaatattttctaagctagtacgtagttactttaaaaaaacatatatattaatctattttctaagttaacatttaattaattattggt

SEQ ID NO: 8538 - DNA, 573 bp, Oryza sativa
aaaaacaatgaatcaaatatccaaataaaaaactcccagaatcaacccatcacataatcaatcaacatatatataatacggccaatctttataacatcctcactttttaattggaagaacagaaatggaattacatggctctaggaccacccgccaccgctattcaccgcatggtgaagaagtccgcccacccgctgctctctacagacaaccattgatgtcgagatcagctgaagagagagggggtaggatgaggaggatgagagggaaaggcgcggatggaggaagatggtgaatggacgttaaccttggatgttggtgttggactcgagggtggcggatcagatcaatgacaaggacgaggcttcctgcctagtgctaatgcctccatcctccacttcattagtgttgctaattgtgatgaagagaatgaggcactctagattcagctcgtactaggccctaggcagaggcattgagggcaaggaagaagagatctgacatatcagtgccattgccttggtcgccgcgggttgtgccccatcccccttgctagccccaaataggctagat

SEQ ID NO: 8539 - DNA, 1477 bp, Oryza sativa
caccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcgttgacacttgaagagaaaaaagccttctgtaaatgtttacaaggggttagagtgcctactggtttcgcatcgaacatcaggaagctagtatcaatgaaggatttgtccatttcgggatacaatgcgtatgactgtcataggttgctaacggtgttcctaccaattgctataagggcagtcaaaccagtccatacaaaggtggttataacaaagttgtgctactttttcaatcgaatttcacagaaggtatttgatcctttggaattaggtccgcttcagacatttgccgtcgagactgtatgccagcttgagatgtatttcgcaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaatagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtatggctcaagtgttttatgtgaaggacccttcagatgaaagaaaaactattgtcatatccggaaagcaacagatcgtcggcatcgacaacatcgaagaccccaatgattacaacaagttggacgatgtaccattggttactgatctttctatg

SEQ ID NO: 8540 - DNA, 8832 bp, Oryza sativa
  unsure (1)..(8832): unsure at all n locations
ctgcaccccctttcagttttagctttttttttatgggttaacctggcaatgttaatttggtcctgttggctttctgtcatcaagctggagtccccagcaaaaacattgtatcagaaacctgttatgctttaagtaaagctgggtgtaggccttttgtccaaaaaaaatctgttaggtgccagcccaccaccacccactgcatttttttgttacggataaacttgatttcttcagcattatataataaaccttccatatgttgttcttttcatatttgtccttctaaaatcacagttttacatgccaaggtctaagatagccaaattgtcatgttatgtagtgtgtaagttcattttacaatttgcatgtgtaaacaatgtcaaaggttcattgtgcaataagtcattttcatagcatggtatcagcgttattgcgaacactctatttagagcatgtagacaaccggtcaagtgtgcatgattatacagataaaatttgaaccttctaagcataaaggtattagtaaatttttgacagataaatcacaagtatggattacctcctttgaatacccgcctttgctgagagctcgagtgacagatctgtagactctttgactcatatgtacagcattctcttccatgagttccaaagcctccgtaacaaactatagataatcaaaaagctccaaaagagatatctaatcaaaatgactatactgttactccatgcaaagaataaaacatgcactcagcagaagatttaccaaaggatcaggtgctgttgcacaatattccagtatatgagaaaaatcttctgaagtcaatgccctgttagtctgttgaagatttgaaagcaacaaggatgcttgctgccgatcacctctgcaaagagcaccaacaatatctgcttgaatggatctagtagccaaactggtcatccatttaaattcatcatattctgcaaccattacatcattgttacctatgcatatgcataaaattcacttctataacaatctaatatgagcattaatcaaaccagagcatctcatggtataattcagcaaggcagtgagacaggacttacagaagttactaacacagataaattaaaaagggaacctcaggctccaaactatatgaatttaccccaaaaaaaaataaaaggaaaacgcttagttccccatttgatcatcacgtttcttgcaatataccgttcatatacaatttgcaagcatagaactgggtaactagattagaaacaacagttatggccttccataaggaaaacatgacagtacaacgaaaaggtgtaaagcccagcaccgtttgaacaagttgaggcctctccggagtgaactccactaaccacattggcttgcgcctgcaaaacgtgcaacttcagcatccagaatacacaccaacgcacagaaaatacataaggacgcaaggaagaaactcttcgttacaatctgcgggggcttgaatgccgcggaggaattggtgcaccggcgagcggctctcgatctgcagtacaggagagaaatgtgaaatcacggcgacacctgaccccgcgcaaaatcattccacggacgatactcttacagtattcgatgcatcgagggagatgtcgtccgtagagctcctgggcggggtcccttcgcggcgggcgaggcgcgtcgcgcgagcagccgggcagcggggctggctggctggctggccgccggcgacgttgaggcgccgaaggccgtcgacgcgaggggggcgacaggtgagggggcaccccgacgaacccgcgcacggggaggcggcggcggcggcggcggcgtggctggtgatgtcgtcggggagttcgtgttggctcgattagagtgcaaagggaaacaggaaagtctaccagttaagtgggctgtgccttgtgggccgtttctgttgatttgggccgcgccgctaagcgtgaaatggaaaatataggtttaggcccatcgggtgctaaacagctattagtaaacctgtaggataggctgcgcatcttgatattttatacccttcagtaattcagtgtaactagccatttagtcgtgccttgcacgactttatgtgcccgtaatgctctcaatcatacttaattttgaatatatttttttacaaaatcatacaacttgataaactattagttaaatctatagattcagctcaagctatatttaaactaaaggttcaaatattatgttcaggatcaacctttcaccgtataccgtcaaaagatgagaatgtttactcagcgatatgatgcataaggcataaaatagtcaaacctaacacaatacacagtgacaaattaaatggcaatctagtccatgatttgaaaccaacacaaattgctcaaagatcatttgacctctgagtatctcaagaagataacataataaacatcccaaaataaaaatacacaattttgttatgaagtgtagtaaaaaattcagagtcatcacaattagtatagtttgtctgtttgtgcattggtgccaaccaaaaacccttcagtccaaagccaagaggatctctcaactcttctttgtaggcgcgagaaagtagatatgcatgagacaactcattgcaggaaattcactgcaacgaaaacaaggactagaaataaatagaagtttcttgaagggtctctaggaggttttatcaattgaaggatccagtggttcacattgcatggcaagaaaatcggacggctaatatttttttatcacattgttgtaagtatttttttatcttttttatatcgaattctttatgtagaaactatgttgcttcttccttaatgcacatataaattaattcttcacctttttatgtcaaaaatttgttccatttaaatctacaatgtgagacaccattattcttttactcaaatataagtataaagttactaaggtgtagtaggtgaaaaaaacatatatacaatttatacttacgtgccacttctttcttaataaatgtgtagtataatggattttccacttaatatttaagcaactacaatagtgacaaataatgaaacccacggattaagataacacgtcacgagatatacacccataatctttagacttttgggcatatntaaaatagcttttttactcaaaaaaaaattaattcgtctgctaggggacaataattttcgtagaaaacttgcttcaaaattcaaattactcgcaaaatccactgccaccaactcaacatgtgcgcccaaaataaaaaccaggctgcagttagccaagcaggcaggcaccctcttgcactctccaccgatccaccaacaccacgagcaaatttctcttccaacgtgggcctccccacgcaccgccgcaaaggcgcgccgatgtcctcctccccgtggcctcccaccacgggcgccgcctccgccgccgccgccgccgcttcccccgcgcctccggaaggagcggctggcggtgccgcgactcccgccgctgcgcccgccacgacgtcggagcagcgcccggtcaaggtcgccccctcccaccccaccccgtcccgtggtctccgcatctgtgtccgactgtccctttgctctttctgctctcggttatacgcggtcacactgagctcgtgttagcctcgcgcaggaagggggagacgccgcggccgcgggggctgctgctgccgtgcagcagcaggaggaggaggaggtggaggcgaagccccagttgctgcgtgaagacgactcgtaattcgcgatctccctctgttactatgctccttgttttactgcaatgcgtgctctgtgtttgcgtaattgcttgtatgaacgctgcctcactcacggttaggcttttttttttttttgccggtaatattacacagagtacgaactctgtaaacgcgctgatgtgtagtcgctatcttttatactactgttgtgggtgtggcacaatgctgacaggagtagaacgatgaggtgaggccatttagcctgttactagtatcatgatgttctttgtgtacatgatgactatgtcagcagcaccttgtcagttttgtcagcagcaccttatcagttttgtggtttattacattgtgcacaggaaagcatatcacttcatttgtgacagtgtgagataccttcacagtgttaggatatgctatgtagtcctatatttgcaaataaccaacaagcagagaaacatttttttccctccgaaaaattgtgccaaaactcatgtatatcacttatttttccttccaaatgtgctgtttctcaccaacatatggagaattctgaaatcaactgcgcataactttttgtcctgtagtatagcaaaagcttagattccgtgcctatgcacccggttttgtttgattttatctttggcatctgcaatttcacttgttctgtcttgtatatttcaaaattaaggtgtcacaatcaccttctctaatagaacccacccttgaggagttgatttgcatgatgttactatgtaaattgcaccatgaactgtttggctgccaataaaggttaacacattttttttttcgaatagagagatcaaagaaggctcaacaaatctagtgcttttaaaatagattgggaaaacagagttctgtaaaaaaaaacggagttgcaaaatatattcttctatgaaaaattgaaggactagcatgcatctttgcttgcagatatcatctgttcatcactgcatacgttaaagtttctgctacaattattgttgattacttatcatgtaccactttactactgttttccagaatagtatgtgagaaaatgaaaaataggaatataacttcagaaattgatgaaggatttaactgtttttgttatatttcctactgtaatgtaatatgttaattccataggtagtaagcatctcaatctgagctcagcacctatattaatataaattcctttctgtgtggtaaaatagtttaactctttgttcgaatttcaaaccctttgatggtttttaggtaacaaagcgaatacataagatctttgaaaaagaccaagttggtacatacttcctccgtttcacaatgtaagactttctagcattgtgcatattcatttagatgttaatgaatctagacatatgtatgtgtttaaattcattaacatctatatgtatatggacaatgctagaaagtcgtacattgtgaaacggagggagtatatactttgaagaagactaaaatttctccccacactacctcaaggcatgctctatatagaatttggaacaccttggccctcattggctcatacttgatatagaaattactctgtcatggtatttaccttctgcttgttgttgccatgagaaataaaaaaaaatggcagttaaattcgtgcattgcattgtcatgtgcagagaaacagaaatccaagtgcacgaacagaagataaacaaatatcaagctatacttgcagcccgtttgaaggccaaatacttctctaataaggattttgatggaggtatttgtgaaatcatcatctatgtgcagtatagatattacctagtatatttgtgcacactttttttttcacacgtttaatcacatacaggcatgccattttttcagtctcatgctatagagatctgctattgatacagtgcatcatttttctttcaaaaaacccatggatgaaatgagaaaacgtgacaaacttaagttaactgttaaacatagttattccattggaggccagaagaaaatccctctttaagttaattatcatcatttatacaaaaaggaggatggaacatttgggaatacataataaactgataaacatagatgcattactttcatgctatttgttttggattaagtttatcctgaataaaaaaaaaagttgaactgaagcatggcatgttacccaattggtcgacatcttaaccctaaaagtctataattatgggaccatgtctctttgcatttattaacagtaagtgtgtacgtcatcttagtatggatctgttaagcttccattttcattgaattttccatttacttactacttccactatcaaagtcctccaaaaggaaagaatgagaaaaatgtgaccttatggaatgtcaccttgggactaacaaggcccagatagactcctagtacctggactaacaagtcaggcatagattgaacacgctctcctagaactcctcatgcaaaattagtgctcagcgaataactagtaaagcaaatttacgagttgaaatgcaaaacacaataaaatgcccaaattggaaattcacctggaggaatgccgtgcctcggcatgttcatttctttgcctggctgcttgcaaaggattgactaccaaataagtcaatcgtcaacttagctgcatgtgggctatgcaatcatgtccttggagatgctgatcatacttccactgcccttcttactatgcttacgtcgaacccaacccccccccccccaccaccaccacaaccgtatgtcctgtttgaaatacgaaatgttcttccattattgtatatactttataacttgacataatcacatcactaggcctcccttctgttctcacatgtaaacgggtttctttcaagtattttgaatttttttgatggaataagccttgtggtctttggtccttgtggtccttctcttgcttttaggttgtttttcccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatgtatccaacctccctcgggaaggtatggcttttgtgttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccttctccacgcagcagccccccggaggtgagccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcgaaggcggaggcggcggaagatgcggcacgtgcggcggaggtagaggttgagaccttgcgcagcagcatcaacggctccattgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgagcgcaggcgtgccggcggcagcccggagctcgcacgtggccctcgcaggcagcacggctctctctcccctgaccggcgccatggtcaccacggtgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagtcccgcccgagatgcagttctcgctttcccagaagcggactgccaaggaggcctgggacaccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggtgacgacacctacgacgaggagagagctgtcgagaagctcttccgctgcgtccctgagaagtacagacagatcgctcgctcgatcgaatctttgctggacctctccacgatgtcgatcgaggaggcgttaggtcgcctcaaggtcgtcgatggtgatgagccacagcctctctcggggcccatcaccatcggcgggaagctccatctcactagggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacgcctgccgcaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8541 - DNA, 605 bp, Oryza sativa
tgcaccccgatatttttcaaagatgaagctacaataagaagtatagtatctttctatggtatcaaggatacatttccgcttgagggtcaccttgtgactaggaatcctgatgctggccatgttaaaagaatatactacgtgtcaaaatcagtgcaagaagttttggagctcaatgtaaaagttggtgagcggcttaagattacctcacttggcctaaagatatttgtaagtgtctcctttaatttatgttttcttttatcaattttagcttttatcagtggggcaaatggcacgacactaagctgtgattcttgcaatatctttcaggaaagacagtcatcaaaggatggctcaccatgcacatttaggttgtcttcagagggtttaccactgctgctttcatacatcaccaaacagattctctacgcttctgcaattgacttccagcaccttttacaatacagaactattaaatttcctgattttgtggatgcaaaatttcgggaaaaagcttcagctttggtggctggttgctgtgttgtaagactttgggaaggtaacatcacatcccacttataagctttatagagaaacaccacaacttg

SEQ ID NO: 8542 - DNA, 1344 bp, Oryza sativa
ctgcaccccaatttgtgcgtcatggtttctcccctggatgggaaggagctgcttgagaggatttgtttacgttatgggctcaaaatccccaaagcggatgatgtaaaacccagcatgaagattgatggatcagacgagcagcctgatctcagcactgaggcagttgatccagaagctgtgcccgaaagcaaagcatctgacatggagattgcagatgctaaagaggtggagtaatcctgctgaatgctgatgctatccaaggccacatattatagctggatacaacatcgccccatcatttgcctaccggtattagttgagcgatgagccgccatttttcattgattctggcatttacgccgttttcctgtttgatttatcatattctgtttctgaagaatgggtgaatgaactcgcccattagtgaaagggcaccacgttgctctaaagcccatctgtccatgtcatctggtaatcgtgcacgtattgccccctccatacttccggctggctcatccacctgtaacctatcagtatcagcttatttttcttcttcccttttcgaagagaatgtattacagggagtcttaacctgaactcttgaacctgataaattttgatatgacaatatttcagacacatcctcttgactaaatgcttgtggctgtacgtcttgtcgctaccacggactgaactgtctgaccatgaatgcattatcattgtgacgtatccatcaagtccatgcagaactcgtgcttgaaagttagaaacctgttacggagacatgaatggatgttagaaaattctatgcagaaacttgaataacgaggaggcaatgagaatggatagaaaacccagaggctgtgaagcttggattcagcatttttaccactgaatcgggtctcgtactgccgccggccaaggcagaagaaagatgcatgtacgtgctgtttacacctctcggcgacgcaaaaaaccggtgcctgtcagttgttttgttccatttgagagttgactaatttattgaaggccacaagcaagaaaaaactgacgcactgaagcgtgggaactttctcaatattttgaccctcgtgggaacgcacagttattgctccccctccagtcaaagacattgtttatattccagtccagtaaaaaaaaagagagaatgtttatacagttctccatccaaggaagttgtttagaacagcgacacggtatccaaaacacaattttgacttcttatttctataaaaatatttattgaaaagtgatatatgtatacttttatgaaagtattttttcaagacaaatctatacatataatttttacatttcaaactc

SEQ ID NO: 8543 - DNA, 674 bp, Oryza sativa
aagattggtggctaaaggttttaaacagagatatggtaggtgaggatgaggacacgtttagtcctgttgttaaaatagctactgtccgtcttattttatctcttgcagtttcaaaaggatggagtatacgctagttagatgttaagaacgcgtttcttcacggtgttctggaagaggaagtatatatgaagcaacctcctggatatgagaacaaaaatttatctgattatgtgtgcaagttggataaagcattatacgggttaaaacaggcgcctagagcatggtattctcgactttatcagaaattgctacaattggggtttgttgcatcaaaagcagacacttcattatttttcttcagaagaggagacgtcacaatatattttctagtatatgttgatgatatcatagtagtcagttcctcagataaggcagtgtcaactttacttcaagatcttcgtagtgattttgctcttaaagatctcggaaagctgcactattttttggggatagaagtgacttcgatttcagaaggtctgatcttgtcacagaagaaatatgcaaatgaattgttaaaccgtgcaggtttgaaagagtgtaaacctgtcaatacaccgctctctatatcagaaaagttctcagcatcttcagggaaattgttgagtgataaagat

SEQ ID NO: 8544 - DNA, 7062 bp, Oryza sativa
ttcccctttctactatgtgccaatgcatgttgcccggaatgattatgtgaaaaatctgcaaaactcatgaaattccagtgttctaaaggaagacacgaagtgttgtatacatcttatatgtcctgtcctgtgctgactgcataatcagttcatctatgatttgtctagcatcaggccatcagccatcctttttgagagtttactcatccaaatgctaatatttccggaattaaaaaatttatggggttcagattgacaaacagtacgtaatgacatttgctttaatttgtgttagggcctaaactactagaaccaaaatcctggaaatatgtcatccccagatgtcggtgaggcaacaccgctgaggtcatgaagaggcctttttatagaggtttgcaagatttattattacacaacaagacatgcatacatttttggtaagctatcagattcattttaacttctgcttgtttcgttctgtgcatgtcttggttgcaggattgctcccaaactctgcttgtttcgttctgtgcatgtcttggttgcaggattgctcccaaactgaaataacgggttggtgactttgtagtgaacatgggcaatccatcttctaaattgcaaggtatttctgtaaagcgtatggctgaagcaactagaaaacatcatttgggtgaaataattccctgaaccatgcatgttgttgcagacataattagcatatgtatatattgatctcaccgattacgcgcagtgattgaaatttcgtttcgaaattttggatcccccggcaagttgatatctcggccaaaatttttggtttttcacaaattttggtgaatttggtcaaaatttagtcaaattcagttagagtgtatcaaaaattcagaaattttcggtccaaaagatgttcggaaatttcggttttaccgaaataaccgaaaatttttgcccaaaacaaaattgcaaacctttattacgcgtactacgcaagtatttcggtgagcacatttgcacgactccacacctccgctgctgctggtatcttgtattatttttaggctgcatatatgacattttataattatagctgccatatagtcataaggtgtgagagtcttgtagtctggacgctcacgaatgatggtcaccaaggtagagttccttggagtgattgcccgaaccatctttttgatcacaaccttatcggtcatgtccttggactcaagccccttgatctcattgatgatcttgctcaatcgatcatacatgtcacttgggctctcaccatccaacatcacaaaccgctcatattgcccctttaggatctccaccttggactcacgaacgctatccgtgccttcatgcaagttgcgaagtgtatcccaaatcaccttggcactctcaatgccgtccacccggttgaactcacttccactcaaggcgctaaatattgcatcagcggcttgagcgttcttgtgctcgtgttctcatcgtcctccttgatgggatcctcgggtttctgcaaaacataccctttttcgactattctccaaatagaagggttaataaacttcaaatgcatcttcatcttatgtttccaagcagcatagtccgtaccattaaagttcggagctttaccgctataggtgctcacgtaagatgtagatgtaggtggatagtaataagggatcttagctcccttatcacctttcttgccatcccccgtttgacccgatatgatctctccaaacgattaagcctaattaggagattaggctctgataccaattgaaatggtcaattaggcctagagggggggtgaataggctaatttaaaaacttaagtaaagcggaatcaggaattttcagaactaagcagagattttcggaacttccgaaaatactcagtgcagtcgaactcaagatgataactctagatctagaagtctacaacaggataaacaaggaacaaacagtaactagaccaatagcggcacaagcaagcggagctagtggagagggataaagaaatatcaccaagataaagctcgcaaagttgttcccgaagttcaaatccttgagtagattctactctccgttgatgagctcactaagagcagggtcttagctaaccatttcctcaagaggttgcactaagcactcctccttccactaagaggtatctctttccttgcggaggcgagatccggccttcacaaacttcttccggccaaccacacatagatcggtggctcgggagcgacacctagccgtctaggaatcctcaacctccaagagtaaaacataatgcaaagaactcccggagatgatgcaagtgctcacaaatcttcacgaagaccacaagaagcccccacacaaactcgaatccacactctcacacacacaccaaatccgaatcaaacccgggtggagagaggaatcgagaaagaaatggctcaaatgactagagagagaagcacgccaagggtgcacaagtttgtaatgagagcagcagccttcacaagtgaggggagtgggatatttatacccacagctccaaatctgcccgttggaacacaataattctgattttcggaacatccgaaaaattccagatctgaaaaaatcgaagtcaacgcacttttcggaacttccaaacataattccgaaagtactttcgatccagaagcatatttggctcgcagacattttcggaacttccgaaaatacttccgaaaatttccagaagcttaaaatcagttctatgtattttcggaacttctgaaaatttccagaagcttaaaatcgattctgtgtattttccttccgaaaatttccaaaagcttaaaatcggttatgtgtattttcgtaccttctgaaaatacttccgaaagaacttccgaaaatttccggaacacacccaagagggcaatgcttccaagaaaaatagattttgagcacttgcattagtccttatatgtctatgcatcatcccccttaatagtacgactttcctatgactcaatgcaaggtaaaagatacaatataccatttgatcattgccatattgcatcgtgacgtcgcattcaacggggtatgcatcacattacaacacatcgaggacataacaaccttcatatttacttgaataaaaaagttagtcctctctaacagacaagcatcgtagattctttggttcagctcactaaactggaagtaagaatcaggtagtgatttaggcctcgtttggaacagcttcagctcccaactccaacttacctagagtcggatctgtgccaaatagtccagttcctccgtttttgggaatggagttagcagagctactcttaaaaaatgaactacgggggtggagctgggattttcagctccacagctccactccaacctaaaagaccaactaccctttaattttttacgcaaaaatggcactgaactaccccaaactcacctctctcacggtcggtgcacacgcgtggggggatggcgcgcgcggcggcggcgagtgatggcgtgtggtcggcggcgcatgagcggtctagggtttggggatttttttccttttttttcaatttcagatctggagttgaatgctagccaaacacttttcagcttgttcccaactcccactggagtgggagtttagagctaggtgttggagtttggtgccctaccaaacggggccttacagtgattaagagctcacagtaaacattcggtaaacagcaaattatagcgtactagtactagttaatctctccgtcccaaattataggaagccccatttttaagaaaaattaaactcggtagcttttgactagtaatcatactaactatatctatactaagtattatatatgttatatcactagattcatattttgaagaactttcatgtgatgctaatttcatatttggtgggatcatagaatggaatgaaatactagttaaagtatgttattgcagaccgtataaaaaatatagaccttataatttgggacagaggaagtactacgctataatttgaactttcttttcttttatttctatgaaaatcagttgcaaaagcatgggctttttcgctagcactaaataaaataataaataaaataattctgaattgacctttataccccctgatgggcacccgatcctcattcccaaatcccgagaatttagactatttaccatcaaattcacgtgcctcaacttttttaccactcaatccgtatgccctctataatatatcactagagctgctaattgttagatttggtaccactttcactattttcatccttttctattatttttcacatgttaatggacattttaaccccctggacccacctgtcagatctttggatcggatcgatccatctcctgtcgcatgccccttccctgccgcgacagagagcgacgccgcgccatagccgagcaccgccgacgccgggcgccaccaccccgccaccgagcgccgccaccccacctgccgccgagcaccccaccatccatctgcaaccgtccatctgatcgtccaattgatttttgtatgtaagcacagatacgatttggtaggagtgctagtaatactgatcttgtatgtaagcaccttggcatctcctgattgcatatgtgagaatcatgcctcaaaaaacacagcttacaataattttacatatatcagccaaacttcatccagaattcagcacacattggcgacggcggcggcactgcgtcgagctgaggcgaggggcgacgggagatggatcgcatctgacaggtgggtccaggggcaaaaatgtccatcaacatgtgaaaaataataaaaagggataaaaatagtgaaagtggtaccaaatctaacaattagagctaacaattagcagctctagtgatatattatagagggcatatggattaagtggtaaaaaaattgaggcgcacaaatttgatagtaaatagtctaaattctcccaaatcccaacctaatcctagaacatggtggccgcgcgtggggcaaggtagcaggctgtggcggcgagcaacagccggcgcccgtggctgggcggcggctggctaggctggccagcgaggatcgagagcagcaagcggaaagttttctgtaagctaattttagcctcatttcgcgttttatgtaggtagaacttgattgttaatggcaaactgaatcgatgctgccagccatcttcttttagagcaacaccaattactactagtatagtaattacagcatctgaccatagtgccgtaaagaccgctcaatatatagcagggaaactaactagcttgtgtcgacagaggacagagtagctagcttgtgtcgaacggtaatgtagcttcagtagaagccattctcagttcacctttttatgtggctatgagaatgagtgctgtccctttctcctttaaaccgatctccaaggtgaaagttccattaaaatccagtgtgtttgtgtggtgattgttgaggaagtgtatcctcaccacagatatcaagacaaagggatgacatgttggttcatcatttgtgtcaaattttattgaaattatgtagaattctgccaatttttttttcatatttgtcaaatttcatgtcaattgaattctgtgaaaatcaggttgaaattgggcaagtttcatgtcaatgtactttgatatcaaaataggggggatgcaacatatgtacaaaattaggggcaagtatgcaacaataatcaaggctatacatgtttttttaccatagacttaacactgtcaacaggagttaacaacccagggtcaaatcgaagctttgattaaaaaaacaatggcaaaatcacaaaccctacaaaacatggggaaaatcacagggcctcatcttttagcttatgcttatacttatgagccaaaatttgaattttcaaccttaaatttggagttgattttgaggttttttcattaaagtttatttttcagcctttacttttagattgctaagaacacgtatataaaagttttattcacaaattacttttcgtttgcaaatatgccatttcgaataagcgaaacgatggctctaacaatcgtgtggggaagtaggcgcaagaacacaattgccacatatcgtaaatatcaaatggatttcaactgcacggtgtgtgctatgtatcagtctgcatgagcgtaagatatttgcgaaaaggtgccccagtcccagtctgtgtagtacagtgcatgtcaaaggagggagtttaccaccagtcccaatgtgtgtactacagtgcatgtcaaaggagggagtttacctcccaaaatcttccaatcaggcatagtttggtcattagctagatacttacttttctattacattgtatatataagtaaaacaaaagaactcaattattgtctcacatacttgtttagtttctgcagagaaaacccagagctggattatggacagagcaggcctacaggcataagctcacaacatcaagcaacaatagtgcaactgtgcaaccaataattgcaccttatgatggagacattccacagccttgctgtgagggtccctatgtgacacaaaatatccaaaagcatgcagtgaagtcaaagtcaatagacttgttttttaagggaaggattattttttttggcctcaatagaagtgtgttaggtaaggctgccaacaagccaatggataactctaagcttttaagaggtttgattgattcaattgttcagcacagctttgctggtctgttgcttcacatcaataattgtcatccatggctacgagcatgctgcttgggcctctcatcgccttggtcaatcggcaggtctccaattacctgttgcaacagtaccaagagctggatggtatggaggagcagctcacaattctggagcgcaaactgccggccatattggatgtcatcattgatgctgaggagcaaggaactcaccgtcctggggtaagtgcttggctcaaagcactcaaggctgttgcttacaaagctaatgacatatttgatgagttcaagt

SEQ ID NO: 8545 - DNA, 1003 bp, Oryza sativa
acacgtgatcaaggggtagctcagctaatgggaacaactaaagcccatcaattggtaagaatggaaaaagaggatttgcttgcaatttttgaaaaaagagcaatccgttttgatgagcagaaacctgatgagctggttcaaattggctgggagattatggacagatgtcacgggtcccctttagatgcaaaagccttgggttcaatgttaagcacacggaaagctgtagaagaatggagggccgtattaaccaaaagtagcatctgtgatgacgagaatggaattttacctatactgaagctcagctatgatgatctgccatcatacatgaagcaatgttttgctttttgtgcgatctttcccaaaaactatgtgattgatgtggaaatgctgatattgctctggatggcgaatgattttatcccatctgaagaagcaattcgcccagaaacaaaaggcaagcagattttcaatgagcttgcttcaaggtcattctttcaggatgtcaaggaggtacctttacacaaggatgaagtggacatagttaccgaactatatgtagcatccatgatctcatgcatgatgttgctgtttctgttattggaaaagaatgttttactatagctgagggtcacaattacattgagtttttgccaaatactgttcgtcatttgttcttgtgctctgatcgtccagaaaccctttcagatgtttcactaaagcagagatgtcaaggtatgcaaacacttttgtgcattatgaatactagcaattcttcgttacattatttatcaaaatgccattctcttcgagcattacgcctctattaccataacttgggtggacttcagataagagtgaagcacttgaagcacctcaggtttcttgatctctctggcaattgtcatatcaagtcacttcctgaagaaatatgcattttgtataatctacaaacattaaatcttccgggttgtatatctcttggtcaccttcctaaggatat

SEQ ID NO: 8546 - DNA, 489 bp, Oryza sativa
acgaaagatcttttctttactcccggttgttctcaacaaccggtactaaagatatctttagtcccggttgttctcaataaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctccttcgcagccgccgtatctctggggtgagagccgccgccgccagatctcccttcatctcgatctctccgatctcgatctctctccgtcgcgccgaccgccactagacgccgcgccacgacgacgacgcgccacgccgacgccgtgccaagccgccgccggcacgccacgccgccgtcttcgccgccgcgcgcgcaatgccgccgccggcacgc

SEQ ID NO: 8547 - DNA, 207 bp, Oryza sativa
gtgtacctaagaccactggtcgaagatcttaaacagttgtggaagatggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagt

SEQ ID NO: 8548 - DNA, 16412 bp, Oryza sativa
cgcgagccaaatgtcggacggaatcctaaaattatcttataatattacacgttttaatttagtttatgactaaacaattaaatataatgtacgtctaaaattcctagcgattaagtccgaatttctaccgtgaatcgatttcttatagagattatccaaaaatgatccataatagtctataacgattcatctatttgataattatgtctaaattactacggcgaattgatttcccatagaaactaccaagaataatccataattaaattttgcaattctacggctataattaatctataatgaaattctaattattttaaattttctaaacttacccaaactccctctaatttcctatttatttccttttctttttctccctttcctttttcttttcttttctcttttcccctttctttttcttttttttttcctttctctttttctctttttcctttctttcctccctcccggcttcctccttccttcctctccttttcctccctcggcctctctctttctctctcggctcggcgacaaaagaaagaagggggggggggggggggcagcggctcaccgacggcggcaacggcaacggcggcggcggcaacaacggcccacggtgcggcacactggggcggcggcacgggggcacaaacgcggcggcacaacagcacaagggcggcggcccggcggcttggaggcggcggcccggtattgtgggtaaaggaaaggggtggaaatggaggggaagagggggaaatagtgaggcttatataggggaggggaaaagctaaggggggggggaggggagaagggagacgcgacggcgacgcggggcgcgaggtgggggcgcgcggcgcgaggcgacgcgacggttgcggcgacgcgacggcgggcggcacgaggcgcgagacgacggcgacccgcggcgatggcgacggcgacattggcgcggcgcggcagaggcgaggcgacggcgatgggaacggctcggcagcggcggcgcgcggctcggagcgacgatgggacgcgcgcggcgatgggacggtcgcgcggcgacgtcgacgcgcggtgacggctcacagcagcggcgcgggacgcgaggcggcaggctcgcgtcgcggtgatggaacgggcgagcggcgcgcgggcgcgaggcgcgaggcgacgcgacggccgaacggtgacggcgcgtggcgatggaacgggcggcgcggcgcggtaacagcggcggcacggggctcgggggagcggcgtggcacggggtgcgaggcgacgacggcgacggctcggcagtggcgacgagacggtgcgcggcgcgatgggacggcgacgcggtggcgatgggcgacgcgacggcgatgcgacggcacggggctcggggcggccgggcgcgcggcgcgcggggcagaggagggggctgggctaggggagaggtgggagagaaggggaaaggctagggaccacattgaacaccttgcgggcaatgaatagtgcactttcctaatattcccgattttaggttattttcaaaataaatttgatttcataatttctaaatcttgtataaatgaagtacatcccacatttgtgttatcctaactaaaatcctccttaatttaatatcactcatattctgtttatataatttattttaattagggttattccatcgcactaaaatttaattattgctaatatggttgcgataatattttatttatttccaaacccacctaacctttattttaattatattttaattatttatttagtcaactagattttcttttatggtttgttcctagctagttattcattattcgcgattaatagactccgacatcaaaatccaatgaaacaggcaaataaagtcagcatgatgcaattggtttaaaaagtttttgaaagtccgcatttttagagttttgattttgttggtcgaattttcagggtgttacaaacctaccccccttaaataaatctcgtcccgagattttcttaccaattgccgaatagatgcgggtactccgtcctcaagaattcttcgccttcccaggtggcttcatcctcggtgtgattactccattgtaccttgtacatacgccacactttgctcctagtcctcctttctgcttcatccaatatccggatcgggtgttctggatatgtgagatcattgctaatgtgaatctcttccagcggagcttgttcttcagacactcgtaagcatttctttaattgggacacatggaagacggggtgcacatcggcgatatattctggtagctgtaactgatatgcgacttctcctcgcctggcgatgatctggaatggccccacatatcttggtgccagttttcctttaaccttaaacctttttgttcccctcatcggagaaacctttagataaatgtaatctccttccttaaattccaggtttcttcttcgagtatcggcgtaactcttttgtcgtgattgtgctacttttagacgatcacggaccaagcgaatcttttcttcggcttcttgaataatgtcaggtccaaataccgcccgttctccagtctcggaccacattagcggggtacgacatcgtcgaccaaacaatgcctcattgggtgacatctttaggcttgcttgaaagctgttgttgtaagagaattcggcgtagggcaaacacctctcccagtccttgctaaaatccagagcacaagccctcagcatgtcctccaggacctggttggttctctccgtctggccatctgtctgtggatgataagcggtgctaaatgcgaggtaacttcccagggcttcatggactttctcccagaaatgtgaggtaaattgtgtgcctcgatcagatataatcttcttaggtataccatgaagacacactatcctggtcatgtacaactcggcgagttttgcactgctatagtttgtcttgacggggatgaatcttgccgtcttggtgagtcgatccacgattacccaaatggaatcatatcctgttgcggttttgggcaatccaacaataaaatccatgcctatctcatcccatttccattcgggaatcctgagaggttgcaacaaacctgccggcctctggtgttcagccttcaccttttggcatacgtcgcaaagtgctacgtattcggccacgtctctcttcatgttgggccaccagtagcccaccttcaaatcctggtacattttggtacttccggggtgtaatgagtatgccgactcgtgagcttcctttaaaattaatcccctcagtccaccctgttcgggtatgtaaattctctttttataccatagaacgtcttttccgtcggttgaaaattcttttgcacgtcctgcagctaagcgttccttcacctctcggacctcctcgttgtccttctgggcttcttctatttgggctctcaaaagaggttgaatgtccagggtgtttatctgtccatgaggcactatatgtaggttcagctgagctatttccttcctaagctcagggaccatcccttccattctcagatgattgcaatggctctttcgactcagagcgtcggctacaacgtttgctttgcctgggtgatagtgaacctctaaatcatagtccttgattaattctaaccatcgtctttgcctcaagttgagatctgactgggtgaagatatactttagactcttgtggtcagtgtagatatcgcaatggtttccaattagataatgtctccaaatctttagcgtatgaaccacagttgcgagttctaggtcatgggtagggtagttttcttcatatggtcgcaattgtcgcgacgcataggccacaacttttccctcctgcatcagtactcctcctagtccttgccttgacgcatcacaatatataacaaagtctttcctgatgtcgggaagaactaaaataggtgccgaggtcagtttttctttgagctgctcaaagctttcctgacactgttctgaccatacaaacttcttttccttcttaagtagttgtgtcattggtcgggctatcttagagaacccttcaatgaaccttcggtagtatccggccaagcctaggaaactccgaatttcggtcaccgacttgggtgctttccattctgtaacggcctctacttttgcagggtccactgctactccaccggctgagattacgtgacccagaaaagcgacttccttcaaccaaaattcgcacttgctgaattttgcgtataacttgtgctttcggagtttctggagcaccaatcgtaagtgttccgcatgttcttcctcgtctttggagtagactagaatgtcatcaatgaatactaccacaaacttatctaaataatccatgaatactttgttcataagattcatgaagtaggctggggcattggttagaccaaacgacatcactgtgaactcatacaatccatagcgtgttgaaaacgctgtcttggggatatcttcggttctaatcttcagttggtggtatcctgatcgaaggtcgatctttgaaaacaccttagctcccttgagttgatcgaaaagatcatcaatccttggtagtgggtacttgttcttaatagttacttcattcaatgatcggtagtccacacacattctcatgctaccatccttcttcttgacgaatagcactggagctccccaaggtgacgaactgggcgtacaaatcccttttcttgcaactccctgatttgctttttaagttcttctaactcattgaccggcatccgatatggtctcttggatatgggggcagttccgggtatcaggtcaataataaactctatgtcacgatctggtggcattccaggtaaatcttctggaaacacgtcaggaaatcgctgcactacgggcattccctttaggggtagcatggtaaatatacctccggcacgttcggttagcctaggatcttgatccatggttgctcgcatatccgatccccagggtgtggtcagggtaacttctctacgtccacagtcaattactcctctatgctttgctaaccaatccatacccaaaatgacatcaagagtttggggtattagtaccataagattggagggaaataccacatcctaaggcggatgggtacgtcaatgcaagctgtatccaccgctatctcacccccaggtgaatgtactaacattggttgtcttaatttaactctggttaaattgtgttgttgacttgctttcaaagatataaatgaatgcgatgctcctgaatcgaagagaactttaactggagtggagttgagtgaaaacatacccatcagtacgccttgatcttcctgggcctcttcagctcgaacgtggttcacttgcccgcgtccaaagccggtagcggtcctgttagtctgcggggtcctgaatagacctcgtccagtagcaggggtggcggtcccgtgaatagccgtcgcattagctccggtgcgaatgggtgtcttgtttggatgaggacatttattggcgaaatgcccatactctccacagttgaaacagcttcctggccttactgatcctgtggcggcctgattcggtgcaggagcgcggttctgaatggtaaccggcctgtggaaattgctggaggcggcaggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtattaattaagcaatattaatccaacgctatacaacataccctgttgtatgggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaattgaattatgacgcaataatgaattatttttgaaaaggaaaaggggatttattgcgtcagcaactagggtttgggtggaccgggcgcatgggcggcggttcacacgaacggacggccgagattgatccgatccaaatcggacggccgagatcgatcgggtccacggcggttcacggcgaacggccttgatgacgccagcaatgacgtcaccgacggcggcggcggcttggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcgggaaccttcgggtcgacgacggcgaagctgctccggtgatctccggcgacggcgaaggggcggacgaggacggcgacgacttggcgagcacgacggcggtcttcccgagcgacggcgacggctggaacgacggtggcgcacggctggagcggcggcggcgacggcaaagctagggcacacggcgctagagctcttccggcgacgagaggcgaaggcgagggtggcgacgggtagaggagacaccgggggtccttttaaaggggctcggaggcggcggcgaaggcccacggcgacggcaacggcgaaggaaaccttcgggaaggacgaatccgagacgaactcgaatccaactcattccaaaccgattgagccaaagattccaaaggagaaaaggtagaggagatcccggagatcatttcccctctattgattcggccggagaaggaaaggaacggccggatttggaaggaaacagcggcggcggctcggcggcggcgcgctagggttccggcccgaggaagacgacgggcctgacaggtggaccccacctgtcagcggccgaacgcgcgcgcgcgcggctgcggactgggccggctgggccgaggagagaggaaagagattttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaaattagatcttctcttcaagacttttaaaataaattctagaaattccatttaaacaacaatttatatattttgaattttcagggtgtgacacaggtcgactggttgtcaccactgttggtctccatgccaaggaggttgtccctttaggacgctggggtgcggtctgaggcgggcggttcatggcaagcctccttttacgattgtgctccatgaccttccggtcgttctccaacctaacgaccttattgattaaactctggaaactatcgtggtcttgtccaatcatgggcccgcgtaactcgtcattcaagccttcaatgaatttgtcaatcttttcctcttcgtcggcaagatctccagttgcgtagcgcgccagctgagtgaaacggttcaagtactcttgcactgtggtattcccttgccgtaatctcttgaactcattcttcttcatcctcatcaccgcggcaggcacgaagttgtcacggaaggctgtggtaaattcctcccagtttggttctccagcatcttcttcccgggcttctttgtacgtgtcccaccagtctccggctggtccttccaattggtttgccgcaaagatcactttatcggcctcacgtactcgaacaagagttagcttcttctcaatgaccctcaaccaatcttcagcatccataggttcttcagctgtggcgaatgtgggtggcttggtcctcatgaactctccaaagcttgaccccccgcggttgccttggttgttcgcgatagcttgcagaagttgagtttgggtggccataaccccagccagagtggttaggtcaggtgtctgagtttcgtcgttgctggttgttgcccgacgacggcttgccatctgtgtaggttgatggggtaagtatcctaattttctaactagctcctatggctttatcctattaagggagttgtgttgatatgaactttgttttgcaagcatggtggaataaactcatttaaaacacaacaacaatggataccataaataacatcacagagtttcacaaatgatacatgaatcatgatgcaatcgactgcgtacatatgcagtccaaataaagttcatccagaagatacaacgaactaatcattaaactactcgacaatctaggtaagggagggggtgtctcgcatactatccaaaaaccatctgatacgagagcgaagctgcaaggagtccgtcagtctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgagggcctccaaggaaggtgatgcggggaacaggagcctcatcctctgaaggatcagtgatgtctggctcgatctccggctcagtgtcggtcccctctatctcggagtcgatctggatcggagtctccaaaccggaacccagctgcggagaaggtgtggggatcagtgaagtgtgcaccaactccggaacaggtggcggtgccgctgtaggatccactaggtagggtgctgactcggtagctagcatactagcctctcccagaagagcgtggaatgctggtgggtacggcggggtgaggaagaagtagcggtcacggcctactgctgtggaagtagaagcccctgtagtgctgatcttggctgctcaaagctgctcctccagctggctgatgtgctcctgactctctctcagctgctcctccagagtatccatcatcccgcggcgatcgttgtactggtcagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaatagagcctcctcgtagtagtcatctactgcctcagcccatcgtgacaaccgagtcactatcgggttgtagcagcagggcgtgtcctgaactgtgcaaactgagttgccctcctcccggaacgggtgatgagcaaactcggtactcactaactcagctcggtggatagagctgagtcggagaaaggcctcccgagcagcatcctgcatcgcggtctctggcaggtctcggtggtgacgtgtctgaaagctgtagtccaactcggaagggactcgggggtgaatctcgacccgagcctcccaaactgggccacactgcctcactcggtatgacggaaaaccagggtatcgcagacgcctcaacatccgatgcagctcaatgacatacccctccgattggggtaagctcaactcccaggtagcgggtgaatccgaatctgccatctaattttaagaaaaaccccaaagtcagttgagagtaaaacttgttttgtaaagaaaatagttaagagtaagatgaaaattgtgtcgagttttgtaaacatagcgtttttatttttgaaagtattactaaatgggaatttctcccttggccaacttagaaaaagggtggggcgccttttggtcttttcctacagtcgtatggctctgataccagctctgtagacccccgtttttatagcaggaatcactcgtgtaaactgtaccatttccctggatcaagtagtctggtacacactaattcataactggaataccaatgctcatacacgagagtctagtacgaattattacaacataagcccgcaggcattgtcttaaatcatcagaccgagcggtctggaatacaaccaaaagcagagtttagataaggcagcggaattttaggcagcggcatgccattgccacaggcaacgaccgtactaagacctactggacgccatcatcttcgtctccctcctggtagtaggcataaggatcttccgtggcttcatctcccgcttctgattaattttataattgcaagggtgagtaccaaccgtactcagcaagccaccacagcaatgatgcacatgacaggggaattcaaaggatggctatggttcttttgcacaaagcaagttttgtaattcttttcacaagcctaagacctagcatagactgatcaagttttaataccagtattcatattaaacaatgacggttctgtccaccatccattgtgatcccaaggatagcttcccgccattgagtcgttatggttttctaaggatgtccatattcccacctctcaggaaatggctccatcagcataaaaatcatcatgcaatatcccatcccatacaagttaagaatttagagtctagccaagtgtaatatatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgttcatgtttctagcagtgagaggagttctggcgctcccgggaaagagaagtctcacacacatattaaattatggttcaagttaagttctccctctcacacactcatggcagtcctaccaatggcgacaccgatgtagggcacgcctctcggccctacctcaacggctgtcccatcgtagcgcacctgcctcactcaggggtgaaccatctacgcagagatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtatttgcccaagcatatagcatttgataaatatgagtatgcatgattctagaatagcatttctaagcaattgtcataattgactagggactcatacttaatcatgggtacaaggattttaagggtaaacaataatcaaggcatggcataatcacaagtaggatgttcataattgcatgcaaattttatttgtaaacaaaacaatttcgcaattaggatcaacatgttcaacgaatagtgatgacttgccttgctcaaagtcttgcgggtcttggccttcgcttggatctgcaactccctcgggctctatagttacgtgcaagaattgatttgaattcagttagaattcaaataaaaatccaaacaaatccaaataaaagttgcatgcgaaagtcgattcttttatattaactttactattcgcgaactacggcaaacccaatttcgatttaaactgttttgcgggtataatattttgttgtcataagttttttttaatttaatttacccgagcattatacccatatattagattagaaatttcttctcgcgagccaaatgtcggacggaatcctaaaattatcttataatattacacgttttaatttagtttatgactaaacaattaaatataatgtacatctaaaattcctagcgattaagtccgaatttctaccgtgaatcgatttcttatagagattatccaaaaatgatccataatagtctataacgattcatctaattgataattatgtctaaattactacggcgaattgatttcccatagaaactaccaagaataatccataattaaattttgcaattctacggctataattaatctataatgaaattctaattattttaaattttctaaacttacccaaactccctctaatttcctatttatttccttttctttttctccctttcctttttcttttcttttctcttttcccctttctttttcttttttttttcctttctctttttctctttttcctttctttcctccctctcggcttcctccttccttcctctccttttcctcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgatgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccaccagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgtgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatacatacatatatatatatatatatatatatatatatatatatatatatatattgcatttcacgttaacgttcgtcctcgttcgttcgctcgttcacgttccctagctcgttcacgttcgttcgcttgttctcattcacgttcgttccctcgttctcgcttgtcttcgttcgatcgttctcgttctcgctctcgttcgttcgatcgatctcatgctcgttcgttaacggcggtgtggcggcatcggggcagcg

SEQ ID NO: 8549 - DNA, 1898 bp, Oryza sativa
actgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacataattacggcacgtactttctcctcactattgttccctccttgtgatcggtgcgtgagtaaggggtgtcttcatttgataggaggatgctagggtcaatcgtcaccgtgaaagggggttgcccatccaactgatcggtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgttgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttccctctggacgagcacggttacgaacatacttcttcagaacgcccatgtacctctcgaaaggaaacatgttgtgtagctacatagg

SEQ ID NO: 8550 - DNA, 22137 bp, Oryza sativa
  unsure (1)..(22137): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggcaagcaatcccagctctagtagcatatcggaaggagtggatatgaagtcacctcgaaccacttgagaatctcctcgtaaaccgcaccgtggaatggtagattttggagagagaaaaacgagttgccattgttaattcctcgagaacaaaagttctagttgactcgcttgacaatttttctctctacaattcgatactacctgcagattggccatgaaccaatcctcagcagtatcataacctgctaaactagatttgcaacaaggatgcaacaggagagggggaaaaaagagtagttactaatctggaaacaaacgaatggagtagtagtaattaggagaagaactcgtgaaaatcaaaagaacagacaggtagtagtagcatatcatccttgaacgaatgacaaatctaatccatcagtttatacacgacttaattcataataatataagaatccaatcgcaatatacagggggcacacatcttcttctcagttctcactcgattcgattcgtgggcaccgacccagaccaattctttcacggttaaaacagcgacaaggaaacgaaagaaaagggggggaaaaagaaaaagaaaaagtagaagacgaggcaaacgaactttgaataatcccggtttgagcagagcagcgggtggtggcggaggtgggttagccgcggcagcgggtgatggcggagcagccgcgggagtaggggttggcctggccgccagggcggcagttgtagtaggaggcgccgcggacggagcacggcgtggtgtcgcgccgcagcgcgccgtagctgatgtacccctgcccctgcagcacccgcctcaccaccgcggcgccgtcggccgccgcatcctcggaggagaacccgaagctgtcctcctcgccgccgccgccgccgccgccgaccccgagctcccaggcgagcggcacctcccccgccgccgccgctcccccggccaccgccaggagcagcgccagcagcagcgcggacgccgccagtagggatttcgccattggctccttcggattcggtcgcctcttgccctgcctgcctttggtgtttgcttgctcggtggtggtggtggtgggtggtttaagcgttaatggtggtggtggtggtcgccgggcggcgcgcgggtggtgggtttattataggagagagagagacagagagagagacattgagaatagtagaggaggaatgcgcgtgaagaggggagcgctgcggcgtggggcccaagtgcccaaccgagttgcgtgcaccgcgtcgcgttaggtttggagtcggagccgcgggagggatacggtatttggcgaaaatatacagaaaccaatggcatgtgtttggcacagctcaaaaagctcagctaaacggtctctagctccaacaaaaataaaatcagagttgggtagagctatctcacgaaattaactagaaagttagattttgatttagtctgcttcataactccactccagacccaactcgtagagctaaatttaggagttggagctctaccaaacatatcctaaataaatgttcttaggttcgttcatgttatcacgagtaaaattttttttctcatagatatagttaaacttttactcatagtgacgtagaataatcttaaacgtttattttttttatccaacaataattatcaggttttcagtatatatatatatatatatatatatatatatgtgatttgcactgcatagtattttctctggtatttgtgggtcgcgtcaggctgacctggctctggctgagtactgcggcaacggcaagcggcagcaataatgcctgcagggcagacgcagcgatcatgccggcagcgcagacgcagcggccggtggttcgccgccgatgaccatggtctcagaacactcttcgtggtggaaaaattgaaggaaaaaaaacatataattaagcacggtggttcaatccggagacggagactccggttgctagttgttggttggatgatcgatgaacgatgatcttgccgttccactggccgcggctgcggctgcggctgacgaggggcttgctgctctggtctgtcagcttcgcacattcgcatcgcgcgcgcgcgcacacggtcacctccgcccacatcgcccgtcccgaccaagactagtggaagtgtgcagcttgcttccttccgatagccgctctcatcggatctctcgcatcattcagcaggaggcgtacgtaccagtgcatcattgcactgacttctaactaacccgatggtgtggacagtgcctgtcgagaaaaaaaaataaaaggttaaaataacagaattgttcacaaatataaataggagtacaaaacatttttgctctctatttgttcacagacataaatgacttttaagtagtactacttatttcatccatcaccttctatttttctttctcatcttatctcaattaccctatatccccacctctctttttttttctttatccttaatctctccagatatactaggagtgattgagagaagggaaaagaaaaaaaattaaaaagatacgtaaaatgaggtgagtcataagcacatgattaactgagtattgatcattttaaaatttaaaaagaattagtatgatttttaaagaaatttttctataaaacattttttttaaaaaaaaacactgtttagcaattttcaaaaagtgtgagcataaaaaaaaagaaaaatcttctccatttccatcctaaacaaacattatgttaaaaagacttttatatatatatatatagagcgagtatagcttataggagaaacgcaataactactacttactactacccctacatttcatattgtaagacttttaagactcacctagattaatccattgatcaatatacatgttttctatatgtgtctagattcattaacatttatatgaatttggataatgctagaaagtcttacattgtggaacggaggaagtatctaaaaacttagtctctttcctctccgtctctcgcggcgggtagtcaccagcaagggtagaggagggtgattttccagggagccatcagatccctatagtcgagttcatcctattttaaattgagtttatctcatattatgacgtcctctttccatttcctgtatagttcagtggagatgtcaacatccatattctttgtcttagccgcctccttccatggtcagcctgagctctaaagacagagcttgctttaccttctctgccttacgccatctagatggctaatacgaggttattcactggtgtttgggtcgacaagtgcagcagatttgcctagtggtgggaggtcttcttcctccacaaggacgagatggtgctggccattcaaatcctctgacgagtttgatgctgccaattcggtgtccttctttgtctccgaccgagcattttcaaggttagactgaagcttgttttgttcattgggttcacttcaacctccacttatgagatgcccttgttgaatttgcagcttgatggtagttaaccttgtccttgctgtcacacgagttcatcgtcggacgagagatcatcagtgctcctctcgacaacgcgaactcgctttccttttttgagggccacctgtttcgccaaagcttgtttttatgacctagcactcccccaatgtattgtgtattgggcaccattgtagtactggtttgtcgccttgaagagctgggcgctttgggggtgggttcgcttgtacttcaatctacgccttacgctttcttttctttttgcgattttgtttctttttcttgctagactccagtgcgtccttcttggccgacgactgtttctgctcggccaccttgccctttccatctttccacctgagagcgtctgcgtgattaaccattagtcgaaacttaaaattctgtgctcataaggatccaagcccaaatacaacctatacttggtgccattcatgcgggggttattaatgccgccgatccccagctcccgctcccgctcccagctggccggcgcctggcccgcccccgcggccagcgcgaggacgcacgccgcggctacggcggccacggtcgcggctcttgccatggcgcgcctgtctgcctcttcccgcgtcttcccggctgcagctatagcgtacgtaatgctctctttgtttgacgtttgtagtacaagtgagtggcaggtttcacatgatgtgttcaatagaatggttgtaagtgacagtaagttacacatttattttgggggtagcatctagcatgctgcatggttacatataagcatctaggtgtggattcagacattcagtgctgtcccttcttatcatttttattttacagcattggcgttacttcgtggagcacaatttagtttgatgaattatgaatgcttttgttggttttccttacttttgggtagatcaaatgcattttgatcttgatatgtgtacattttccggtagctcgattccatttgatgtttgtatggtcacttttggagtagctacagtaggagctaggattttggagttgtcaaatctgaagccaagtgagttagcatggatgaaaatacatgagcaacaactattcttggatctgtttttctatatataaaaaatacggtataccaaaccatgcgtcaattttctgcccatatattaaaacttacatatcaaatctttattgttacatataactaattttgtgcaactgaagatgcatggcgaggttgtcctcaatgagaggatacatgacaaggtttgcaatgagcaatttattcctgaagaacatactaatggggtgaaaattgatttgggaatttagatggttttgttgtgttgtctccgtttgcttctgtagttgttgcttccattcagtttgcaatggcatcaattggtttgtactgaaattctgttactagacttaatttcttggtgacatgcagctaactaatgccagtgagtattgttcttgttatgcttgcatgaaagcaataaatggatatattcataaataaactccatgtgtatgtaatcgtttttttttggacacatgtgtatgtagtctaaacctcgctatatgcaatgaatgcaagcagccatgctttagacaatgcttttcatttttttctttttgatcgagagcatgtacatatttggtgcaatgttaaccaaaagcctattttttggctttacatttttggacaaaaggcattacgcccggctttactgaaagcttaaattggtgatgcagaaaagtacagagaaaatgctgggttttccatcttaacctgcaggctcaaaacaaaataaaaccaactgctttaattagaacaccacacatccagaccacaccacctgaaaactacaggcaagcagcgacagaagacaagctacaggaggtgcttggacaaaagcataacactactgaaaaccaacaaaaacaaaaacaaaaccaaagactgaaaaaatgtaatatgaccactatggaaaaccgtatagaatggcgtgcaaatctgaacggttgctctgatcagtgatcactttctggtgaggctttattgactatagatgttatccttgagagccaatatttcaagcaaatctgacttgctctctctataatatttattccacaattgttccatttgattttctctcagcaaatctggactgcagatttgaacaaacccaagcaaaatcaatgaaataatcatttagcaatatggtcattttgcttgatactatcgcaaagatcacaatggtagaaaatagcccggacatcattttaacaaacgatatttcttgggggaaaaaagagagataattttaacaagcgaccgtgtttttcgattggcacattttaaaatgttactttcctgatcttcccttgttaatatcatgcatgctagctactacaaccaacaagaaagcaaggagagaaatggactatttggaacaagaagtaataattcacaaaggacaggacagctaatcatccatgaatgatgaattgatgaatccatccatcaaattaggagaatacacgatttatttataattgatacagagtaggagtaccggacacatgtacagtgtacatctctcttgactttagattagcgggcaccaatccctaccaattcgttcacatttcaaaaggagacgaacaataaaagaagacaaaaataaacaaaatatgtatagagtagacgagacgaactttgaatcacaaatcccaatttcaacagttttggtggtggcagctggatggatggatcatcccctgcactgggtgatggcggagcagccgcgggagtaggggttggcctccgcgccgggctggcagttgtagtaggacgcgccgcgcacggagcacggcgtcgtgtcgcgccgcagcgcgccgtagctgatgtagctcccctgctgcagcacccgccgcaccaccgcggtggcgctgtccgccgcctcctcacccgggaagccgaacgcgtcgtcggcgccgacaaccccgagctcccagctcagcggcacctcgcccggcgccgcgtcggctcccccggtggccagcgcgatgagcagcgccagcagcagcagcgcgggcgccgccacgatggcgggtctcgccatggcgctcgacgcggaggaggaggaagaggaggagggaggaggaggaggaggaggaattggttgcttgctttggtcgacgtcgcgcgcgtcgtaatggtggtggtggtcgccggccgccgggtttaattataggagacagaggaagggggttggcggggttgtttggaggctgaaaatttcaatcaatattctaataatatactctatacaactatataagaaatggtaaggtaacgcaaaattgaagcaatcaagacactcttttataatctcaacatgtctaactattacccttttctctctctctcttattctcccgatgccaatttaaaccataaaattatggatgaatagcaaatgtggtactccaagtttcatctcagactcagtttagtccttaatcttttagtctatccatgctataccttcaaattttcattttagttcaaatttatttttaaatccacttagaaaccacatagctaaacatagtcttttttcattgaaatttgcatgcaatgaatttgtttatagataatgcatagtagtttatgtaaaatgaaaataagtacgtgcttccaagtgtatatatgatagccattaagctcaacctttatgtgcacatgttgaaataataggaagtacatctgcagtgctatttattcatattgtttatctcttttctaatgtatgcatattaagggcaaagggaaaattttctaatagaaacgttgactagaaatatccatgtggcatattaagtgggtccaagaataattttaaaccaaaataaatacttttaaaggatttatatgtacaaaataaaacctgaaggactaactttagcgtctggtaaaacttgagggactagattggctattcaccctcaaattattatcaaagaatggttgacacttgacaatttcaatatttttcaattatcaaagagaactaatgaaatattaaatgagaattataaaaaagattcaatatagtggtctgtgtgcttctctcgccggcaaacaataattttcttttctgctcggacgacaaaagttggaagtccagatagcatgtgcctcgtcgacttgagagttgatagccaaactaaagtatagccataggtgtgagtgtgaaacctatctgacaatgcaggctttgtcctcatgtttgtttttttaagaaaagaaaaggaagatgaagaaagaaacaaatgtaagccctatgtaacacaagtcgtcctccaagttgcacatcacgttgccaccattgactcggtctcttttatatttgcttcgtcgtatatatcgctgcaatgcaattatgcaattgtaaaaacaaattaatatgatatgatttgcactacagggcaggcgtgcaatggggattgggagtgactgcaactttggcagtagccacggatccaccatccaacaggtaaggaacgtacaggattaactgtctatgctccctccttttagctatttaaacatgaaatgttttctccttttctttatctcaactttctcaagtttgagaggaatcaaatgtagtttataaacaaaatacacacatacttcacttcaataatattttgcacaattgtacatggcactgataaatgagctagtgagtttaacttctccccgtgtttgggaataatgcatccactaagtcaaaaaaaaaaactaagctactactccaaaatcttcacgtaaatcagtgtgaagcttctattgataacttgtaaagaaaatgttccgttcggaaaaaaaaactttaaagaaaaacaacaggattaatgtttcttagttgaacagagcatgagtcacataataaatttaaaggagagttacatcaaaatacgagctctacttcaagcccttaaaataaatgccaagcttcttttaaacatctaaataagtagtattaaatttcttatcagatgaaaaataactgtgctagtatttcatgttcaaatagctaaatgaggaaggagacaatcaaatctgagcgttccttactagctggatggttgcattagttgctactgctaaagttgtagttactgtagtgactgcacctgattccaatccgtgcaatggattggacggacgggtcacacatctgcgtcctacaaggtttgttctgatttgctcaaatcaattaagcgacagttgagttcaagctaatgcatcttggcacattatttcctctttttttttctttttctggagcaacaaactcgctgatacaaacactggagctaccggtatactatatatagcgactgtccatgcatgatttgaaagaaaaaacaatagatatatatggctactaagaaataataattaatgtcgtgcaaaatgtgtgggacacaccgaggaaaggatgatgcatggtatattggtatcgatacacagtatggatttgattaaggataaacattcacctgaattagaatggaggcataaccctcgcatcaattgggggtacatagacctaatccttatttaatttatatatatacactttaaatactgcaaaaataattataaaaagctctcactcaattgcgtgtaataaccaaagtatactctatccgtcccaaaatataaaacctaggacatgatgggacattttcaagtactacgaatctagacggataggagcctaggttcttatattttgtgacggagggaatagcggtttactagatgccaataggatatgtataaaataactgaaaaaaagaagtaaaagagaaaacatacctgaaaatgacttaattactgttagaactgttctaattacagatctacgagacactccgttactccgtagaaacctatgaggttttttgaggaaaaataatgaaatttaggaataaaaaaaggatctgtctattaatacagaaataataaatctaaatttccgtaatgattatccataaatggatgaatgctaaagccatattattgattttttttcttataaatgtatcgccatatctttcataaaaagtattcagcatgtatttacattgtaagtccctaaattactgtcggtgacatgggatcgggagtatcatgactagaggcttgggcaggagcaatcacccacgtggcctgaccccctcggggggggaggggggtcgggcccgagggtggtatgaccgcccctctctttgtctccccgaggggtcggaccgctcccgtttcggccccgagggccgaggcgccccgaccccttgtgggttttgcgccgcgtgtatgagttaggtgggcacagcggggctcacctaaccgcatttattgcggtttggacgagcgcgtcacgctgcatgtaacgcagtgcagcgcactcgtttatccggtctgtgaccggtcacagaccggtcagatcgcgggttaggtggcaacaggcgatctgacacacgcctcgccccgtcccgtcaggatgagagcctccaggcactcgtccctagccggagccagcgtgctagctcctggagatggcacgttggtcccggtcagatatatgccaggcttcatcgcaaccattaaaagcaagacattgtatgaagaagggcgaacatgcagattggtaaactgacgcgtggtggacaagaacggtcatgatcccatgttgcacctgcttccggcggagtggaggtaggtatgggctgtcccatcagaaggatcactcggacagcaaccattgcaaatctccgcccatttatgaaggaaggacgggccaagttttaggaaaaagaggatgggtccccaccgaaaggagagataggtagaagtggtgcatgtggtatccccttgatatataaaaggaggaccttgcccacttagaggggggatccgaaaaaaagggaggaccaaaagacgagagctgggagagaaagaggaagagggtctctagagtttgaactctcttgctctccagctctttgtagcttcttcatacacagatccaccagaacacaggagtagggtattacgcttctcagcggcccgaacctgtatacatcgtccgtgtcttatgcgtttccactttcgcgaacattccacagattgagagcttagaacttcacttagcgtccccggccgaaccggcaaaggggggcctgcgcggtctcccggtgaggagccccacgctccgtcatctggcgcgccaggtagggggcgcgtgtgattttctaagccctcatactctttcgtgcgcgccaagcttttcctgttcagcccaatggccgagcaagcaaaggtgcgcaacctctctccgagtgttagcggtgacgacggggagccaaacccacgccgtcgagctcgtactccaccgccccctccgcgccaaagtcctaggcgggaggaggcgctggagaggatcgaaggatccgcgacttcgacatccacgggtgatggagaagagcggcgagatggggagcgtcgcctcctcgtctacggcgacgacagcacgccccagggcgcggtccaagctgcgggcgcgctcctacgtcacccgcccgtcgtccctgacccggagtctccagcccaacgttggctggacgacatggccaacttggtcatgatggcacggcagcgcctaggtgttggtgggcggtcctccgctaccaagacctatggcgctgctaccaccggttccgtgtcgtcaaggcggagggcgcggcgagcggcggctattgctcgccattcggccgccactccctcgtcagcacctccgacccgggaagatcagcgtggggggccaggtgcccgcatcggtatcgagcgccggcgtaatggtcgacgtgctgcccacgcaacggagggcgcctcctcgtccggagtgtcacctcaacacggacgcggggatcagccctccgtgcccccggttggtggtgttggctgtagagcctttatggcgagccttcggaacgtccgttggcccccaaggttccggcccaccatcaccgaaaaatatgacgggagcgtcaaccccgccgagtttctccaggtctacacgaccgggatcgaggccgccgggggtgatgacagggtcatggcgaatttctttcccatggccctgaagggacaggcgcggggttggctaatgaacttgccacccgcgtcggtccactcttgggaggatttgtgccagcagttcaccatgaactttcaaggcacatatccgcgcccaggtgaagaagcggacttgcacgcagtacagcgaagggatgatgagtcacttcgctcatacattcagcggttcagtcaagtccgcaacaccataccatgcatccctgcacacgcggtgatctacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgctgctcggacagggcggcgtgacaggaggaggaagaagaggtcagcccattccgacgacgagggtcatgtccttgccgttgagggcgctttgcgggccacccgaaaggggaggcctgcgagcgacaaaaagaaggaggccggcgctcccggtagggagcgtccgaccggcaagtggtgttctgtgcacaacacctccctccacgacctcgcggactgtcgcgcagtcaaaagtttggctgagcggacgaggaagtgggaggaggagaggaggcaggagcgccgagagggcaagtccccggcggttccctccggtaatcagcgaagtgaggccaagcagaaggcccccgccgaggacatcgatgacggcgatgatgacctgggttttcaggagcctggggccaccattgccactgtcgatgggggagcgtgtgctcacgtttctcgctggagcctcaaggccatgaagcgagagcttctggccgcggcccctactcatgaggcgacgcgtcgggcgcggtggtcggaggttgccctcacctttgaccagaccgaccacccaccatgtgttgcccggggaggacagatcgcgatggtggtttcccccaccgtttgcaacgtgaagttggggcgtgtcctcatagacgggagggggggggcagccctcaacatcctttcccccgcggcctttgacgccatcaaggctccggggatggtgctccggccgtcccagccgattatcggtgtgacgccggggcacacatggccgttaggtcatatcgacctactggtcaccttcggtggatccgccaacttccgcacagagcgggtgaacttcgatgtggcggacctcagtctgccctacaacgcggtcctagggaggcccgcgttggtgaagttcatggcggcggtccactatgcctacctccagatgaagatgccgggccccggtggccccatctctgtccatggcgacctcaaagtcgcgcttgcttgtatggagcagcgcgcggaccacctcgccgccgcggccaagcccgagggtggcgacgagaggctcgccacctccgtccccgccgccccgaggcagcgaatgatcacgtgcgacgaggtcccggtcaaggagattgccctgggcgacggcccgtccaagatcacacgaatcggtggtcttttggacagcaaataggaagacgcgctcgtctccttcctgcgggcaaacgctgacgtcttcgcatggagaccggcggacatgcccggggtccccagggaggtgattgagcaccgtctcgccgtgcggcctggcgcaaggccgatccggcagaaagtgcggcggcaggtcccggaacgtcaagccttcatccgcgaggaggtggcgcgacttctggaggccggattcatccgcgaggtcatccatccggagtggctggcgaacccggtggtcgttcccaaggcgaacggcaagcttcggatatgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgcactactcgaatttctttgggtagccaaataggacgtaatgctgaggcttatgtcgatgacttggttgtgaagacgcgcaaccaagagactttactttcggatctggcggaaactttcgagagtctccgctccacccgcataaagctgaaccccgataagtgtgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacctggacggaggaagctgaacgtgccctcactcagttgaaggcgtatctcagctctcccccagttctggtcgccccggagccagacgaacccttgctactctacttagcggcgaccccgcaagtagttagtgcggcgttggttgtggagcgcgatgaggacaatcctcattccgcgcatccccaccctatgctggcttggcccgggagagagcagggaggagaggcccccgagccgaacggtggcccaaggcccccgacgaccggggtaggccctctgcccgcttgtccgacgacgccaggagcccccgacccccaggacggccccgaggccactgtgggaaggccgcgcctgtcgtcctccgaccccgaggtcgtcggcacagaagacgagtgcgccccgcgaggccgcttggacgaagagcgcccctgggatgtggcccctggcgaagaggatcggccccaccgaaaggtgtagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccagatcttgcataatcgagagggtacaggacgggtggtgaaatgggcaatcgaactttctgagttcgatttgcattttgaaccacgccacgctatcaagagccaggccctcgccgattttgtggcagagtggaccccggctcccgagcccgtctcagtccccgaggccagctcaggcccctcgcagccgcctcacaccgcccactgggtgatgcagttcgacggctccctgtctcttcagggcgccggtgcgggagtcacgttgacctcgccgagcggagacatcctcagatacctggttcgtctcgactttcgggcgaccaataatatggcaaagtacgaggggctccttgcgggactcagggtggcagctggactggggatccgccgcctcctggtgttaggcgactcccagctggtcgttaaccaggtctgtaaggagtaccggtgctctgacccgcaaatggatgcttacgtacgccaagtacggcgtatgaagcgccatttcgacgggatagagcttcggcacgtacccagacgggataacacgattgccgacgaactctcacggctcgcttcctcgcgagcccagaccccaccgtgcgcctttgaagaaaggcttgcccagccgtcggcgcgacccaaccccctaggggagacggacgcgcctgaccggcccccgaggcccgtcggagtccaggcctcgggacccgaggggagcgctcctagctcccttagattgattgcttggatcgctgagatccaagcatacctcacagataagactctacccgaggaccgcgaagggagtgaacgcgtccagcgcatctccaaacgctacgtgctggtagaagggaccctctatcagcgcgcggctaatggaatcctcctgaagtgcattcctcgggaacaaggcgtcgagcttcttgccgatattcatgaaggcgagtgcggagcccactccgcctcgcgcaccttggttggcaaaacctttcgccagggtttctattggccgacagctctcaatgatgcggtcgacctggtccggcggtgtagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcaatcgacaagttcactaagtggcccgaggcttatccggtcgtcaagatcgataagcactccgcacttaagttcattaagggcattacagcccggtttggggtgcccaatcgtattattacgtataatggcacacaattcactagtgaacttttcggcgattactgcgaagacatgggtatcaagctctgcttcgcctcccctgcccaccccagaagcaatggccaagtggagcgcgccaatgcggaaatcctcagaggccttaaaaccaagaccttcaacatcctcaagaaacacggcgattcgtggatcgaggagttgccagcggtgctctgggcgaaccgaaccacaccaagccgagcaaccggggaaatgcttttcttcctcgtctatggcgcggaagcggttctcccatccgagctcaccctgaggtcccctcggaccaccatgtactgcgaggctgatcaagatcagcttcgcagagatgacctcgactacttggaagagcgaaggcggcgtgcggccctccgagccgcacgctaccagcagagcctacggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccctggccgggctccgttcggctggccacgggcgacggcacagagctgcctaacccgtggaacatcgaacaccttcgtcgcttctacccctaatggggttcgggtgtcaggtttcgggctcgggccaaccccgcactcccctcgggcgtgcagagttggccgggggctaccacacatgcatattcttatctctcttatatccgtatttcaataaaagcattttcgatttcctaaaggctgtgtctgtgctgttgtttccttttgaagaatcttgacttgaaataggtcactcgtgctcaatcctgccctcgggggctcgggtcggctaaaatcgccaaaaggggcccagaaccgagccgtgccccggggcgtggtgaactcgggggggggggggaatcggcaaaaacccacaatcgggtcacccataaccctcggtcaccacgctcctggcctggccagtctcgacatgtggatctccccaggcactagccccaacccgagccatttgaggactgggacctgggcacgagcccttgttcaagctaagacacaaaaggaccacggcacagatcatcctcgttctcatacacacagcaaagtgaaattgacacagaaatttctttattttgattgcagattaagttaatctatacaagaaggaggcccgaaggcctcggaagaaagaaaagaagaaaaaactatttaaatattggcgggggcctgggagctcactccgatgcactcgggtcgccagcctcgtcgccactgtcgcccacaccgccgtcatcgccctcctcgtctgagttgagggcgaacgcgagccgaggggccgaaccctcgaagctgtggacgatatggttggcggcgtcccggacctgcgcgcgcacgccgtcctcggtcccgggagggaactcgtccagcgccgtccatggggagaagtcggggtccctggcctggtagctcgccagtacgagctccaccgctcttcgggcgaggtccctcgaggatgacttaatcgtccgctcgagctcctcggggagccgttggagagtcccggccatctccgagaggcgctgggcgaggcccccctggttggcggcgtacttcgcagtccgcccgccccaaagacccgcctgtcgtccggcgcggtctaaacgggacacggcatcgcgaagcatgctgggccctatctcgcctgccaggcgaagggcctcgacctccccagtggacaaattcagcgcgccctgcagatccgcgatggtgtgttcggcagctgcgaggcgggcggctaagtcgctatcgcccgtggccgccccgccgctatgcgcccttgcatccagctcccttgcctgcgcctcgagttcagcggcccgctggttcagtgcggccctctcggcgcggacaccttccagatcgcgacgcgcttgttcctcttgcgcagcctcgcggagggacgtgctctccgccagcctttgcgctgtggcctcggcctcctcgagggctcgctcccgctcggtgagcgcatcctcacggacgcggagagcggactcttcttcggcacaggcggcttcgtgcgccgccagtgtgacctcccgaatggcaacggcggcctcgcggtctgccaggtccctctccacgacgcaggcgcgctcttccagcgccatggcacgggcctcaagggcttcttcgcgccgccgggacgccgtctcggtctccgtcgcccgccgttctcgggcagcggcagcatcaaggaccccccgggcggcgtcgagcttcttccctagctccgcctcccagctcccgtattgaaggtggaggtcgtcctgcacctcgttcattacggtagtggcgatgagggcagccccccgctcctcctccacctccctggcgatctcctccagcaccttccgacgggcctcaagctctgaggcgcgacggcggtgtgccttgcggcccacctccaccatggcctccaccgagcgtcgcccctcttcgacacgcgcccatgcggcgtcgagctccgcccgctctgcttgcagggcctccatctgggcacttaacccgtccaacatcgtggtgtttgcgacggccaaggcctgcagaaggggctctgcgctcagtggggcaacggaaggcatgggggagagccgccttggtgaagatgccgctcggctcggcccgccgatggacgtgccggactcagggacgtcccccggacctggcttgtcctgagtgtcgcccgagggagtgggcccaagcgatgcgtccgcggcctcgtcgcgagctgcctcggaagtcgtcgccgcctcggcctgacgaagtctggcctcctcccgagcggcttcttcagcctggcgagcctggacggcctcccgggcggcctcctcggcttccggtagacgatccgcggcttctcgacggtcagattcccgcctccgggcctccgcggtcgccgtatcctcggcctcagactggccggacttggaatggcgggagggacgcgacgagatctcgctgaagcagaagaaagaccagaagacaaacaagatgggtgagtgaaaactcgcgttaggagaatgaatatggccacaatgggcgtgggacgaacctgcgagggggtcggttaaacgaccactttggaggggaaatgaggtttccccgggatggttctgtccccccatcttgcggagccgcttcttcttccgctccccctcgggctgcggcgtcggcgcggccccctccgggcgcctgctgctgacacgcgccgccccgccccctcggggaggagatggggaggaggtaccctcctgcttcctcttccctcgggcgtcggcagggcggctgccccccgagcccccatcacggggcccggaagcacgaccccctcctggggtagattgttctcccctgcagctcccgcccgcgccatcatggcctcgaggagcccgctcctctgaggccccgaccgccatcatgatggtcaagatgttggcgcgatctggatcgctgcagagggggaggactccttgggggatgagggatgcctccacggagctgagattcagcacccgttggaccattaccttgaagtcttcagggacccagtcccatttgaccccccggtgggtcctcatacagtcctcggacccggtgtactcccaggcgccccgggcgcgccgctggagtggcgcgatccggcgacgaaggtagtcgccgtacaccatggcccctgtgagcccctgagatcgcaggcccgccaggcggtcgagaacggcgtcgtagccatctcccagatctaccggcgcccgccagctggaagcctgcaccgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcatcaccgcgttgggggtgaggtgcgccatctggagattgtaaaactccagaacatccatgaagaaagaagaaaatggcggaaccagccctgccattgcgaaagggaggaagaagacggaccgccccgggtagcgtggcgccgggcgtccctcgcccagcgtgactatctcccggccggtggcagattccggcatgaagcggcgcggcagcccggcctgtctctcgctcacgatgcgggaaggcggcagcacgctaccgtcaagcggagcggagccccgtgccatgacgccggatgaagaaatgtttgagagcgagcgcgtgtggcgagggtagggcacaggaaacaaggagttagggcgcaagcagtgaagacaaggggaataatggcgagaggaaggaagcaaatctcttcctcggtgtctttatacccttgccaacgctgtgcccggctcctcgcttctcgcgcccactatctcgctccctcgtttctcgcgcccacgtctccactaatcccactcgcccgttggcggcgcacgaggtggatatgtggctggggcagtcgagatggaacatatcgtgcgcgcgttaattacgctcgccgaccgaagcgccattaccatatctccaggcaaaacgaaccggctcgtcccgattcgtgtgctactcgagtaatgtggcagtcttgaagagaccgctcattattgacagtcgagttgccattgccgatgtgtgcgatttgcgaccgctggttttctgcccaactgtagagaccggccccacctgtcaccaggccttaggagtggcgtcacgcccgaccgcttccctcgaggagggcgatcgccctggcataacgccgggggctactgtcggtgacatgggatcgggagtatcatgactagaggcttgggcaggagcaatcacccacgtggcctgaccccctcgggggggtcgggcccgagggtggtatgaccacccctctctttgtctccccgagtggtcggaccgctcccgtttcggccccgagggccgaggcgccccgaccccttgtgggttttgcgccgcatgtatgggttaggtgggcacagcggggctcacctaaccgcatttattgcggtttggacgagcgcgtcacgctgcatgtaacgcagtgcagcgcactcgtttatccggtctgtgaccggtcacagaccggacagatcgcgggttaggtggcaacaggcgatctgacacacgcctcgccccgtcccgtcaggatgagagcctccaggcactcgtccctagccggagccagcgtgctagctcctggagatagcacgttggtcccggtcagatatatgccaggcttcatcgcaaccattaaaagcaagacattgtatgaagaagggcgaacatgcagattggtaa

SEQ ID NO: 8551 - DNA, 6584 bp, Oryza sativa
ctgtcctcatatttttagatagacttgttatttttttgttagaaaaatgagttgccaatagatatgtgcttaaaatgtacgtagtaatttgatgagaaagaaagcatttggttgaattaggagtttacacagaatttccaacgaattatgaaataataatttttcagaatttccaccaattatttaattttaccaaggctatgttctgttaatctcttccaaaaagggtgagggaggatttactagaatcgctccaatcgatttaactgaaaagccctaaatgattccttaggaacgacgggtgatctactgggcactggccgtccattaagtgttttaatctaagtattcagtcattgattaaaattatgtttgtggctatctactatatactcctattctactacagctactcgtactagccaatgtcccgtgtgaatgcatgggcgaatgaccggacaaataactatgcaaacttaattccagttaattagtactcctactcgtactgtagctactggcggatcaaaatagttatgcaaacttaattccagttaattcctccctccgtccctaaatatttgacgctattgatttttttaaatatgtttaaaaccgttcgtattatttaaaaaatttaagtaattattaattatttttctatgatttgatttattgtcaaatatatttttatgtatattgtactgtaccatcttctagatcaactggtcgatcgataccaataatgattatcgttcacttatcgctctccaggattagtgctcaacagaatccgatccaactgccgttaattaaagaaatcgaacctctgcatacaggaagaaggaacactagctttattcttgacgttcctcttctcttttagatgcaatcatgcaaacgaattatacgcggtaagctaggtacgtacgctggtctttcttctctcctctcgctcaattatttattatttattggtcatggttacgttttcagatttcttttgaataattatcacgtcctccgattaaattacgggatgactaaaccgcggcacgagtggtttactaactcgttgagatttggtaagaggagagagataatcatggacaggaggatcgacattgccggatatttagcgaggtcaaaatagaatgctcaacctgaacgaagtaataataattgttcagttcttccctcgtgatactacatgcctccgtttataaaaaagtgtaaactgttcatgtttatagcttataaaggaatgccgtaactaatgattttgctgtatttttgttgatagtttttttctaaaaaattgatagatgtaaatatagtataatcatagtataactatattgtaacttgcacgtaactacgatataattttgaaccgtttgatttactttaaaattcgtgcatgggatagaaaaaatcataacccacccacgcacatgtgaggggattcggtaccattatctccgttttcacatgattagcatatcaccttggaatttttaaaagttaaatagaagttacaatatagttacatgcaaattacactgtaattatatcacaattgtattatatttacctctataaaatttgacgacaaatgttatagctaatcccagtaactaatacgcactccttccaaaaagcctaagacctatttcattatttggtttttccaaaagtctaagtcctgtttgtagttattatgtgctaaattaaattgttgataggaacccaagaagccattttaatgtttataggttgcatgttcattggttttgtcacatggtgaatgaattaattgtttcttggtcttcatgaaaaagaaataacactcaaatttttggaaggagggagtactttcttataggaacttaattttagattagaaatatcatagtattacgaatcttgacatagtctgtctagatttatcgtgtatatgttcaatttagtatttattactaatataaagcgattagtaataattaagtttaatgatgcgacttacaatttgtttctgcatggctagctgtattctcttcgaaccctttcgccaactgctgtcgatgcagacttgtgctttatatggttgtgtgtgccgtcgcattcttattctaggttttgatccctttgggatacgatgaatcgtggtcagagttagtttggatacagctaatcaccagctgccaagtgacttgcacccgccgccgccgggagggacgggcaggtatatatctctgtcttgcctcgtatcgtaagtagggttaatcgaccgagctttctgtaataaataaactggaagggatctgttttagcagttaattacggagtagttggtgtgtgttgccggagtcaaaattgtggatgcaatcatggatggggatgcctcaatgtatagtaagtgtatggtgtttgtaccctcgctaacacgagcaaacaatatatggtcggcagaagggctacggggattattgagtttgctcctttgcctatggtgttgtgcttctgtgcttgggccaaaacttaacatggcatttctaaattttccattgtttttttttatattttataattaagaatgtcattgaaatgataattctggtggcggagctaaaaaaatttcaaaacccaggcaaatctaactacaacaaatatttactaatttttttttgttttcaattctataaaatatcaaattttacagcgttttcgctacgataagtccgggccaccgccagggcggtggctccgccactgattttatgaataacaatttttaattatccctaaaaagctcaatgcaacacaaataggtaaaaattgtataatcagaagtacaagatggacttttttatagtttaacactactagccaagagcccgtgcatcctaacgatgagtttctagcttatcaggtcaattaagcacatgtttagtctaaataatacttttatgatttttcttattgaacatgtttttaaatttaaggagaggcagcagtgaaacatgagaggattcgttgaagggtggtgcggcatagattgtgaggctcagatatcagtagtagggatgttactaacagaacagacactaccactactaatattaatagtatagatgcaaagcttatttttttaaggagcaaaatttatctaagtcagggtcaatttagtctttgtgcaatacttttgggtggctttcatgcgtattttttaccaaaaaaactaaagaaaccgcatataccagcccaactatcttgtattgcatcgaagtgccaggaaaactagaagtacatacggatttgatggagatcagctcacttctaggttgcttttgcttgcattctcccttggaagttggaagtttttattgctgatggctgatccaaggtgggagacaaatcctttctcggttgaaatgccattatatcatttctcggtgctcacctgtgactaatttactcaaatttcaattcaaaaaaaattattcaaaattagccgtggatgtgctaatcctgttaaacagaatgaagcagccattactactagagcttggcttacactaatctcgccgagcagatgctttaagtcttcaaaaacagagaatttttttagtatgctgctactcctactaatgaaatgctcatttctcacatatggtgcaatttttgtggtatattgtctatcccacaattggaaccacatttttgctcacactgttaaggtattgttccattttgactgtgtcggctgaccacattttaattgatactagtgttgagcaaagctggggtatagtagagcagtggaagaacagagagagggagatgatgacacagggaagatatatctgtcattttgcaatgttttctcttacagtccaaattgacagaatgggagcaaaacaggaaaaaaaatggtatgtggcttgatagtagtgacataaacgagaagtcacacagtaactagtggagtacgtcagaagttgggaattcatatattagtggcataaacaaaattttccctcaaaattacattggtatggtctatacatagattagggaattaataatacaatggagaaacatatggatgatcaaactgcagttgtatacacaccttcatcaacgttcaagtttgctcagcagttcttcaagtcgtggaagttcctgcaatatgtcgttccaatttggcatgccctacaaataaagaaatacacttggttagatatattaatttacgcgtaaacttcagattcagtgtcattcaattctaacgtatgaccttcatactatacttattacatcattaagtactatctccgtctcaaaatataagggattttgcctaaattcctcatattttagtacggaggtagtataaattttcctgtgaccaactaaaatccagagaagaatactcttccagatcttctgacacgaccatccaatcggaggattatatagacatcttcaccgggagtgacaccttcagactcttgctggtcacgtatccaactgaaccatgagaatgtagatgtcaacaaaaccttagacataacaaattgatgctttacaatttttggatattgaattgttgagttccttctataagcatgcttgactactattaggacaaatacttcaattcctggaatagtcatcgcaggacattacataatgtaaacataaaaatacagtgaagctaatagaaatgcacaattctttttaaaaaactagtaaaatgcacaattctttttaaaaaactagtaactagtaactgcaaaactgagagcagcaggagggttagaagccattatattaaacatatacttccatcctcccaaaataaataaacttttatacacaaatctggacaaatagggtgtgtccaaattcgtgtaggaaaaagttgaatctttatggggcagagggagtacagagagaggtgaaggtgaagctattcctaatatctattttttctcctaaaaaaatgtttatctgtacattaaatagagacttaacagcaggggtgtttttggtgccataagaaaaacaaggtgtaaaattcttcaaatgagtaaatactagtactcccgccattcagaaatgtatggcatattttcctcaaaatgagattgaaaaagacttttactatttattctctctagctactatatttaacacatgcatattggaaagttggatacttatcagaggtataaaggacattatacttgttttgcacaggggtatgaaatatttacatttgtggacaaagcgaatcaagaacaggccttgcatatgtggacagaggataataccttggaaggccattcaaaagttaaaacatatggtctacgtgagtggatgatacttacttaagaaggtaaaggaggcaaagcattgtggaacaacacaaaaaaatggttgacataatggcatgcaagtagtgaaaccgaggaagtaattttgttgtttaccaggtaactatgcccattgtaatgctaaattatcaaagagcagtaaaaactattagcagaaatgggtgacacagattttaataataatgataagtatttcagagaagaccacaaattttgaatattgtagaggtgaccataagcttattcatttgtgccctagcttttcaaaaaatgtcagttttttttattcttccatgacatctaaatacttatttatgttgttgttctatgtagtgagagtaaaaaatctacaagttaaaagaaaaggcacctttcccattgttcaggagagacaatatcagccttaaatcgctcttcagcttttaaccgtgatttcgctgcaatagattcagtacgcttctcaaagtcatcctgtcaagagaaaattgctttccttttgaaatatagaggaaattttattgtctaaaatatatatatataaaattcttgggttttagcaaaaacatgtaagtttagcctaaccccaactgaaggagctgatgcagcagatcttgaacttccaaagcctcttggcttactttgggctttctgagaagcaccaaagatcacaggaattagaagaacacctcgtttcagcagttcagtccgatatctctcagctctttgcattgctcgagtaatggatgcttttgaacctgccagtataacctaaaatacttgtcaatatagtatgggcacacaaaaaaagcacaaaaagatgtatgcaactcaggaaatatcaagctatctattgagaattgaagatgtaaagagaactatactaactggcctagtaatgtcccggagttgcacaagctcaataatgcgattggttgacaggcggacaggtaaccttgaaagggtttcattgcgagaaatttgtgtgatctgctgctcttctttcttgttttcccagaaatacaaagccacgagcacaacaatacctgcagtgcgctgattcaaaagtttgattatcttttagtttaattaaccgtgtgaaagcacagtatacaagtttcatcaaatgattatattatacatggaaacccgagaaagatcattattggcttaagatgtgatcct

SEQ ID NO: 8552 - DNA, 17178 bp, Oryza sativa
  unsure (1)..(17178): unsure at all n locations
accattttcaaccataccattttttggcaaagttgccaaaattttggctgcgtttagtttattgccaaatttagtaaatacacaagaaatgctgccaaaattttggcaatattgccatcttgctaaaattttggcattgtcaaaatttggtaaggtttattttggctacaatctaaacaggcccatactcaattatgactacaaacatgaagtgtcaccaaggtgtagtacccgcaacaaatttgtacatggatgtttttttcctcatgttgcaaccatgcataagaacgcattatcgccatgtaaaggtggaacagaaatcccatgctatcaaaaggtacactcttctcaacacccctttcttttaggacatatcaatttacctccaatattgatggcagcattcccaacagtttccagcagatcaggggcaccatcgccaccttgaactgcaagtataagtctaggaatggtaaagaatgttgaaattccagctgctgcagttaacgccacataaaagaaccttcggacaccacgaaatggtgcttgtacttcactaatgagtttcaggtctcttcggaacccagaaccaatatcttctccaccacgcaatgcctgaaatgaatttacagtatgtacaggatcatattaaatattagtaaagtatggatacttacctagtggttacagtgctcaagtagcacctctagatcctgggttaaacttcccacaggagggaatttcaggcctagttaaaaaagttactccttggcccctcataaaaacatgtattaagaatcgacctatggaaggcgggccctcgtgtaggggacaggggcctcaaaacacgggctaaggaccaatccatagggggccagtccgtgtgtggggggccagggtttgtggcttttctcggtcggtttggttgaggcttcctcttcttaatgaaaagtcgtgagggcggtcattcccccgctggtcgagttttttttttttacttattcacaaggttactttcttattcattgggtcaaatatcggtattagtcattgcctcattgggtcaaatttaaactatggtcagcagattactttcttattcacgaggtagcaaagcagtaaaatacaaattcacaaacctcttcttgaagttccttgaattccggtgatgccctgaacggtgccaagtcaggatcattaagtatagtaccaaacttgagattataatctcgcagagctgtccttaagcaatctgcagctttgttgctttcttccctggtcaaacatgcacaccaattaatagaaaaacataaataaagcacaaaaggaacaaatcaataattttgaaagtgttgcctcacctaaatgcatggcagcatgctttattgtatagtgctgcttgggcttcaacaggatttggattcagctctagggcattctcaaattgttcaagagcatccttcacctttggaatgtgaaagcaatatcacaatgaatgcagttgatattttattgtatatggttcttcaatttaatgattacaacaaacccatgcaggagttcactagtacatgcaccgtctataagaaacccacttcaattaatcccatatctctaacagacaaacatggtattgtttcagtttagagcgagtacaatagtaggttacaagtcagctataagcacatgtgttggtgataagataagagacagaagaaaaatggactacagatttgtagccagctgcagcacggactccaaaacgtcgtgtgtatatttttttttgactaaatcattgtgtgtatatgaaaggtgggaccatatattaattgtgtagtatatatttataggtaactattgtatgaatgtgctattaaattgactatacatgatttggagctaatagttggctatactattaaacttgctcttagagcaagtttaatagtatagcccactactagctgcaattcacctataaccaatctagtagccaattcatacaataattgcttactatactattaatatatagtcccacatgtcatacacacactgcgtcttgaagtccgtgctgtagttagctacagatctgtagcccgtttctcttctctcttatcttttatctcattaaaatatgtttatagccggctaatagttcgctattgtacctgctcttaatagctgctttgcttaaggctgagtttgagggagcatatgggctgaaagtttccctcattttctgtgcacacacttcccaaactgctaaataatgtatttcatgtaaaagttttctatatagaagtttcttaattcttaaagaatcatattaatcccttttcaagtttggaataattgatactcaattaattatgtgctaatgacttatctcgttttgtgcaccgctaagttgctaagagcaagtttaatagtatagccaactaatggctacaaatcaactatagccaatataatagccaattcatacaatagttacttactatactattaatacctggtcccacctgtcatacacacattatgtcttggagttcgtgctgcagctggctacagatttgtagcccgctgctcttctctctcttattttaactctttaaaatatgtttatagccggcttgtagtctgctattgtacctgctctaagcccaaatgctcattcaaacccagcctaatgttcaaactcaatatggacatgaggatgtggtcaaatatttttgggttcaacttcaccattcccttgaaggtcgttacgaagaatttactattttactcagcaagcaaaagatggtaaacccagttcaaacactcaaatgtggcgtaaacatacctatatcagccaaagatgaaccaaaatggagataaatgcaatgattaaattctgggaaaaggctgccgaatactgacattcctcagctaactagagctgcttgcgcactaaaactggggcatctctatcaacatattactcctaccgataaaattactcgttaatatgatctgatccttcacgacgattgagaagcactcgaaatgtggaataggcggaacgggaatcgacttcgctcaccctgcccttggagaagagctcgagtcccaggttgacgcacgactccgccgtcgggacagccaccgcctccttccccggcgatggcgggggagacggagacgaagaggccttggagcggagcacgcagcggcgtcgtcggccgcaatgagggaggaggggcgagacgaaggatagcgcttggagggcatagctacgggttccgccgcctccgcctccaccgccgccggcggggagaagggcgaggtgtggccggagagccgatgctccggcggccgccattgccggtttcgtgaggtgaggtggtcgtttttctcgttatccaaactagtatttgtggtcgaggaggaacgagttgggccgaagaagatgcaaaacccagcccatttactcatcacgtgtaaaaaagaaaagcccaaaccggcccaccacggaaaccctacttgcgctgcgcctccgcagcatataacctctcccacctctcgccctccgccatccctctctcctctttggcggcggcggcggaagagagcgacgcagacggacggcgtggtggtctccccctccggcgacgtagctcgagctcgcaaccatggtgagcgccgcgccgtttctcccgttacgtctcagtttcatagtctctgtacttgtgtagcaccggtgtcttcttcttctgttctttagtttcgggtcgagtggtagcaggatgggcttgtgtttagcttgtgtggtggtaatgttaagagggagaattgagagattgggggaggatttggtttggttcttgggaattgatgcggtgtgcattgttgtagattggcgggcaggtgtgatgagggctatgcaatctttttttcgtgttatgtttcctatttcctgtttcttgatggcagcatatgtatgatgattaccttttgatgtagtaactgatttaagttgtgtgctgtttgatatattcttactaattttatataggaattagattccaagatatgtagttaaacagtatggatcctgttgggatctagaattatattgtggatatacagtatcgagcctattgctatctagaattatattgttgtactggcttttaagaagcatcacaattctgtgagtatgtggttaataacatacttaacgttgtcaacctgttattttctgaacaggcgaggggattgaagaagcatctcaagaggctcaatgcgcccaagcactggatgctcgacaagctcggcggagcttttgtgagtttactgatttcctgtgatgtgcttgaaatggcctctgccatttgcgactattttctgttgttcagtaatgtaattcgccgaactgctttgtgtgccttccaggcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatgggtatgcacgcatgtttcttttctgacccgtcgttatcttgtatggtctggtatgcaagtggttcatttctagcataccttacatggtaatgccctctgtttggcagatgtgatttccattccaaagactggtgagaactacaggcttctctatgacaccaagggtcgcttccgccttcagtccgtcaaggatgaggatgccaaggttagcattgcttcttttcactcatgcacacgtgaatgtaaattctctattctgttttgtagtctaaatgtttgtgacccgatcttttatatgcagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaaatacatttctatcttcaaaatttgagttttgtttgggttgacagaattttccatcctagttgaaatgtagttcacagtaatactgttaagttgcagagatgcatccttttctactgttatttcatgttatcgagccattttattgtgttcatcttttggccttgaagctaccaaaatggctgagaccgttatcatcatgcagtcattataatgaacagtagcaattagccatcacttgtttagagcgagatttgttttcaggcaactgctgctttactgaagctacatggctaatcttggtttattcaaacgagactattggcatccttccagcttggcattcaaagggagtcttggtttaatcaaataggcttccaatctttccaggttttgcaaagtaaaacctttttcgtaatggatcatattcctggaacacaattgtatggaaaggtagggatgggtagaaaaagatcgagaccgagaaattcggtcctaggtagtgagaccgaattttattcggtcaattcggttagtcttatcggttaaaaaaaaagaccgaattaacaaattaacaaaaaaaaatttctaaatccaacctataatccactaaattcaacatgattaaactctatttttcacacccctacttataggcatgtaatgtaagaagtgtctttacgcatacatgcttacgattttttttttgatttttgtgttgaaaatttccattatttctttgcatatatgaaaatgttgctgaatttcggtcaggactgagaccgagacaaattaatttgtcggtcctaatattttttcgttgaaattcggtattcacttccaaaagaccgaaagaccaaagaccgaaaccgaaattttcggttagaccgaatacccacccctgtggaaaggtacgcatgccgaacaaatggaatgtttggtttattcaatgagacttcaattattgggaaaggtgataatacaaattggcaaatacggtagtactgttttaaacctctcgctagtattttttttcacccgaggctaaaccgaaataccgtcctgcctgggatgcatagtttacaaaaccacgcggtcatcacgtgtggtaatcttttcagtttttgaaatcacggtatagctctcggtttggggaatcatgctaggatgtggatcctggctgtgatgtgaacacactcgtgcatactcaccggcagcggtagatccggccgtcatagggccggcaacgacagatctatccttcttgggctgcccttgcctccccttcaccagtgtagctcctaaggccaccatgggtggatccacgtcccctaagacctccacctcaactgttgccatcgtcgaggtcgcggtagccgccgccgtcatttgagtcgttgtagccactgccttatcccgtcacggggtcactcgagagatatttaaccatttgccacatttagatgtggcaattaactatttgccactggacccacatgtcatagacacatgtggacccacatgtcattgagataggggtggcaaatagttatttgccaaatctaaaagtggcaaatagttaaaagccccggttactcggcggtggcagatccgccctttcctagggctgacaatgatgctgctggatccgctgccgccatcaccgtccctccaagggccgagggtggtggatccatccctcacgagggaggtgtcgatggatccactgtccttagggggctgccgccgtcgtcatcgtcgtctttgccatatctcccaccagagccgagcggggtagggagaggggaggggaggggaggagtagggagaagagaggggtgaggagaagatctcctccatgatagaaaaatctcctccccaagcatctactccacgcgtgcgcgctccgtcggggccgccaccgagctccactgagcatttggacctcaagcgccgccacctctgcatgagagagattgtgagtgagtgagaaagagagagaggaggtgaggagttgaggtgactaaatacgtagggagagtaaaggggataaggataaggatgagcagagagatgggtggcaggcgggcctattaagacgtccacctgcgataataaattttcgtatcacaggtggatttttgctggacaccgcctaaatatttttacatatgaatgctcatttagttggccgcctaaatatttttacatatggacgctcatttagttggctaaaaaaaaaacacagtgtgtgttcgcgaaaatcgttttttgtaagtgtttcttaggtcttccggtgaaaatggaggcacaacacataagatcgcttcccgattttgtttcaattcacgatcacgggatttcacgtggccgcaggccgcagccagcgtcgcatccaccttcatttgtccgtcatcgtacaccgggctcttcgtccgtcattcgcaatcccgtgagcttcgtctgtgcgtccgcgtcccaacgcccgcacgagcgttcgttgtttctgctgtccccagacaggttccaagactgagagcgccctgacgtccatgcctagggagtatagtcgatcacgtactagccacaccaagtaagaagaagaagaagaccggtaagagaggggtggctgcctgcttttttgcttcttgctgctgcggcctgttcttcatcggagctcttcgtgtccagatttcttcaaggctagagagcagctagcaataggaggaggcagtaggcatgggcagcgtcaaaggtgagcggctgaccggtgtggagctctctggtttgtgtagatggctttgctctgtgttcatgatttgggttctcaggggatgctctgaacttgggttatttggggttcaaagttcggatcatctgttcgatgttcccatcgattttgtttggtgagagttgcaaaagaacggttttatgtaggtagggccaaatcaaacttgagatttctctctctctctctctctctctctctttttcctgacgctttccctgatatgtgcattaaaggattttgatatggcccagcctgtttgagtttattttcttgattttctttttgaatttatttagatagtgtgtgctcttttgagtgagctctctagatagtgagtttgcttcattgtgtctgtgcgtgatgacagcacaagtgtcaagacgaggcaacaaggtgcactacgctttatgcgcaagacactgcaaaatcacatacgactatacatgacaattgaaattgtttttatccagtataccgcatggacatcttaatagcataggataaagagaaaagcaataataaccaaaggttggagtttaggattggtttatttatttataggggtattagcatggctaggattataattagctagggtttagctttagattagcgatagtaaggttggcaagtatagcggctaggatttagtttattaatttctagcctacatgggagacttctctaaccggtgctgacaaatagcataatggccagaggattggaaggttggtgcaggttgtgaggtggatgtgttattctgacaaccatggatggtagtggggcgggagagctaagtgtgcagtgtactgtggagaccaaggaaacaatgaagctccaatctctgtaggcatcgataagtgtggtgcgaggaatagcagtacttcggctttgggattatgttatgtggagctttatatccaacagtccgatctcgaacgtccttatgaaaggcgtaaatttccaaacggtgttttttaagtggctaaggggtaatttggaataagaggaataatattcaaaagattgaatttaatataattctaaattggaagtttaaatggcatttaaatagattaagaacattcaaataaaatatgaaaatataaaaaaatagtatcaatagatagagtttgaatttagagtaatttaggtccaagtttgacttgaatcggttttatggttgaatcagttttatggtttgggagaaatgggctctaaaaattgaactttggattaaatctagaaaatacgaaacaaaactgtttatggggccaacctgtcaaacactgttattcttttcttttctctccttcctcctcccgatcacctctctctttcttgttgcaggccgtggctagggttggggattccagcggctatgatggccagaggccagggcggattgagagaggaggctgtgtgcacgacggtggcgaagtatcccccgtagtggaacggctaattgtgccagcggcaaggtcggtagctaagagtgggcatggcggattggcatcgaggaggccgaaaggggatgggtggtggcttcagcgtagggtagttcagattaaattgatgtcatgggaagctctagcctctatgtggatgatgatgataactcattttgtggttggttgtatttacacccaaatttgtcatctaagattcggattaggaaaatattgtcaaaatttggagagtatcggtttgcttcacggagctggtatgactgtcgtatgtgggccagtcagaccgctgcttgtgtgccggtcaaactagcagagtccgatctcgagtctgttttcgtcaggcctcggaattccttttttgggatggcatattttgggtttttgttgatttttttgtcccgagttggacgtggaggaggcaagaccaacccctatataaagcacaaggccggtttaattggaagaagaatctacacagtccaatgtagccaatagaatcgctttttcaatattgcacctacttttcgcctagttctagcctagttcatccatctttgtcgatttgcgccgtaaatcatccgccttcactgcaagagtacagaattcttttctaggtttgttccgtaaacctaatgttcacccttaagatgggtgtgtatcgcttgtttcatttaaatcggctccgctagccggtttaatctatcgaaacccattttgatctagcttttgctagattgaggtggtcggtgactccataccaccgcaaggtgtttaggtgtctcgatcatgattgtcttcttacaaaaaaaagtttccaataggttggttgtaactagcgatggaaaggaagctcgtggctcgttagctcgctcgacttgtgacaagctcggctcggctcgactcgtttcattttcctaacgagccaagctggcattttaactcgttagagataaggagccagctccagctggctcgcgagccttaacgagccaggactccaatagacaacagcaaaggcccagcccaagacaacagaaaaaccctagtcctctcctcactcctcacggcatcggcgtcggcggctcatcctctctggctccgcttgattcctcgatccctcccccctcaggcttccgcaatggcgtagtgcgctgccactagtcgctctcctctcctcatctctcgctgcgacgccgcccggccatcctcttccattgaagaagctctcctcgccgccgccaactgctagggccgtcgccgcacttccccagccagcgccaaaagctctcctctcttcacctctcgccgcgacaccgcctggtcatcctcttccaccgaagaccggccacctaccccgcccccgctggccaccaccccatgccacacgccgcccactgcccaggcgcccaccgatggtttggctctcgagcctaatgagctagctcaagctttcaaatgagccaagccaagctaggtttctagctcgttaggataacgagccaagctgagccagctcgttatcaccaagccgacccgagctggcttgctatccacccctagataggtgctatagctttctaggatgtactgagacgctacaaacaaaaaggctccaccggattatagctggacgccttgatggagaaatgagcttgcgcaacgaaaaacagagcagtgcacacacttggcctcggacttcgacgaggacttgaaaagcttcaagtatggcataacgatgcctaaatttcgcgttacaccagaagttgatgaaggatttggcttgaattggtggagtgtatgcacgcatagtgctcgatcactgtcatgcacgaggccgtgcactttggcgcgtggacatctatccttcggctgagcaaggggcggtgtaccaccatggtttgggccgaggtggactggcttacgttgaggaataagttcatttgaggtcccttaacttgacaccgactctgatttcgtccctaaaccacaataccagatacaccctcaattatcaaaactggtgcaaataaggtcccaaggcagtttggatgtcggtttcggtgacgtggcatttacgtggctggtttccgtcggacttgagggagaactggtagacaaagaggtccaggaagaaagggagtatggtttgggcgcgcggagtctacgccgaagccgaggacaacgagggacgagtggcgggagggtggcgaagatgtccaggtaggtggacgcgaggggccagccacagcgagggaaatgagagggagtggatgttgccaggaccgtcaaagaggaggacgcgctcgcctgctctgtcgttcttcttgctgtccacccacccgtccaccatctcgcctcctccaccattctcctcgccgcgcacccacccgtccaccaccgctcctcgccgcccacctgcctgtccaccactgtctcacctcctcccccgttctcctcgccgcccacctgcccatatgccgcctcgcctcctccgtcgttctcctcgccgcccacctgcccgtctacgcagatccaggtcgccgcactctccgctactgacccttggcgaggagctcgattgcggtattaagggaggagcaaaccaagcccctcccttgctgccactgccacgtggccattggatcgtgggtgtagccttgctcctatgatctcgaggttgagggtgctatcgatcccacgctgggggtgggagagcgcaaccttcttgtgcgtgatgaggaagggcgcgtcggtggcggtggtggcggagagaagggcggcgacagcgaggagtgagaatgaggaagaagagagagaggatagagagaggggatgagtgaagatgataggtggggccacatgggccctaccatgttttatttgtgtgtgcatctgattgtgggccccataatttttatttcgagatcaaattgccacagtcaaaggagccatgtaggcgccacgtcagtcaaaatcgggcataatactgccgagggatcacgtttgcacggttttgtaaggttgaggatgcgttgtatccggttttgcggtttagggacgaatttcggactcggcgacaaattgaggtacctaaagtgaacttattccttagtttgatatcaggttttgtgggacgaaatttgactgggctgaggttttgcgccggctagaatgagcttgaaattctgtagagcacttcatggacatggacagccaggggcggatctacccattaggcggggtgggtcgatcgactcagctatgactcgtgttgctccacgctctcaagacccctcttactccattatagtagttatgggccatcaaaattaggtataacaaggtgtaaacacccaacaaattgaggcaattatgcgaatgaactattaatacgatacatgttgattgtttctgattggttacagacagtgtgataccttgatgtttttttttgtttttctttctgtaatttgtaaataaccttttcattttataaaaatacactgcgaggtaaagtcctggcagtatttccagtaaaaaaacgatacgtgttgtgttcaaatgctcttaacgagtgaacatttctgttctccgccccatatatattttaaagctgcgtccgccaggacagcatagttttgtattttcaagatatttcagataataaaatgaataatttggaggggcttggatgcaaagtctcagtgtaggtgtaggagtaggagtaggccatgatgatgtaggaatttagtagaattttcgtggactaaagcaagaatttgaaattcaaataatatttgaatttgagaggaattgagagtttgcgtcaaattaaaaaaaaattgaggctaagcctatggtactggagtggagggaataagtagatgaattagttttagatggaaagtgatttggaaaggcacttgggggtttgagcaaatttggaggaataggattttattagcacaagagcaaaccaaagatcccaagagttttactgtgctagggaatagatatttgatttgaagaaaattttgggcatgggaatatgtggaggaaatttatagaatatttgtgacgagatgaaacatcaacgatttgggatttaaagctagagatagaatatgggatccttgaaccttgtttagaagggataaattcaaaaatgtttaaattgaagaaaggagagatttgaaaattgggatcagacttacatgaatttttctataaattttttagaataataaaaaatgcttaacattctaaattcaactcaagaaatagaaatgaaaaggcggcatgacgcaattcgaaatatttaaattttgaggatgttatactattgattactctctgtcctaaaatatagccatttttagctataaattatgttgagatggaggcagcagatcataaagcgtggggaaggagcccggaggacccacttccattcctttgcaggattcttctcgaaggaagaagatgtctgctgatcgatcaccgggatcgacctcatcatcaaccaatggttagcttcttgcaggatcactacaccaacactggcaccaaaggaggcaaatgatcatcaccaagtggcactaatggcttcacctaattaatctggtcagtaccaccaaataccgcggtagattgaattttggtggcctgtttaggctaagttttcagatcttgttagatcagaaacttacaactatgatgaacagtagcccttaactatccttttttttatttggagagatttgtttccaggctattgctgttttattaaagctgcatgtcaaacatactccctccgtcccaagaaaaagggacacaactacaccgagagtgctagctggttagtgctaaagggagacaccattctttctaaaaaaaaaagctactagtacactcaatatctatgtatttttttcttcttagagaagattctcttaaattacttatccgatttataatccgatttcacctttgtgttcgtaacaattaaatctttacaacaagatctcacatgattatatttttatgaaaaatcacaaattacttttatgatatgtctaaattacttctagatttcactaagttacttcttagacatataaaagtaaattcagtaaagcttaaaagtaatttacatatattatagaagtaacttataacaaaaagaaaagtaactttaatttagaactatatctagattcattaacatctatataaatgtgggcaatactaaaatgacttacattatgaaacggggggagtaactctctgtagtagaaataattatattgtgagtaagctgaaataagaaactatgtagactgaattcgtaagtaaagtgtagagaagatttataaagtccacaaaatatagaattaactaaaaacaataataaaaattaacttagagcattctatagaagtaatttagtcaaatttgaaagtaacttatatatattataaaagtaacttagtatataataaaagtaatttacaactataaatattttttcattgtaatataatcatgtaagatcttattgtgaagatttaattgtaacgaacataatggtgtaattggattgtaaatcggataagtaatttgagagaaaactttataagaaggaagaaaaagacacacatatctaagaggaaaaacaacacgcacatcagcacgtgtagtagtaattcttctcacaatttgatcgtcgctggttaacactaaaccgagagacttctcggtttagattttaccaagaaaaagataaacccatgtttagatttatacccagggtttgttgttttttggaaggatgttcagatttatatttagagtttgttcttttttttaaggacgaagggagtagtctgcagctaatggtagaggtaaatttcatctagtaatgtatggtagaacgtattgggaatacttgaatttatccttcctatgcttacaaaaaaaatttggcatgactattggaaagggaaaacatttctaaaatatgccttttatcatacaaatatatttcaacaatgcaatcttcattggtcagcatttctggaacacaacatgaagaaaaggtacacatgccaaacaaatgaaagatttgctctattaaaaagacaatttgaattactaggaaaaactgataattcaaatttacgacttttgaacaccttcttattattaaatgttcatcgaacgatgaaaaaaaatacttcacgttgattttctatttaggggaaattttagagttgtgtttttctgctagggaatagatggttctccaagttagcccttatttgtcagactgcaggaaacgttcgatctgcagataagaaatacatgatcaaaactagaaaagattcaagtggcatgggaatatgtggaggaaatttatagaatatttgtgaggagatggaatatgaaggatttggatttanagctagagacagaatatgggattcttgaaccttgtttagaagggataaattgaaaaaatgtttaaattgaagaaaggcgagatttgaaaattgggatcatactaaaaggtatttttctataaattggtgagaataatagaaaggcttaaaattcataagttctactcaagaaatagaatgaaaaagcaacaatggtgcaatttgaaatatttaaattctaaggatgtaaccatactgattagataaggcatggggaagggacccgaaggaccgcttccaatccattgcatgattcttctcgaattcattggtgagcattccgggaatacaacatgttgaaaaaggtacacgtgccaaacaaacgacaggcttgtggcctgttcactttgatgccaaaaaaaccttaccaaaatttggcattaccaaaattttggcatagttgccaaaattttgccaacttaccaaaattttggcagaatttcttatatagttaccaaaatttagcagcaaactaaatgtagccacttttttttggcaactttaccaaaatttggtaaggttgaaaatggcatcaaagtgaacatgcccttggtttattaaaaagagacaatttaaattactagaaaaaaactgataattcaaatttatgtcttttgaacaccttcttattattaactgttcatcgaacgatggaaaaaaaggcttcacgttgattttctgtttaggggaaattttagagttgtgtttttctgctagggaatagatggttctccaagttagctcttatttgtcggactgcaggaatagttctgcaaataagaaacacatgatcaaaactagaaaagaagcacaaaatgaaaccagacatctaggaacaagcggttgaaccgttgaagattcaccaaatcgagaatatggcatctctaccaaatcgacaatatagcatctccaaggcttcgagatagtactagataataaatctgctttccaggtcgtgttgataacagatctgcttggttaacttcctaagtatctgtctatgttgctatgaacagaacacaatcatgtgccttgtgttctggcgaaaaagttactatcatg

SEQ ID NO: 8553 - DNA, 7098 bp, Oryza sativa
aggtaaaaggaatatttcttcaatttttttcatcagtacttatcattctaatctataattctgactgctcctttactattgactagtttctctgcatttatctgtttttcacgagcttgaaacttttataagcacttacatatctttggactgattacctgtagatgcctaaaatagttcagcctaggatgtctgaacaagttggaacaatagagtggtataatgggataaaaatgacaaaacactgtacatggtgaatgatcgaatttgcttcattgtgggaaatacagaaattaattataaaattattgcataccttcatgacgggcgtctagttctttccactcgaggctgcccagccgttgccgcaggcatgtagggagcacttttagagcagggcattccataattataagcccttggagggatgagtacgcttgcggtgaattgggtagtgatgatgatgccaggcttttgcagtaacagagcgtgagttttaccaacgatgggagctcgcccgagtgaggagactccagtgattcaggaggagagaagtggtccccagctggtgatgacggttccaacacaggagcagacacaatgttgtcactgcaaggcccttcaattaatgttgacccacgtctctgcttgccgaatatggacttaagctcagggcaacgtcgtatgtgcaaatacttgagagatggtggggtgttgaagacctctaccaaacttttacactcaattattgttagtgactccagacgtgttaggagttggcctccacctgatgttgaccgctcaggagcttgtgcgtatcccttcagtttgttgcagctcactatccctaatgtcttcaaggataccaagccctgaaattctttctccggccagtggatgagcacatcgcatctacaaattctcaaaactataagctgtgcaaaacatgtccatagtgcatgtgcaccagaaaggaagaacatgttgaagttatctaggcgcatatctgccagaggggattcacctttccaattctcattgtcgtccacccactcaatcaaattgtgttcagctggaggcgctgtttctacaccttcctgcagcaagctcagagtggacaatgaagtaatgtatcttggtatgcaaaagagcaactgttgggagcccttcgttatgtgtaaaacactaagctttcgtgcttcaggtagacttgccaactttggacaatccataatacgaatgttctcaaggttagggaacattggtgttttgacatgtgttgcttccacctgttgccatctgtcgattttatttaactcaatgagttggagctcctgtggaaaatttggcagcgcagttggtgtcttattgttgtcgttgtcacaactcggctgttcttgcctctcagttttgtcccaccatcccttgaaactcttcagattttctagtgtgagctctttcaattttggaaatattgaacatgtcgtgctgttctcaccaatgctacacaaatattgcaatctatcaaatccagccagtcgaagaagttggaggtactgcagctgccacaactgcggaatattttcgcaccttgtataactagtactgagatcaagctctataagaccttctaacatactaacccatgatggtaatgttgtacctttgtaggaggccaccttcagaaccaacagattatcatgaggtcgtagagcttccatcaccttgttatgactagaatctgctgtttcattgcgaggttcttcattgtcccatactaaagacaattccatgattttccttttgctgtcaagcttggtatgtattgcatctgactctcttacattctgtagctggggtagctctaggtgaccgccaatgtctaatttctgcagctctccaacattactgcatttaaagccagaacccactacaaaacaagtgagtgtctgtagggaagtgagttttctgaaatccggaggcatgtgcttcaaattcaaacaaccatgagtgtagaggtgacggagcgaagtcatgtacttcatttgtttaggaagtcgacggaggcaataacaatcagataggtttaacgtttgtaaactatatagaatgcttatttctccgggaagtgcttttatataagtttttgagagatccaggtaccttagatgatgtagaatctttggttttagttggatcaaccgcatctctttactcagtttcaatgctcgcacagagctatattttgccaaatgctgaaattgtctatcaacaagtacatcacatagaagtgtttggacagattgacacctcttcttcatataatcattcaacgtagtgtcaggctcattagatgacaaaagtatatggcggacagtacttggaaaaaactccttttgactaggattttcagttatgctaaaacattcgtttcccataacagatagcgcaacatcgtgcatcaaatcgtgtatcctacataaccttctataacaattcccatgtttgcttccatattcctgaaatgggacttgtttcatgtcttggaagaatgaccttgaggccaactcatggaaaatatagtttccaatggtttctagagggacattttttttcgtctgggataaagccattggccatccatacgtggattagattgtctacgtcaatcacataatctttgggaaacatagcacagaaagcaaagcattgtttcatgtatgagggcaagtcatcatagctgagcttgagtatatgtaaaattccagtctcctcattgcatatactgcttctcattaatatggcctgccattcttgcacagtttccttggtacgaagtagagagcctagtgctgttgcggctaatggagatccaacacatctgttgacaaacttatcaatcatttcaacttgctcattaggcttttcatcctttctcaaactaaatgctctcgtgtcaatgatttccttgataatgctgttctccagagcagtaaggttatatgcatcagttgtctgcattagttgagcaacttgttcatcacgagttgttgtcaatactgcactgccgatgctaccatgttgaagggaagcctttaacttttcccacttatcggcatctctgctccaaacgtcatccaatacaaggaggtacctttggccgctcactaatttttgaagcttctgcagtggcttgtccttggtcacttgactcacatgataatctatttggtgtttgccatcctcttttacttccttgctcctatcagctagtttaactatattttcagcaatagagtcaacatcaaaagggtcagatacgcatacccataccaacaactggaaatgcttctgaatttcactgtcgttgtaaactagttgcgctaatgttgtcttgcccagcccccctattccaactataggaagaaccaagagatccgggctgctagcttgaccaaggagaatattaacaattttcagtttttcttggcttcttgatttgctaataatgtttgttgggtcaaagatctcagaatcagtttgcctccactgcatggaaactaaaggctgaggttggaatctgaacctaaaggcattcatctccgtgacaaggacttcaatgtcatgcacaatcttgcaaagtcttttgtccatcctgtaccggaacatgacacggttgtgagtaggaaagagttttaccacatcgaagccgagcgcggtgtagtgcccattcttcttggcttctcgccaaagagcctcatacttgaactcgtcgaagatgtcatttgcttcgtaggccaccgtcttgagctcctcgagccaggctttcgctccttctctttgttctgacgcctgcttctcagcgtcggagatgacgtccaggatggccggcagcttgcgcttcaggatcttgtgctgctcttccaagccctccatcaccctgtactcctgtaggaggtagctggagaccttatccttcaccatggacagcagtggcttgaccacgatgctggtcaccacctccgccatttttgcacgctcgcagccagaggtacgcacaagcagaaggatgaggagagcaaccacacttcgaattgcacagcatcaattcgacgactctcctctccttttatctttcttctttcctcaagcatcctacagagtgtctccaattaattaatatttgctgccatctttgctgtgagagaataacttttttggggattgatccttctaacaaggcggccctgtttctttatttttatttttttgaaacagaggtggctctggaatcttgacgacattatgaacattaggtatactataaagttttttttctctcatttaaacaaatcaagaagacagtgctactttgtagaattgcgaagaagctacatcatagtatttatgatatggtttaggtatatatgcaaagtgatccctagcttgattctttttcttagttgggcaagagtaaaccatggatcaacttctcggccaggttactgctggcctgccgctcgatcgagatcgttaccgctgcctgcgccggtggacgagtctcccctgcacaccacatccggccagaaggacagaggcggagctaataaggattcaagggctggcaatgcaacttgcgtggggggttgtatatggatggtgtttgctccgtgttattcagtgatgagattatttggcaattggcacttggacaggccagctctgctacgtttagtctactcccttcgtcccaaaaaaaaaactaacctagataaggatggaacactttatagtacaacaaaagtgtacctaggttggtttttttgagatggaaggaatagctgctatgtcggttttgacctgtcgggaggaatatctgtcttctccgaccttctacatgattctggccgatcctggatcgacaatccgacggtatatatggatggtaggaatgcttcaactgcagaggtttaggcgctagtcgtctgtggagtcgattcaaattcgaacctagcccccacgtcattctctgtaggtagctgacagttgagaaaaataataaaaggatttcgaaattagcacgtgaattgggaaaacttaaaaacctacctacagaaaattttagctccaagttgagtgaaccaaattttcctagaaaatttcaggtttacaattggaccgtgctgtgtttgaataaatagtagaactttcattttcagcatattgacacttgtaaattgcatatctttccaaacaactataaaattagtaaaaatttcttcataaacaatatactattcaatgtgtaacatctcatgaattttaaagcatttcccatttccatgtttctttggtattaatttttagctttttttccccttgtagatagatatccaccccctcaaagaattttgacaaagaacctgtgataagtctgaatacaaacataaagcatctatgtatatcgaacctatattgaactgagtgcttagccgtgctaaagtatagtaaagttcaaagcaaatgcttagccatgctaaagtataggaaaggccaagaaaatggataaagccattagacgtacctttcacttgtgagcaattgaatattatacgaagactaatcatgtacctaaaactttggattaaatctagaaagtactccctccatcccaaaatgtttgacgccgttgacttttttaaaaataaaatgtttaacgccgttgacttttttaaaaatatttaaccattcgtcttattaaattttttaagtaattattaattcttttcctatcatctgatttattgttaaatatacttttatgtatacatatagttttacacatttcagaaaaaaaatttgaataagacgaacggtcaaacatatttaaaaaagtcaacagcgtcaaacatttagaaaaagagggagtagtaaatagtgttcatcggggccaaccggccaacttgtcggtttctgttttctttttctttcttttctctccgccttcctcctcctgatcccctctctctttcttgctgcaggccgtggctagggttggggattccaatggctgtgatggccgtggccagtgcggattgggaaggaggctgcgcacgattgcggcgaagtatatataccccacagtggaagggcttattgtgccagcggcaaggtcggtagctgagagtgggcatggcggatgggtggtgggctggtggcttccgtgtagagtagttaagattaaattgatgtcatgggaagctctagcctctaggtggatgatgatgacaactcatttttgtggttggttgtttggttgtgacggaggaggccggcccagagggttggtagctgacggagcgtggggctcctcaccgggagaccgcgcaggcccccctttgccggttcggccgggggcgctaagtgaggttcttcgccctcgatctgaggaacgtcagcgagagaagaagcgcacaagacgcgggcgacgtagacaggttcgggccgctgagaagcgtaacaccctactcctgtgttcttgtggatctgtgtgtgaaggaatacagagagccagagagcgagagagagttcaggctcccgaacccattcgccccttcttttctttttatctggttaggggtcaccacatgggcctctcgctgcctaagaaaggaaacatgctttttacaatgagggctaatctacagccggaagtgacctctgacaagcagagcatacgcctcctgccccgctcgccagctttcccggtggacgcccatttcaaccttcattcaatggccagcgacttccttgccatgcttgtgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggaccggataagcgtgcgctgcgctgcattaaatgcggcgtggcgcgctcgtccaacctgctataaatgcggttaggtg

SEQ ID NO: 8554 - DNA, 17205 bp, Oryza sativa
taacccacacatgtggcgccaaaaccacagggggttggggcgccccaaccctcggggccgaaacgggagcggcccgacccctcggggagacagagggaggggtggccacgtcaccctcgggcccgaccccccccgagggggtcaggccacgtgggtgaccgcggctacccaagcctctagtcacgatacccccggccccatgtcaccgacagcagccatggcgccggacagaaaaactcaaccgagaagggatgatgatgtggttgtttacacccaaatttggcacctagaattaaaataggaaatattgccgaaatttggaagtctaccggtttcctccgaagtgggccggtctgaccgccgtgtgttgggcggtcagaccggcggtgtgtggccggtatgaccggcaggtctgagtccgactctgtttcatcgggtctcaaagtttccttgctcggaaaggcatgtttcgggtttcctttggtttctaccccgagttggacgtggaggagggcctatagagggcaagaccaacccctatataagggacatggccggttcattgtaaaaaatcaatctacaatcaatcaatcgaatcgtttttcatattgcttttagttttctcttagtttgtccatctttgtcggtttgcgccgtaaaccgtccgccgccgctgcgagagtgcgacatctctttgtaggtttgtcatgaaaacctttcgttttgcccacgagatgggtagctatctagaaatcggctccactagccggtttagttatcaaaacccatctaggtttagctctttgctagatcgaggtggttggcgactctaggatcaccgcaaggcttaaggtgctgcgatcgtgcttgtcaacttgtcaaaaaagttgccaacacgatttttggcgactccgctggggaggagatccgttcatcgtcaactcaacttcgacttcgccatgacgaagccgccatccaagacggaggtggagccatctaatgtgatgccggtcacattggatgacttcgaaggagaagatcgcaaagctatggaggagtacatcaatgagctcacacgggaggcgttgatgagagcaactactaggactcgtcaaggcgtgatcatcaagcccgggccacgtcccaagctcgctcccgacgtggtaagtaatgacgaggtatcacaatctatccaacaacaaattgcatctacaatagattcatctatggctaattttaaagatagatttgatgtaatgtttaaggataaagttgatgggtttttaaggagtaggctcggttcttttatggatgattacacattaaaggataaagcctataccactgttgatcaacctcctatagatacaatgggtagtaaaaccgatggaacggcattcacggtcggtccgaccgggcctgacagccagtcagaccgcgacatagccgtcggttcgaccggccagacggccggtcagaccgggtattaccccagcggtcagaccggctttcaggctggtccgaccgcacatcatgacgccggtcagaccgggccttgggccggtcagaccggcgcaattgtcccaatacagggtatagatccaatgactaatgctaattatttgtaccactttagaacatttgatcctcctgtatctactgctacaagtaatcctcatgttcccccacatattcctaatgcttataatgatgcttctaggggatatcctcgcgatactagacaaggccaatataatcatattgcgccacaaacacatcctattaggccaccaaacccactgccaaatccataagagcctaataacatggaggatatgattagtgatattatgagtaatagattcgggattgaaactaggaatcgtgctagagcttacaaaaagccatatcctgattattatgataatgtgccgtttcctcgaaattatagagttcccgaatttgctaagtttagtggtgaggatggtaagaccacatgggagcatgtaggtcaatttttggcgcaatgtggtgaggctaatagtgatacttttaaattgcgcttgttttctttatctttatccggtaatgcttttacatggtttacttctttaccggcaaattctattcatacttgggctcaattagaagaacaatttcatgattatttctatactggggaaactgagcttaggttatgtgatttgacatcggttaagcaaaagtataatgaatctgtcattgattatattaagagatttagagatgttagaaaccaatgttatactttgaatataactaatagagatttggccggtcttgcttttaatggtttagttgctcctcttagagaaaaactagatggccaacaattttttgatgttagtcaactcatgcaaagggctctggctcaagaaagccgggttaaagataataaaaaatttgctagaccatttgacaaaaggcctaatgttaatgtagttgattatcctgaggctagtgataatgaggaggagggtgatcatgatatttatgttgtcgaatggtcgtggactaataaaaataagccttttgtttgctctaacttaatgccgactcctcgcaaagatcggcaaagtgaagttaagtatagttttgatgtggccaagtgtgataagatttttgattaccttttgcaagaaaaacaaattagattacctaaaggccatgtcataccattgcaagaagagttgaagcgtcgagcatattgtaaatggcatgattctcattctcactctactaatgattgcaatgtgtttcgacgacaggttcaattggccatagatgaaggacgattgaagttcaccgatggttccaagatgaagcttgatcatgatccttttccggtgaatacaattaatttcaatgataagaaggtgttgattcggccggagcaagccgaatctactaaggggaaggaagtggtcattggggaaccaaggtccaagatggtagtgccaaagaaggcggaggttggcgtttggaaggagaataagagtggagcttcaacttctaaggctcctaggaagaccaaactgacctttaatatgcttttggagaaatatgagaggcaaggtggtgagaaaattcgcaacaaagggaagagaccaagatcacctcctagggaacgatttggtcattcaccaagacggtcgcattcaccttcatatcatcatccacaagatatgtcatggggtccctattcgatgccgccgccgggttattcttatccctacttcatgccatggggggcaacgccgccaatgtaccatcatatgcctccaatgcaattcaaccaagggtggggaggaccaaggaggccaattcatgagtgattgtcttctccaaacaatagccggttctatggtaagaatcgggttaatgaagaaaagagggaaggaaaacgcgtcaaggtggaagagaggacttcggaagtaattactatcaaagtggggtcccatgatgtgcctataccttctggagatggagttggaaagtccccaagcaaaaaatccgaagccggtaccagctcctcgcagacgaccggtctgaccaggccctctggccagtctgaccgcggccatgttgccggtctgaccgggccataaggccggtctgatcgtcgacccgatagtggtccgaccgacgcctcaggccggtctgaccgtgtgccacacatcggtctgaccggcgcgtctggccggtctgaccgggctccagcgccggtttgatgagaggattgtaaagggcgatgtgagggcttcatcgtcttcaagcaaagtcaatagaggacattatttacctcctggaacagagccgaatcctaggtggatgcctgaggatttgacggctactcaaaagagaaggttgcaacgtcttcgggcccaagaactaagggagaaaaaggccgaagagcaaagggataaaaggttcaatgagttgctaccaccaccaatatggaggcctaaatccatagagaaggcaaaaccgattgatgtagaggagaaggaagaacaatcggttgataaaagtgaatcatctccaaagaaagacatggatatcaatatggtatgtatgttgcctatggagttttgtgctatggatgaagccgaagttgctcaattctcattaggtcctaaagatgcggtttttgagaagcccgatgaatcaaaccgtcacatgaagcctctctacctcaaaggctatgttgatgggaagccggtctctaggatgctagtggatggaggtgccgctgtgaatttgatgccgtactcgttattcaagaagttggggtgcgaggatgatgagttgaagaagactaacatgattctcaatggcttcaacggtgaaccaacggaggcgaggggtatcttttcggccgagctcaccgtgggaaacaagacgctaccaaccgctttcttcatcgtcgatgtgcaaggtaactacaatgttattttgggccgttgttggattcatgccaattgttgtgtgccttctaccttgcatcaatgtttaattcaatgggacggtgatgatgttgaaattgttcaagcggatacattggccgaggttgcaatggccgatgctacttttgagtggcgtcatgggaatatccaatgcttatcggggagggatctttctagctatgattttattagtatctccgatggcaaatttgtacctatctctgtaaggccggctagtgtagcacggctaagccatataaatttgtatagtgagtaaagaggataatttagagtggttacaaaaaagggtgcaagaatatcggtctacaaagaacgatattggagaaactgttgaagattttgatgaagtggagaagcttggacaagggtttacatcggccgatccattggaagaagtagacataggtgatggaactaaaccaaggctgacttttgtagacaaaaacatgagagccgattataaggttaagataatcgagctacttaaagagtatgttgattgctttgcatggaagtaccatgagatgccgggtcttagccgtgagcttgttgagcatcggcttccaattaaactgggttttaggccttagaaacaaccgcctcgtcgttttaatcctttactatatgaccgagtcaaagaagaaattgatcggttgttgaagacggggtttattaggccatgtcattatgcggagtgggtttccagcataatcccggtgagaagaaggggagtggtaagattagagtttgcatagattttagagatttaaataaagctactcccaaagatgaatatcctatgcctatagccgacatgatgattaatgatgcctcgggtcataaggtgattagctttttagatggtaatgccggctataatcaaatctttatggcggaagaggatatgtacaagacggcttttaggtggccgggatttgttggtttatttgagtgggttgtcatgacttttgggttgaagaatgccggtgcgacatatcaaagggcaatgaatttgatcttccatgatttgctaggtattatcttagagatctatattgatgatattgttgtcaaatcggatggtatggaaggacacatagccgatttgaggttagcgtttgagaggatgcgccggtatggtttgaagatgaacccacttaaatgtgcttttggtgtgtcagcggggaagttcttaggattcatggtgcatgagagaggagttgagattgatcctaagaagatagaaaagattcgtgatttcaaagctccgacatgcaagaaggaggttcaaaagttgctaggtaaactgaattatttgaggaggtttatttctaacctagcgggtaaaatcgatgcttttgttcctatacttcgcttgaaaaaagaagccgattttacttggggggcaaaacaacaagaggcattcgaagagttgaagagatatttgtctactccacccgttgtgcgagcgcctaaagccggaatgccttttcggttatatattgcctccgaagacaaagtcattggtgccgttttgatgcaagaggaagatggcaaggaatatatcattacatatttgagccgccgtcttttggatgctgaaacgaggtatgtctttatagaaaagctttgtttatgcttatactatgcttataccaaattgaggcattatttgttatctagtacatgcatagttacttgtcaagccgatgttattaaacacatgttgcaaaggccaattctaagtgggagaattggcaagtgggcatatgctttgatagaatatgatttggcttatgaaccattgaaatctataaaaggccaaattgtttgtgattttatagtagaccatcatatagatattgcttatgagggagaggtttgcttagttgaagttataccttggaagatttattttgatggttcttcttgcaaagaaggtcaaggcataggggtagttttgttttcacctaatggcatgtgttatgaggcatcggttcatttggaatattattgcacaaataatcaagccgaatacaatgctttattgttcggcttacaagttaaatatgtggaagctaaatatgtggaagcctttggtaattcggaattggtggtgcaacaagtcgtcggaatctacaaatgcttggacggatcactaaataggtatctcgattcatgtttagatattactgccaattttgataattttgctattagacatattgctaggcgtgataattctagagcaaatgacttggcacaacaagcatctggttataatgtgaaaaaggggttatttctgatattagaagagccagtgcttgattttaaatcttcgtgcgaaattggcaaaactggagaccaggggcggtctgaccggcgttgcatggccggtctgaccggtgaccaggggcggtctgaccggctgtatgctgccggtctgaccggcgaccccgagcggtctgaccggccctgcgtggccggtctgactggttttgggcagagcgctgggggcacgcttcaatcaatttggaagccgaattaattaagaattcagacatttgtgcccaggatgcagaagaggattggagaattcctttgattcaatatctgaaggatcccacgcttaaggttgatcggaaaattcggcggcaagcattcaaatataaattgcttgatggagatttgtatcgccgaaacagagatggtgtcttgttaaagtgcttagatgaagatcaatctaaagtggctatgagagaggtgcatgaaggaatttgtggaactcatcaatcggcccacaagatgaattggttgcttaggagagcggggttctattggctgaagatgattgatgattgcttcaaatattatagaggatgcgaggcttgtcaatggttcggcaatgttcaattggcgcccgccgccgtattgaaccctataatcaaaccatggccgttccgaggatgggctttggatttcattggtcaaatttatccttcgtcatcaaaggggcataggttcgtgttagttgctacggattacttcaccaagtgggccgaagccgtacctttgaagaatatgactcatacggaggtaattgactttattttgaagcaaattattcatagatttggtattccgcaaacattaactatggaccaaggtgcttcttttatgtctaaggaagtgaagagttttatcgaatcttatggcattaaattgttgagttcttctccttactacgctcaggctaatggacaagccgagtcgagtaataagacattgttaatgctagtgaaaaagaagattgaggaacacccgaagaggtggcatgaggtgttttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagatgttgatgggagacaaccttgatgaagtcatcgacaagcgcttgaaggcattggaagatatagagaaagagaagaagagggtggccaaggcgtataacaagagggtgaaagcgaaattgtttcaagttggagacttggtttggaagacaattttgcctttgggtactcgatccaaggagttcggtaagtggtctcctagttgggagggtccttatcgagtgtgcggcattgttcgagggaacgcatactttttagagacactacaaggggagcgttttcagcgagcaatcaacgggaaatacttgaagaaatacttctgagcgtttggcaagacgcttaggaggtactatggcctgtaattgggttatcgtcctaagaccaaaaacatgttctatgcttttagattcacgttgttcatcaaaaaggcaggggggcatgtgtttagacccaaatttggcagttaggattaaaataggaaatattgccgaaatttgaaagtccaccggtttcctctgaagtgggccggtctgaccgctgtgtgttgggcggtcagaccaccggttgagggccggtcagaccggcggtgtgtggccggtctgacggcaggtccgagtcctactctgtttcgtcgggtctcgaagtttccttgctcgggaaggcatgtttcgggtttcctttggtttctaccccgagttggacgtggaggagggcctgtagagggcaagaccaattcctatataagggacatggtcggttcattgtaaaaaatcaatctacaatcaatcgaatcgtttttcatattgcttttagttttctcttagtttgtccatctttgtcggtttgcgccgtaaaccgtccgccgctgctgcgagagtacgacatctctttgtaggtttgtcctgaaaaccttccgttttgcccacgagacgggtagctatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcaaaaaagttgccaaaagtggtttgagattttgaaattgataggtggtatagcttctaggatgtactacgatgttaccaacaaaaaggctcactggacggagaaatgcgcttgcgcgaggaaaaacatagcagcgcgcgcacttggtgtcgaactccgagaagacttgaaaagcttttagtatggcataatgatgccgaagtatcgcgttccagttccacccgaagatgatgaaggatttggcttgaattggtggatggtggtggagtgtatgcacacatagtgctcgatcactgtcccgtgcgaggccgtgcgcatcggcgcgtggacatctacgcttcggttgaccatggggcaacttaccaccatggtttgggccgaggtggactgatttagggtgcgtttggttagacttttcaacctgtttttttgcttttgcaaaacccaaaagctaactaaagggtctaaaagccacagctacttttatccaaagtcaacttttggtgtagtacaaatcaaaagcaactctacccccttattttcacttgcttttgggaaaaaaaattactcatccctaccattacgaaaaaaatggttcgctattcttttcccgtctcctcctccttgcgagtcgcacacggggagagggtttccgccgccgctgcccacggccggcgccggcgcccgtccggccccgcccagcgccgcccccgcccttccccaaccgttcggcctccgccggcgctgtcaaggccgactccatctccgctgccacgcgtctgcctccgccgtcgccgcggccgccgcacgcgcgtctgcctctgccaccactgccgaggccgactccatctccgctgatcctcttgccgaggcgcttgtcgacgtcgacaacgcggcgtcgcggcgcgcgctcgagaaggccgggttccagcaggaggccgtgctgtgcaactactgtgtcgtcaagggccagctcagggacatggtcatctacagcttcatctccactgatcctctcgtcgagtgatcaatggctaatcatgttgctgtgagattttttctatgtattgtgaatgtatgtatgataaaaaaaatattttgccaagaaaccaaattcagattactgcatgcaaaccagcaagaatttcagccacaaagtacagcaaatcctgcagtgccattctgcaagatgataaattcaggcaattcatcactacccagcagactactaatgtttcttccccaactaatctctgagaaaggtacactcatcgactcatcgtggggttggttatcgaatctatcttctccaatcccgattgatagattgaccaaagcgaaaaccgaaagaagttcagtgcatgaagtacaacaggaagatgatcagatgactgacgagatcatgcttcccatcctctgagaacggtggcgcgggccacacggttgacgccgagggtgaaggcgcccatgcggaggtcgcagtggtggctcctgcacatctccttctcatccctgaacccgcgggtcatgtaggtctgcccctgtcgccgccgccgcggcgcatgtctgcctccgccaccgccgctgaggccaactccatctccgctgccgcgcgacttctttttttttcaacgccatcgttcggtcgtacatcggcgggcatgggaggtggccgtgctggagctccggcgacggcgagcgcgcgtgcacggcagcctcagcctcgccgcccgcgtatgcctctgcctctgcctcggcctccgccgccgccaaggccgactccatctcttcttctttttttttccagagtgtatgacatgtgggacccgcttgtaagcaagactaatttttcaaaagccatagttgttgaaccatacgagcttttccaaaagtcacagcccatatttcacagcttcttttcaaaaagcaacgacccatggctactttttcaaaatccacagctcaaccaaacacaccattaggttgatgtcgggctttgcgggaagaaatttggctgggctgaggttttgcgccggcaagaatgggcttgacattctgtctagcaattggtggacatgaacagtatggttctgtattttcaggaagtttcagagaataaaatgaataatttggaggggcttggatgcaaagactttggtagaacttttttggactaaagcaagaatttgaaattcacacaagagttgaatttgagagggattgagagtttgggtcaaattaaaaaggaataagttcatctgaggtctcttaacttgtcaacgaattcaatttttttccttcaaccagaaaaccagatataacgggtccctcaactgtcaaaactggtgcaatataggtcccatgacggtttggacgacggttttagctgacatggcgcctacgtggctaaattgactcggtcttcatctgacgtggcagtgatgtaccctgttggtatttcttacgaccacagataaatccgcaagcgcacagaataccactgtagcactttaccttcgggtgaccccaaagggatatattgaactcagggaacgtttgtaatctacctaaggctaaaaaatctacctaaggctaagactatccaaggacaataactgatggtaggctagctaggctagagaggactttctatgtgttttagttatctaagctaagtaaaggaaatttcctatctgttgcattgggcaccaacccctgctggtatgccagcgtggttcctgctatagctttatgatgtacccgaacgtggaggattactacgacgggatttagggttgtcaccacttgccatctacctctaacaaatccgtgggatacacaacaaacaaaggtaatttctaacttagacaccacgcctaagttattaattactaatccctccgtttcctattataagactttctagcattgcccatattcatatacatgttaatgaatctagacatatatatgtgtttagattcattaacatctatatgaatgtgggcaatgctagaaagtcttataatatgaaacggaggaagtactctaatacttgcgcaggaacttccttctttacccagagtcctagtactagaccccttagtacgaatactaaataatgaacccgcaaagatggaaatatatcttacttagtctaagtaattaaataacataagaaatgatcttgaatccatactttatagaagaagtttctccgaacccggaacagagtgtaccgacagctccggtactcctcgaaagctacactcgtcgaggtagaagtcggagagagcgccaaacttccaggcacttctcaagagcttcctctcactctctacctattttctaatgtacaaagatacaatagaggctcttgtaattcagctcaaagttgtgtattgtgaagtgaagtgagctcctccttttatagcctccatatgacggttacagctatcggaattgtccaaaacacccttcaaccgtcattgggaagaaatcaggaatgtacacatggaagatggtgatcaatgaccttagaacggattcggccgaacccagaaaccctcctcccggcatctccttcggccgggaggtcgcttaatgggcccccaacatcatgtactatgatttggcccaattctaagtggttttgattgacatatgggccctccaatccatgtaaacacatcttggttgtctggaggtgtattttgtcgtatgacgggtgtgttttctctttaaaatacctgcatacacatatttcaccaacactagtgaaaatgattagtaataaaccctaccactaagttggataccatattttatttcattatatgcaggcgttgatggtcagatattatggtttaagaaccgtcaacatggtattgacgtggcaatttgcttgagaaaataacaaaaactgtggtcctacatgtcatttacacccaaaaaataattaaaaagtggggcccacgtgggccccacatgtcattctcaccctcttattccccttcttcctcctctctccccatctcccctctcttcatctctctccaggagagatggggagggcgggagatagcggcgcgctacagccggcgggagaagggagaggagggagtggtgcgtggcggacgacgagagactagagaggagggagcggcgtgcggcggccggccaacatggtcaccatgcacgccggacgacatggtgtagttgtcgctcccgatgcctcaaagggagaggagcacttcaccgttgacaccgagcatggcaacgacgaagcagaggatgagcacgatgagcggcaagaggattggtggcatcctccttgttctcatctctagcagcattgctggcatcctccttgttttcgttgccaatctgctaccactcatcgtggacgatcacaaaccgtggcggcgcgaagacggatgagacgggaagtggaagaggaggtgtgtgtcctcctccttctcgaacccatcgttgtcatcgtcttcggcggcgtaggcggcagggaagcaggagctgtagttgccgctcgcaccgctctgaaccaccctccgccgcctagagcggtcgccgccgctccgcccgccacccgccttgccactccgagcttctccctccaccgccgaaaaggagaaagggagagaggagcagagatgtggccgccactcgccccgctccgctccgcactcttctctccaccgcctggagcggtcaccgccgctctgaccaccgctcgcctcgcagctccgtgctccgccctccgccgcccatgtgccgaaaaggggaaagggagaaaggagtggagctgcggccgccgctcacccggctccactcccctcgctgctcgcctcgctctggcagctgggtgctccggccttcttgcaggttgaaggggagatagagaggatagagagagacaaggggagtagtgaggatgacatgtgaggccacatgagccccaccattttttattattttgtgtgtatttgacatgtgggtcccacggatattattattttttcggatctaattgccatttaggcaccacgtcaatgccacgttggacgaagacttagtccgtgtagaagccacgtcagccaaaaccggtatcaatactgctgagggacctcgtttgtatggttctgtaagttgggggattcgttgtatccggttttctggactgaggacgaaaatcaaactggacgataaattgagggacctagagtgaacttgttccaattaaaaaagttgaagctaagctttggtactgaagtggaaggaataagtagatgaattgcataattgatggcctttcataatagcattgcataatttatggcctttcatatttaaaagttacatttttcatattaaatttacattttaatactcatgttgactaggtctttttagaaaaatatcatatgggtgccccatatcatagacagatgttatgcaatagatgtatattttctttgtctttattgacttacatgcaaatatgtaacaagttatatgcatttgaattagaggtaaggatagcttgatacacatacaatatattcattaataattttttagtatttcataagaaaagagcgagacaatgaacattcaattaaaaagaatggaaaaacatcttacttttaatttgaaattaacttgtcaggcatgtttttaacaaactaatacacatgcccgcgtgtcgtgtgggctaccttcctagtttatacaatatttgtgaggatatggaatatcaacggtttgggatttaaagctaagagatagaatatggcattcttggacattgtatagaaaggataaattgaagaaaatgaaagatttgaaaattggcattagactaaaagagaattttctataaattcttgagaataataaaaaaactaaacaatttcataaattcaactcaagaagtagaaataaaaaagcggcatgatgcaatttgaaatatttaaattttgaggacgttacactacttattagataaggcatggggaaagaacccggaggacagcttccaatcaaccgatggcttcttgcaggataactacaccaacacaggcaccaaaagtaggcaattgatcatcaccaagcggcactaatggcttcacctcattaatctggtcagtaccaccaaataccgcgatagattgtattttggtgacctgtttaggcttagatttcatatcttgttaaatcagaatcttacaactatgatgaacagtacccattaactatctttttttctggagagatatttgtttccaggctattgcagctttattaacgctacatgtcaagcatagtcggcagctaatgtaagaggtaaattttgtctagtaatggctggtagaacatattcggaatacttgaatttgtccttcctaggcttacaaaaaaattggcatgaatattggaaagggtaaacatttctgaaatatgccttttatcatacaaatatactttcaacaatgcaatcttcattggtcagcatttctggaacacaatatgatgaaaaggtacacatgtcaaacaaacgaaagttttcctctattaaaaaagacaatttaaattactaggaaaatctgataattcaaatttacatcttttgaacaccttatttatcaaatgctcatcaaacgatgaaaaaaatgcttcatgttgattttctatttaggggaaattttagagttgtgtttttctggtaggaaatagatggttctccaagttagctcttatttgtccgactgcaggaaacgttctgcaaataagaaacacatgatcaaaaccagaaaagactcaagtcactggtggagaaaccctttgtagttccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttgcatggccctgttgctgcatggtttatatatatatatatatatatatatatatatatatatatatatatatatatatatatatatatacatatatatatgtatatatatatatatatatatatatatatatacatatatatatgtatatatatatatattatattatattatatgtatatacatgcataatatatatgtatttatacatatatatgttatgcaaatgcatatgtatatagatatatatatgaccaaaatatatttacattatagaaaatgtttacacatgcatatagaaacatatgtagtcatgtattaattacaatccattatatgtcctagctagctacgatttcgacgtagcagtagtcgctgctagctcagaagataaggaccggtgaattgtgtttccgtcgtagtagaattcacccttgggatcaaggatttcttcattgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacgtaacaagattttcttaattaacaaaggaacttatgacggtacctgtagacccccgtttttataacaggaatcactcgtgtaaactataccatttccctggatcaagtagtctggtacacacgaattcataactggaataccaatg

SEQ ID NO: 8555 - DNA, 430 bp, Oryza sativa
ttaaatcagctcatctcagcatgcttaatttacagttgacatcagccgtctgcatctatgcatggtttaggctggactattgagtttcctccctccggtgcctagagcgtttgatgttggccaagtgacactgacggtccataggtaggccgtaggcaagtactactcctagaattttgtcagtcaaaatatagctagtggcaatcggtcccttgacacagaattccgcagctaatgggtgttcattccttatagtaatccgtatactcaccagtggcatgcacaccgagaatccgagataggcggcagggagcggaaagccggaaagtgtactacatgcacgattagtcctaaagacatttcatcagcaactggtgagagtatgtggtggcgtagtggtggcaggctattcagctttgccttcacggtt

SEQ ID NO: 8556 - DNA, 1419 bp, Oryza sativa
tgtcactaaccctattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccaccagcagctatttcctcctcgcccgtttgatttccttcaaatccaacatactgagcaaagtccggaatattgtcgtcttccacttcatcttcttccatttcaacaccatgctctccgtgggatgtccaacaattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcatacatccattgccgatccatctacatgagtcaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgaaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagccccaaccggggctaaagatcaccgggatctttagccattaccaaccgggactaaagttaccaaccgggactaaagatcccgggggggcttgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagtggcacaaaatgaaac

SEQ ID NO: 8557 - DNA, 783 bp, Oryza sativa
tttggcttaaatccgtgctatatgtaaagaggagtattgaagtgaacactactaaataaaaaacgagtttttaggtaaaggaatattcccttcttgggatttttttcagcagtactcgtcattctattctataattctgactgctccttttactattgactagtttctctgcatttatctgtttttcacgagcttgaaacttttataagcacttacatatctttggattgattacctgtagatgcctaaaatagttcagcctaggatatctgaacaagttggaacaatagagtggtataatgggataaaaatgacaaaatacacgggggattgatcgaattcgcttcgttatgggaataaagaaattattgcgtaccttcatgatgggcgtctagatatttccgcttgaggctgggcagctgttgccgcaggcatgtagggagcacttttagagcagggcattcattaatgataagctgttggagggatgagtatgcttgcggtgaatcttgtagcgatgccaggcttttgcagtggtggagattgagttgtaccaacgaagggagctcgcccgagtgagactccagtgattcaggaggagagaagcggtccccagctggtgatgatggttccaacgcaacagcagacacaatgttgtcgctgcaaggccctgctggcccgtgtctctgctggccgaatatcgactcaagcttagggttgtcgtctatgtccatttccttgagagatggtggggcgttgaagatctctaccaaactttcacat

SEQ ID NO: 8558 - DNA, 1047 bp, Oryza sativa
agttggcaactctacctgaagcaccaaagctgagagtattagtatttcccgaagataaatcattgatgtggttatccatagcaagatatatggcaacactgtccgatgtcagattaacaattgcagcttcttcctcacaagtacaatgtgcaatacaacaggtcagtggtacagaagaatttagtcataaaacttctaatgcaactatggaactacggggatgttacttcttctgtatggattgggaatgttttgtgaacctgcaagatttagtaatcaactgctgcaacgaactcgtctattggccactgaaacagctccaatgcttggtatccttgaaaagattaacagtttattcttgcaataatctgactaaatctggtgatgttctagaagcgccattagaaaaaaatcagctactcccatgcttggagtatatagaaataaaagattgtcccaaattggttgaggttctcatccttccttcatctctaagggaaatatatattgagagatgtggtaagctcgagttcatatggggtcaaaaggacactgaaaataagagttggtatgctgaaaacaaagatgatttgaggtcagaatcttatagcatcctagtatcctctgcagatgcacctttggcaacaaatacacatttaccttgtatggagtctctaacagtgataagttgtcaaagcttagtagtgcttctcaattttcccctatatctgaaggaaatacacatttggagttgccctgagcttagatctataaggggaaagcaggatataaaagtcgaaagtaaatatgttgagcgtaataacggcatggctatatcagaatctagcagtgatctcagtgcatctataactatagaagatcaaggaacatggagaagcaaatatctcctgccatgcttagaatacctaagaatagcatattgtgtaagcttggtagaggttcttgctcttccttcatccatgagaactataattatttcagagtgtcctaagcttgaagtcctgtcagggaagcttgataaacttg

SEQ ID NO: 8559 - DNA, 7469 bp, Oryza sativa
  unsure (1)..(7469): unsure at all n locations
aaaaagcttatttaaccgcttcagtttagttttggttaacatttgatacattgagatgcttaaacaatttttatgcataaagcagtagaattgattaatgaatttttgaaaatttgtttgtgcaagataagcatgtggctatggaattgctgcccataagagaagttcacaggacagcagcgcaataatggtacgattgataattgcactcgtgctgtatgaattttgcacagttttgcttaatgggagtgtcccattcttaaagcttactaaagtcttgtttggcacaactatcgaaggtttttaggagctaggtatttctaagtccacaaattcattaatctgtatctgcgattatgttgacaatatttggatgaatcattttgttcctattttaaataaaactagcatggtggcccgcacggattgcgcgcatcattatattttctctcttataatagcatacatattttctcaatttattattaaatatattaaaatgacaacataattttaaattttgtactaactttaccaaactaccgacgtgtaatattcatacagtattgtatatatgtgatagttattgattatttttaatatcaaattttagttatttctaaattgtattcctatatggactctaggtttttcttcctatttttttaatttcgaattttagttatttgtaaattgtatttctatatggactttaaactgtacttttaatttattatttttatttcaaattttagttaattctaaattcctaatattccttttttaatatatactcttcttttaatattccttttttaattttgaatttctattatttcttagttgtatttctatatagactctgtactcttcttcttaaattcctgtatggactctatactcttcttctaatatttcctttttcaattctgaatttctattatttcttaattgtatttctatatggattctaacataattttatttttctttttttaaaattctgaatttttattgattctaaattgtataccggcatggactctagtctccttttccaatattccttttttcgccgggacaacgaagaatgccgaccgatgtatatcccccctgcaggagggggacaaatgcagtgcgtcaaagcatcgccttcacaaccttaagcnangnnacaaaggctataatgtccctaaagttggcgctgcggcaacacttaacgagctaactagccctgctatttccatgtttcccattcatcacacatgatcacacacagttgtgtgaccgacgaggatgttccctcgaaaacccgtgcgttgcactctttccaaatcaaccacgtaacgaggatgacctcagcgtcgaagtctggcggtcgatcttcgcaacagactgtcgggtagcgagccaccaactggcaaaatctgaggacagcagcgagcacaagaagctcaatcgagcctggacctgcatccaaacctgctgcgataaggggcaagcctggaagatgtgttggcaggactctccatcctcggagcaaaaaagtgacaaattggtgcaagcttccaacctcggcgctgcagcttatcgactgttaaacaggcattgcggacggcaaggaacatgaagaacttgcatctcgctgacgcacgggatttccaaataatcttgccaagcgggcaggatgttctgccggccaaaaggatagagtaggtagaccgcacctagaagtcgccacttccagatcatagagtccgtacttccggggttgagagaaatcccggcgaccatgtcccagagcgcaaggtatttgtttatgcgaaaacacgtgatctggaagatctgcttaatttcagtgcaggtccaaaaatcttgcctttaggttcgtgagcgtgccggttgatttgatcttgcaatcaacaagaaataaagacaaagaaaccatggttaaatccataaatgatagccgattggccagccgccgatgacgtatcatttatctttgagccgatgtcatatttgattcgatcggcaattataaataagtaagaactaaatctatttgattggctgaagatattaatagcatataatgcttccgtcgatatatacttaaatcaagtgattgggatagatcggtcgccatgccgagacagtataaatctcttaaatcgaaatatatattaacaaggagattataagcattcacagcatagccgataagatagatccagcatgtatcggctaatactccgatactactttatattaagatattaaagcaagcaaaatatatcaaacaaaaagcttaatatatgtaaatacgacaagatcttaacataatgggcaaatttaacatatcggtcaagcacataatatatgaaggagttaaatcaggtaagatcggctgaaaccccgatactactctaatcgacaaccaaaaggcaggctaaagactgagattctaatcatgacttataagatcaaactcaactgatgcagctataagtatgaaaagaaggacaatatctagacaatcaagccactggctgtttcatggagtggtggataccctatataatctacgtcaacattggtatttaacctgatcggctgccttccaatgacggatgttagccgattgaaggttaaataacgatattgttagagattatatagggtatatgataactcaaagaattacataaacaatattagagtatcataaagatggaagcattaatcccgagaacgcaagccgccataacaagtttagccgatcctgatcgctgccgattcggactttagccgattctcgctctgtttctagaatgatctccatcttggattccgcttcggatttatctttatctccgatacttgaattaccaaatttggttgttaacagtattcccctatcgcttggacagacaggtcgcccctaacatcttcaatccaggaattgtcgtggaggacggcaaccaccatgattcccctcagcttgacaaaagagaaaagaattggaaatctgtactgcactgatcctccgtccggcaaccagctatcgcaccaaaacaaggtagaggctccgttccccagcagtactttgctaccagtggcaaagcagtgtagtgactttttgtcagcaagaggtgcaacgcgcgtccaggaacgctctagctcagtgcggtgcaatcaaatccaccgagcgcgaagcgccattcccattaggcgtaggtttatgatccctaatccccattgctcgatagggaggcaaagcttctcccaagccaccaagctgcacgagaccgcagcatcttcgtcgcccttccaaacaaaaccccggcctttcttttcgatttcgttgattgcccaggctagtagttccaacggacatgtagagtgggagcgccattaacactggcttgatcagggctaagcgggcatttggagataaaagcttgggcttctagccagccagatttttggcaagcctatccatcatcgattggatttgcgctttcgtcggtttacgcacagaaagtggcagcccaggtaaacaatcggcaattgcttgattgggcatgtcaacacctccgtcacctcttcaatttgggtatcggtgcaatggatcaggatcaacgagctcttggccagattggaaaccaagacggtggcgtcgcccatcagcttgagcacgaagtggattgtcagcgcatcccatcgggaaggatggaagaagatgatggtatcatctgcgtacattgaggcgcggagcggcaaggaatccgtagcaaggggggaaaacgcgctacggcgtgccaccgttgcgcaaagagccacaaacgcctccatcacaaggacaaaaagcaacggcgagagaggatccccttgcctgagtccccgagctagcctgatcctctgagtatctctaccgttcatggtgacggtggttgaagaagtgaaaagcagagtagaaacacagtcgcgccatcgagcgccgaagcccaaatgtcagagcaggtccaaaaggaattcccatgagaccgtatcaaaagcttttgcgatgtcaatcttcaacaacatggcaggcgttttggaccgatgtaacttcttaaccacaccttgaatgtagaggaagttctcttgtattcttcttcgcctaatgaaggctgactgtgcaggccctatcagctcatccattcttggggcgagacggagctccagaattttggttagaatcttagcgaaactgtgaatcaaactaattgggcggaagtcagttagttgattcgggtcctctttcttgggcaacaagatgatggaggccgtgttgatgagatgcaggtgctgggaattcgctctccaggctaagttaagagccgcaaccaggtcacccttgataattccccaacagaccttgaagaaagtggcgctgaaaccatctagccgtggcaccttgtcacttggtgacgccatgatcgcctttttcacctcttcctcagtgacgtcgccctccaattcagagagatcgtgggccgccaaaccaatcgagtcgaggttaatggacgccgaaggcggactatacgtccccaaaatattgaggaaatagttgtaggaagcctgcaacttatcttcctcggtggtagcatagacaccgtcatgacagagggtaggaattgcattctttcttcgatgtgcattgattttaaggcggaaaattgctccgttgtgccgctatgtttgaggaataacagcctggctcgctaacggaggaacctatatggactctgtttttctttttctccgattaatatgagaatttctaggccatgagagtgaacgtagaggctcctttttctatttctttaataagttaatagatatcgaattttaaatcagtgtaatttaacatacaaactttaaatccggcatagataaaggatgtggagctatcaaacatgacttaacatagacattgagttatatggttaaagagacgtgttttaacgttggggtcatacttatttgtctgaaacgttgatctggaggaatgttaacaagatttgtcttcaataacaaattaattctgaattaacatatacacagatttttgcaaagccgtcccaggaaaaaaaattgaaaaaaaagcatggccaacgagcaagaataggtccataactagcatggccatagtggatcaataattgcagttgatgaggaaagaatcattgcacagttgtgcttatctggaagggtcccaactgtgacagcacaaagatatagacaagcaagtcaagaccagtccagtcctaacttagtattatagttattaattttaggtttgtaattattggaattggcctgtactctaaaagtttttactatatcacgaggaaactataattgactaatttcgaatgttggaattatttaatggtcaggaaaaacgaccaaaaactagtatgtatattgtgctgcagtttctccctttcatttttatgtatgttggaattatttttgtttacacatatcatctatccacatggcctccttcctgttaggacttctgaagcactgccaaactaaaatcttcaggatggccataattgattgcttttgatgatttcacccttattttgctgcgcgtatacgtttgaattctttttttttttactgctgagatctgcatttaggctattactaaccatctcatcagtgtgttacgtagccacaaaattcaacttctttttcaaggagtataggtacactgaattgtgagagcggaactcatgcaatcagttagcagcatcgcaccgttgtaacttcctacaatcttaccatcgatgaaaaacagagaaaaagggtagagatggcctactgtctttttcataatttaatgacctagatttttcataaaggctaagcaccagtccctactttgtttagcagcttctggacatcaattgcttgtcaggttgggaatgtagcgtaatttacaacgggtgttcattccctttcaaagtaagtggctaataattatattcaggatcatgacaaattgcaacttgctgcacacagcgatggacaatgacagcacattacgcgcaccttttcttctaccagtggaggtccatcttgtactgattgattgggacgctgtccaagataaattgtggacagaccccattgaaccaccagttccctctccatttcattgatatttgtgtgtaagctctacaatgggtgaactggtgaccagcatggtgatcgggccactggtccacatggtgaaggagaaggcttccagctacctcctggagcagtacaaggtgatggaaggcatggaagtgcagcacaagatcctcaagcgcaagctgccggccatcttggacgtcatctctgacgctgagaagcaggcatctgaacacagggaaggagctaaggcctggcttgaggagctcaaggcagtggcctatgaggcgaatgaagtcttcgacgagttcaagtacgaggcgctacggcgtgaagccaagaagaacgggcactacaccaagctcggcatcgatgcggtaaaactctttcctactcacaaccgtgtcgtgttccgatacaagatgggcaggaagctctgccggatcgtgcagaatattgaagtgctagtcgcagagatgaatgcctttgggtttaaattcgaacctcagtctatagagtccaaggaatggaggctaaccgattctgacatctttgacccaatgaacattgctagcagatcgagagatgaagataagaagctgctcgttagcatattgctctcccaagcaagcaatgtaaaactcgccgtccttcctattgttggaatgggagggctaggcaaaactaccttagccaaactcatttacaatgagcctgaaattcagaaccatttccagttgatgatctgggtatgtgtgtctgacaactttgatgttgcgtctgttgctagaagtatagttgatgcagttcctaaaaaaggtgataaagtaaccatcaatgaaaatcaaacctcggcacttgacgagcttcagaaattagtgagcgggcagaggtatctccttgtattggacgatgtttggaatagggatgatgaaaaatggcgtaaactgaagaaatgcctcgaacatggtagcactggtagtgcagtgttagcaacaactcgtgaaggaggagttgctgaactaatgcacacaactgatgcatataatcttactgctctaaataacagtgtcattaaggaaatcattgacacagcagcttttagaccgaaaaaggagatcaagcccgctgagctagttcaaatggatgataagtcattattatctaaaaagaaggaaatgattgatcagtttgtggagagatgtgctgggttgccattggcagcaaaagcactaggttctgtactttataccaagaccagcctggaagaa

SEQ ID NO: 8560 - DNA, 1105 bp, Oryza sativa
cctgcagcccctatactgtctacgaactttgaacctttctgactgcagtgatctctatcgacttccaaaacaaatgaagtacatgacagccctctgtcacctccacactcatggatgtacaagtttgaagcacatgcctccagatttgggaaaactcacttccttacaaacactcacttgttttgtagctggtactggctctggttgcagtaatgtcggagagctacaacatttagatatcagcggtcaactagagctacgtcagatggaaaatgttaacgaggaagatgcaagactgatgaaacttgaaaacaagaagctctcaacactttctttagtatggaatgaaaatgacaaagaagatcgatcttacaccaatgcatcagattgtcatgagaaggtgatcgaagctctcaaacctcatgatgagcttcgcgttctgaatgtcaaatcctgcaagagctcatctttcccatcatggatgggtatgcttaaacgccttgtagagattgatctaaataattgtacaatgtgccaaaatattccttcagtttggcagctacaagatcttcaagttcttcggctggatggattccatggactgcagtatttgtgcagcattggtcaaaccatgagataccgtcaacattcccaaaactaaaagagcttaaactaacaaacttgaagagtttcaaccgatggtgggaaataaatgagagacaagaaaagcttgattttcctcagcttgagaagctggttattaagggatgtggggttggagagctaacatcactgcctactagtgacagtaatatgtcagagcctgcattaccagctttaaaggaactcgaactctgtgatttaaatcaattcgagagatggcaggcagcggaaggaacacaagacaaaccaccgaccttccctaaccttgagaacattagtattgtgaaatgtccagaagtgacaagtctaccagaagcaccaaagctcagtgtgttagacataggaaatggctctgaacagatgctcctttgcatacctagatacatggcttcattgtccactctgagattgcagcatgaaggtgaagaaacaacacctctaa

SEQ ID NO: 8561 - DNA, 804 bp, Oryza sativa
caatatgcttgtaaaccaatagcattctcgtaaataacacatgttaccatctaaggacaaacatgccctgacaataagttaggttttgatagccaccctaatggcgaactagtgattattaggatagtgtatggttccagagttgatggaaatctcaatccgtcccgccatgaatcacatgatacaactaatatgattaatccacaactgcacaactatatgtgcattttgacgattttccaacaaaaaaaaaggggacgccacgagcaaagaaacaaaccttctcgccatggctgcccctcggcctccttcggtgtgagcgtgatctcggcgacgcaggagccgtcatccacaagaatgtgcccggcgccgtcgcggtagtccgccagcaccaccacgccctgcctgccgccacaagtcgtcagggagagatggagctaggagatggggggaatagggaatggtggggaggcgacctggagccagacgcgctggaagcggatgccgtagagcatctgggcctgcgaggtgccgtccgactccgagggaggggcctcggtggcgccggccagctggcaaccgaagagcttcagcgccgcgagggtgtagtccatgttgttccgcttcggcgccgccgccgccgccgccgcgccgccgacaggttgagcaccggaaccctccattgcggcgccctctctctccggtgctctctcgggtctcaactctcaacaaacagttcaactacactgatcgcagatgggccgtgtacctgggcctaattaggcgagggccactacatgatgc

SEQ ID NO: 8562 - DNA, 14761 bp, Oryza sativa
tggcaaaacatatctaggcagattactgtagttgtcactttcaattctcaaaaaagaactagaaactaagttctgttgttgggcttcagccttaagacgtacaagcacttaaacattacccactgcattagttttcctgaggactcttatcagcatcttgcttttaacgactttgaacttgattgttgcaggtgcataagctagtcgatctttccgcgcagcccgaccgtgaatcaatgtggtacatggaagtagttgaggccttcaacttcttttacttgcagttctcggctgctagcccactgatgaagcgctagtgtccctgacctcttgttctctccagtgctcagatgcttcgtttggctgtaggcctgtaggctgtagcccttcctaacacttgtccagtgcctatttttaacgggtagtttttgttagggctaatatgtactccttcgagcatctcacattgtggtcgttcatgtcgtggatgggtttatttgggagacgtaaacttttatcccaaagaaacttgtccagagtaatactaacctttcatgttggtaaaagagaatgaattctcagatgcactcagaaatcctttttgtgccattgataacatgaaagaaatctgcaaacttttttatggcgtatacctgaatagtaagtagggttcgctttagcatttgtctcacctggttgctttgtagccaacaaaattggcattgccaaattatttggcttacttgaatatcaaaatactacctccggccagttatattcatggttttagagaaaagtcctggcttattttctttgtaatttcagttcaaagggattttccagaaattaccgctcattgagttgaactactcggcatcgggagcattttcattttctttgtaatttggatatttggttgtcctaaatgtcaattaattatatccagagggagtataacttcttaaagttggtaagcagaccagacaaatcatagctatttttcgccaaaaatttgaggaggtgactagggatcggtcgtccgatccaaatctccaaaaatcgggcgctgacgtcagtgctacccatatgtgtaaaaccactttaaactaatttttttctcttctaaaattttttttctcttaaattatttatccaaatcatgatccgattgcaccattaaattcgttgtaattaaatattcaaaacaagaccacacatggatatatttcgacgaaatttttttagcttattattgactttttttaaaatgttgcacgatgttccaccagttatatcggaattgtttcactaagtagaacggaaatatttcaatcgttagaatcgggtgttgtttcaccttatataaaaacaatgtttcagcaaataacgaaaaaaaagtttcaattcactgcaacattagaaccgtacatagtgaaacattataagtacactaagtgaaacatttttttggtggaaaaaaaagaaacgaattccgagggtttccaaaatatatggatgatttgttgcaatggagtatttcaattcactgcaacattagatctatagatagtgaatcattatgagtgtagtagatgaaacattttcggtggaacaacaaataaaccaaattctcttaacaaagggtttttaaaatatgtgggtaatttgttgtaatagggttgtgtgtgtggacacgtggtggaccagggaagagcgcgcgtgcatggggtgggggggggtgcccgagttctgctcccccgcccgatcacccgatggcaatcattctcgaaaattttagcaaaaaccaatttttgtccttcccaaaaaaatccggcaaggctgaaaatagcatgaaccaaacaaacaagccgagacgggacggggctaaatatagcgaccctccgccgtcgctatacgacgtcgacgctacggagtactcaataactcaaacgacggtatagtagtagccagatcatatctaatccatgccggtggacactgccagtgggacccacatgggtcctctgatctccagtaccttcatattccgggctggagaagacgacgaaacagaggaacagctggcagcccaccccaccatgaatagaactgggccccaccagccagaagtaacggacaaacgtcatcccaccggagcatccgcccccgtccgatccgcgatcggacggcccagatcgcccccgcccgcgcgagcccgctcagccaccagctcatctactggatagcattttcccttgccgcttcttccttctcgcctcgccgtcgtcgccttcaacttcgaggcgagaagcgcgagatcccaaaaaaaaaaaaagaaaaaatagaaaaaaaaaacaagcgaggaacaggagaagcgccgcggcagctagctgccacgtggacctcgccgccggcgtcgccgccgccgccgcgcgtggatgcccccgcggagcccgcgcccatggcgtccgtttcgtcgtccccgtcgtactcgtcgcaggccgccgtcctcctcctcctccaccagccgccgcaccagcacgggcacggcggcgcgtgcctccggtaccgcggctcgcagtcgcaggggagggggaatgccgtagctacgtcgctggggctctccgcggcagggcggggcggagcggggggcctcctcctgctgccgccgctgcccgcgctgcgggcggcggaggggaaggatgggcgggccgtgaccaaggatgaggaggaggaggcggcggcggcggcggtggaggaggagggggaggtggaggtgaggagggaggaggacaagccaggggacgatgggtcaagggaggccgcagcgaggggatcggggtcggggcgattctccgccgactacatctcgctcggcatcagggagcccgtctacgaggtaaccgatcggcgatcgaacgccttgtaatggttaatggtaaattggagacagcaagggactcattcttatgatcatataagtcaaaatttaaattttagaacttaattttgaatttgattttttttcattgtagattattcgccgcatttgtttttttagtcactaaggatacgtatataaaagctttactcacaaatgattttttatttgctaataagcgattcggataaggttgcaaggtcgtgcatcagctaacttctgttcctagtcagaattatggattgcaatagctcatgttctcaaggtcttaagtccactcaacaagccaaatggaaatattgcaatatgatcattgtgagtgtccaaacgtaaataaacaatacattatatgccgttaatccaaacgtgtaactttggatggagggctaccagtaggcttcatgcataataaatctttctctaggttcagattttgctctctctttttttcaagtcatggggagttatgtccctcgttgagatcattttctttgcaaactcaaatggccgtgtgcatcctagatgcagaggctggggatgtaatcatctcccttatctaaaataaatctgcaattgtcatgctaatttgatgcatgtttctgtaagggtaggtttgctttggaatgaaatgcctgttacatattctgggacttctgcaaattgcaagatgcaaattaactttcccggatatcaaattttactcaggtgatagaagtaaaatctaatgggaggatgtctaccaaaaaaataagccggaggcagctattgaaatcaagtggtaggtagaaagaatatgtttctcaaggactgtaaaaaacatgattatgtagtctgtaccaaactctcatatagtgcttgataatttactggtaacagttttagaatttgaaaatgctgccatttcttgtggttttgttcattcttgtgaatgtcaagctcattgacagtatttatgttgatcaccgaccttttcttataggcctccgcctacgagataccagaagcgttgacccatcgctatggctaatgaattcaatgccatccttgctggtaataagatactttcaataattaatcatgtagactttactctgtatatgtttcccatcttttcctacaattttcagttacacaaacaatggaatgagtgatgctaataattgtgtatgtacaagagtctgaagatagtacaattgctctgttacaagtatctcaggttgcctgtcaaaattacctatgttattatagtcaatcacagagtcagagttcaattttttttattcaaagatagaagtaaagaaaaaggttttaattctgcaatattttccagctcacatttcgtttagctgtctttttcagtaacctgcattgtgattgtaatcttgacaaccactgttcattactatgaactgataacatacatagaatatttgtgtatagcttttcatgtaaacttccatatcaatatatttgaactctatgtttgcatggttactagattctagatttatgtagaagttaattttttgccttatcaacctgcttcacagttcaacatattgcttctatgtaccatttcatataggtccgtgaacaagccatattagtaaatcttggttccttgcgagcaattgctatgcatgaacgcgttcttatattcaattacaacaggtcagtttgtacactagtcattttaatataaattgtattttacttggtgaacatcactattgttatgaaacttatcaattattttatctgacttgagtagcccaggaggaaaggccttcttagattcattactgccacggttaaatccaagaaatatcaatggtggaccagcaatgccatttcaacttgaggtatcaggcatatggatattcttatattaatccatatttgtggtctggaacagtcttaatatgatgatattttccttgtcaattgtttcatttatatttgcctccatggaaggtttactttgttttcaactcacataggaataagattgtcatccatgagttttcctagtttctcttaacggtcgaatggaatcttgaacaagaataggattatcatctttgattttaaaagttctttttgattgtacaatatcttttttggtctcattagttattatattaaatcatttaacatatattgctgacaaaaaacatttttatcgccatcatgcatttgccaacatgtcatgctatgcttgcattttcacccgattattgagagtaccatcctcctgccaaatactgggccaagatgatctggttatttattgccttctcttatattcaggttgtcgaagctgccctgctttctagaatacaaaggttggagcgaaggctaatgcgtatcgagcctcgtgtgagtgccagaaaagtccctgctagctctacatcttgtacaagattgtatatcctgatgttgttagttctactttctggtgcatattcaatttatggagcaatctgatatattgtcaataggtgacttaagacacttacgaattcctgttcctgtcctctattttcttgatttcaaccttgaaaacttcattcaaagcacatatatacagaactgaaccaataataatgcatgttatttccatatcctgcaccctaactctttcctttggcatttagaagtccctgactgcagatttgcacgccttcctctatatttttatacatctttaccaaatggactaattgaagcacctgatcttcacacaagtcaactgcacaaatcataagctactgtcaatacctagctttttgctgagcacttactaagtttaacactagggagtaaggatcttcttgaagtcccttgtaaatcacagacaagacatagaccagtaccatgtgtccgtgccacatgatcactgcagaattccttcttttttaaaaaaaatgggaaacagtcggaaagagccctaccaagctgaccctgcattttcatgtggtattttaggtgttgtcgtattcttgtgtttgtgtttcagtcatgtatggatcaagaacatgccagtgttcaaattgactctatttataatggaaaaaataataatttgggtatctgggcttatatctcaggtgggtgctttgcttgaagttctaccaaatcggttgacagctgatgtgttggagcagcttcgtctaagcaaacaagcattggtattaaagctgcgctttagaatcatttcctggacttgtttgtcaagtttaattttgtctctattcatgtgtcaaggttgagctgggttcacgagcaggtgatctcaaacaaatgcttattgatctcctagatgatcctcatgaaatccgtcgaatatgcataatgggaagaaattgcacgctcgacaaattaagtgataacatggagtgctccgttcctttagagaagcagattgctgaaggtatggattgagagcatcattggactttttatattttggagacatattactgccttcatggatttttttttgtttccaagcatggcatgtgcggaattcacaaggagtgttgcaatcacttatttgtcagtagttaactgtttgattctgttttacttgtttcatctgtattttttttgttttaacagaagaagaggaagaaattgaaatgttgttggaaaattatcttcaaaggtattcatctgcaatacaatcttttcagatgtcttgtttctttcttgcagaccttcattgtgtattcttactgtcagatgtgaatcaatccatggtcaagcagagagacttcttgattctgcaagagaaatggaagattcaattgcggtcaacttaaggtctgtctactctcacagaccacatgatctcacaaagtttagcttcatcaatgcatgtgttcttataatttataacaatgctcacttttgtgatttttttgctcttgaatataattggacagtaaaaatatatgtgtaaatgtatgaattttaataaaaactatattttgaatttaataaacgatctaaggtgacaaccgaacataaattactagttcaaccagacaatcaaccattgttttctactcttctctctacatttatattccaaatcatgtgcatggtccataatttgtttaacaccctgaagtcactccaacttggactaaaatggtctttgatttgcaagccctgcatctaaacagacatcgcattttatttgctgcctctaaactgtttctagcagctactatttctttgtgaacccttcatccaagcgactgagtccaactgtacttatcataaagctaggctgcgtgcatctagaagatcatgtagcatggtagcttttcagcaaaaagaaagagaaacacgttctccaatatggaaatagaatttatatccatcagataactgtaaaatgatctttcacatatttgcagtacaaccaaactacaattagcatcactacaaatggacatttcagattcttaaattttatagctatattgtggcgactagcgagaaaataccaattaagagcaaacaatacactccaagtctccaacatagatgaaattaagaaagcaaatgcaagaattacttggaaatggaggacgcaccaattatgtaccggatacgtacatagtactagtctcaaaattttgcaaatgttcttttgtgggttggggccttgggggcatgacttcattatcctccatcctttactctctgtggtgtgcgggtgtccacaggccatggcggtgtgtactttgcaacataaaatgccagcattatgtttcaggtttcaattatcaaagcataaccagataaaagaaagggggactgcttgagtgcttcaaattgcattcccataattttatttttttagaactgatttaagatgaaattatgagagtgggtcttggtataaggtggtgtgttcctgcacctctgtttgtgtagcatacaatcacaataaactatttgagaattgtgggatcttgttctttttggcggatgtgaaatttatgtgaactagctcaacatcacaaacatttcataaattatgggttttcttaattcttaccacattgggcatccttacagctcccggagacttgaagtaagcagagttgagttgcttcttcaggttggaacattctgcgtcgccataggagcattaattgcaggtacaaaaatctgtcagcgcttttgtatctagtgattttcaaatttcagttcctttctatcactctttattcttgaagtaatgctataattgaaccgttgtatttgtttcctgtaggaatatttggcatgaaccttaaatcgtacctcgagacaaacgcggtatagcattgcactcttgagttcaattctgctttctgccacgtactggcactacttgatatagcatgagttgatgacgagtttattttggagcagtgggcattttgggcgacaactggtggaatagtagttggagcagtggctggatttttcatcatgtactcatacctaaagactagaaagatattgtaaaactctgtagcattcggtactcctaggaatgtaaataattcggttttgatctcattttgaaagctattgatggaggcacgtacagattcatatgagattgctttgatgctcccacgaatgctgtcgtgggcgtcggttctgaactttggaccaagcgttcgctgcacgcctgatgaagctagcagcctagcaccaagaccatagtatttcgcatctcttacataaagccgtggcggttttcatgactgcactgggtgagagtgctgaacagtgtaactctagattgatcaatgttactgattatctttgaaaatatttgcctggatccaactttgtcccgcgttgacatgcgcatggatttccccttgtgctttcacttttcatacaggctgcctgtgtcagttccacgtgtaattaagatttggctcatcgtgattgaaccttcctccgtcataaaataagttaatttttagagttgaaactttgtctcaagataagtttatttctactttcttacctaggttctccacaaatcacccctttttaatgtactagttttctattaataaggggttttggtcttttttcctcacacacactaaagtttcccgggatatcagtgattcactaatttcgggactgaataaggatataagaaggtgcctgtgatgttagaaatgcagtgtatttccactatgaagttttgcaagtgacatccctattgagtgttatcggagaagtgggaacaggggttcccctcggggcgttgtggctcatactaagacctacaagatctacatcttcaaagtgtcaagaagagtatgagactcaaaagatctatagtttcaaggtatcaataagagtatacagacctatgagatctacatcttcaaggtgtagaagtgagcatagatagacatagggacaattggaacgaagacttttgcctatctaatccacttgttagtctataggtgtgattgtcacatctggccaactagcttggagggatagcgacaaggctaaacatatcaagtttagtggagtgggcgccactcctacatgcatgcatcggcattgacgaccccccccccctcacgtataaaaggaggatccatgccaccgataaaagggctcgtacactcatctaatctaggttagccaaacattgggtgagaaaggatcttctcctcctcacttaggctgcgttcggtagaacattttcccaactccttctcctcgttttccgcgcgcacgtttttcaaactgctaaacggtgcgttttttataaaaagtttctataggaaagttgcttaaaaaaatcatattaatctatttttgaaaaaaaattagcaaatacttaattaatcacgtgctaatcgctgctccgttttccgtgccggggagtgagggttcccaacccttactcccgaacacagccgaacttttcacatcttacttataattatcttcatcatccatgtccaccatacaagagtagggtattacgtatatgtgcggttcgaacatgtatactcgctttgtgtccattccctttgcataatcaggacccaagctcaaaacttgctcccccagccaaactcacatagagggagtgcctagcttccccgctagaggagttccgtactccgacaagtgtattggtaggtgggtacatgtggtggtgtgtgcatttccatgtaattgaaaataacctaccatttatgtagagagagcaccagtggggtgatggtagagccataggttcatgattctatccatcattctttaaattctggtgttcacaaatattatacacatataagttggttttcaacaggaggattttagtaaggtaaggtgtgtgtgataatcgagagaaaaaaaacacctgccacatacataattaggtgtgaagaaaagaaataactcaacagatttacccgaggatgcaatgagaaaaaggaaacaatgtctctgattcttagaggtatagcgaatgcatcttgtgatctaacttcgtctatgataatgtgacatatgaaatttcaggtgtaaaacaccatctttacgggtaaattttacatgttcgataaataatagacattacttaaagtttgtagagacatcttagtaaaataatatacacatcttttacgtattaggtttaaaacattatcattgtggataaaacctacatgttccataaaatagtagacaacacttaaaatttgtactaacatcttcttaatacaacaatgggcacatcttttacaaattacaaaaagtattaataacaaatcgtataagtccattcttagcaaaaagtttcatttcacggttaccaatattgttatgtcgtcaaaagagttttgaatcgataaatgaaataaaaccttcagtgtacaatttcattttgtggctttttaggttagtcataacatttaataataatgcatgggattgaatgcagttggatgaaatggaatactcgagctcctcaatgccagtttcaaatagttttatagtcttagaaacagtgtacatccagttccatatatatgaaactcttttaatctctcttcataatgatattgccatgtcatcaaatttgtttgaatggcatctcatttattgagaaaaaactctataaaactaccactagaaattttttgttacattaaccaccattgaaattggcctaagagcaatttcaatagaagagtaagccgtcagctctaaaacctatcaaacacatagagtgctgctccaccaaacagatatcatgtacaacaaaagtctacaagcttgccatcacgcaattaccaaagtcttttttttaatgttatgcctataactgttatttttttcttcacactttgctaattttgtagactccataattatatgggacagtaaggaacaatccgttgttactattatcgcctcaacatggaagtgtagtaggcaactattaatcaccgattcacactctctcccccttatttctctgccaagtgccaactcagcatattagtctgcatgcatgtagtatgatcgattaaaacgatctgctgtacctgctaaacttgtgacattcaaaccgatcgcaaaatattttgatctcgcaaatattgatgtacgtacactagtaaaacaactacaaatccaactgtagtctgtagttatcccggtagatgtccccgtcccgtgtgcgaccaattcgccgttcgttgggaggcgcgcgcgccgctcgccttcgctaacgccgcgcgtcacgtagacacgtactactagccgaacggagccgcggaacgaaggggaagtcagtgagggcgaagcacacgtggcgctctccatctctaaccgccgccaatggcgtcgtccccgcggccggcggcgacggcggcggcgcaccgccgggggctgatccagcgcccgccctccgcgcaggcctacctctccgccgcggcggcgctcctcgtcctcgccgccgtcgccttctcccgcgccggccaccgcttcccgcacccgcccgccacccgccgctgccgccccgacgccgagggctcctggtccgccggcgtcttcctcggcgactccccgttctccctcgagcccatcgaacacgtaactgctccctagaacacgcgagagctcctgcttattaggtttcggtgtgcgatgcgtgggggggggggggtgccgatcgaacgacgccagatgacttggctgatctccgtgccttgcagtgggggatctcgaaggccgacggcgcggcgtggccggtggcgaacccggtggtgacgtgcgccgaagtggaggacgccgggttccccagcagcttcgtcgccaagcccttcctcttcctccaggttcttcgaaccagcttttcactgtgttcccatctcaattttgaagtatcccttcgcattggcatctcggcaggaatgtcacgattcgattacttcagtgggcattaaatcattcaaatctctaactcacctgtctggagtatctgatatctgaggatgtaaatttattggttttcatgtcacttttatgtgtatttactgcgtcctcgctcacgatcatggtggtctgtatccagccctgatggatgtgcaactgaattgttttcagggggatgccatctacatgttttttgagacaaagaatcccattacgtcgcaaggcgacattgctgctgctgtgagcgaggacgccggagtgacatggcagcagctgggagtagtgttagatgaggaatggcatctttcgtacccatatgtgtttacctacaaaaacaaggtgaaatatttcactcacaggttggagaaaactgctattgcaatcattctcacatagtcacatatgcttttacttgactaactgcacaggtctatatgatgcctgaaagcagcaagaatggagatattcgtttgtatcgtgcattagattttccgctcaagtgggaattggaaaaggtccttttggagaagccattggtagattcggttatcataaatttccagggttcctattggctccttggaacagatttaagttcttatggtgcaaaacgaaatagagagatcagtatttggtacagtaattctccacttagtccttggattccacacaagcagaatctgattcataacacaggtaaaatgttaagcactagaaatgggggcaggccattcatttacaatggcaatctttatcgtgttggtaaaggccaagggggtggatctggccatggtatccaagtgttcaaagttgaaatcctgaagtcaaatgaatacaaagaagttgaagtcccatttgtgatcaacaagcaactcaagggccggaatgcatggaatggggcacgctcacatcaccttgatgtccagcagcttccatcaggtaaaccttggattggtgtaatggatggtgacagagtaccttcaggtgactcagttcaccgtctgaccataggttacatgatttatggagttgttcttatactagttcttgtcactggtgggcttattggtacaattaactgttccttaccactcagatggtctctcccgcatactgagaaaaggagtgggctcttcaatgtagagcagaggttctttctataccataagctaagctctctgatctccaatttgaacaaactgggatctcttatttgtggaaggattaactacagaacctgtaaagggcgagtttatgtagttgtagtaatgttaattttagtggttctaacttgtgttggaactcactacatctatgggggcaacggtgcagaagaaccgtatccaatcaagggcaagtactcacagttcacattgttgactatgacctacgatgcccggctttggaatctgaagatgtttgtggagcattattccaattgtgcatcggtgagggatattgtagtggtctggaacaaagggcagcccccagctcaaggtgaattgaagtcagtcgttcctgttaggatcagagttgaggataggaactctctgaacaacagattcaacatagacagtgaaattaagacaaaagctgttatggagcttgatgatgatattatgatgacatgcgatgacttagagcgtgggttcaaggtgtggagggagcaccctgacaggatcattgggtactatccacgcctttctgaaggcagcccactggaataccgcaatgagaggtatgctcggcaacaaggaggttataacatggtactcacaggcgcagcatttatggaccatggtttggccttcaagaaatattggagcaaggaagctgaggtaggaagacagattgtagacagtttcttcaattgtgaggatatccttctaaatttcttgtttgcaaatgcaagcttgacaagcacagtggagtatgtaaagccagcttgggcaattgatatgtccaagttctcaggagttgccatcagccgaaacacacaagcacactatcatgttaggagcaaatgcctggctaaattttcagaaatatatggaaatttaactgctaagaggttctttaacagccgaggtgatggctgggatgtatagtgacacatattagtggatagctttattcctgagactcaaatagactgattagccaagtatataaggtggggaagcagggggaggactagtgcaggaggaattatgtaattaagttattcagcaatgtatcctgttgtggttctactccctccgttccataatataagggattttgagtttttgcttgaactgtttgaccactcgtcttatt

SEQ ID NO: 8563 - DNA, 8310 bp, Oryza sativa
  unsure (1)..(8310): unsure at all n locations
actatccaaagtactttaagcacaactttttcgttttttatatttgccaaatttttgaataagacgagtggtcaaacaatacaaacaaaaactcaaaatcccttatattatgggacggagggagtattagtttagcgtgcccctgctgtaggttttccatagatggtttttggtgttcctgcgcttccacttatatttcataattttaattccttttgaattctagttgcctcacatgtgcaatctgtaattattgcaactgtacatgcaattgcaatcgtgccccaggagccaggataaatagttcaatctccctcagattaacagaggtgaacttccttcctcccttttttctttttgtgcaaaattgtatattacatgaagaaagcattatgaatccaaaagaaggaattttaaatttgtaccancttaatcnagatttcattaaatgagatattggtatgtacttcatatttgcatgttctgcactgtgatcacaaattcacaatcaggtatcgatcaatctgctttttctcctcttcctgtttagtaaataagaccaaggaaactaaatctgcatttcctccatttctccccaatgcagttctagcaaattgtggtacaatcttgaattttagtcatgtcattgctacgagaagtaatgcaccgcttgaatcaaaacttgaaattcttcttcaggtaaatcaccacctcttgctgaaacaagtacagtatgagggttaatgctatatttctctttttgataatctcatttactttaaggaagctgggaggggaaatatacttacaatcaagcaaagaattatgcagcctgcagctccaggaaaaagggcataccagagttgcaagtggtgaaactttggaccatcaataaacaagagaggcaagcttgcagctgcaatcatcatggaaatggtgagctttgctatgatgcatttaagtagagtacaaaaacagatgtcaatcagaaatatttttttaaatcctgctgagcacatctaaagcaccacatccctgttgaaagaaagattatatacctggagggtgtgaggcgcctgtaattgtcatgaatgctatggatgcagaaagagcagcacctcttgccaaccatccaggcccaaataaggaaagggctaacacaccaaatgccgcacaaccaatctgggcaacaaacatgttgtatttctgcaagattttgtcacctgctagtattagtattgatttcacgtatgatctaagaatgtttttagatttgttgtaggactccaactggaatgtgttcatccaatctcaaaaaattaacccaaatggaaacacctaatgatttttactacaccgaaaaatcgtacataactacttttgtggttcagtcatgactacagaaaggaaaacagaggtatggttccaagccttcaactgagttctatgagccatagtttttcagtcgacgacaacatggacaccctgaaatttagaagcattatattgctactacatgctgcagattttttagtagatcttttttctaatttgagaaactagtttgcaaatcaacataatctgggtgtccattagattcagtcagtacagtaagtggcagcgattaattcatctgtgcatcttagggtttccgacttgcccaaaaatcttagaaaaggataatagaacatttgtttcccataaaaaaaataaaaggtagcattatgcatagaaaatttttcttgtagtattgaagagtcactgtcgatgttgtaactaaaatatttaactgttaagctattcataccttggcagcaggtgagcctggagcggtgaaaagcacatcgcagactgctccgagaggggcaattgtcaatgatactcccttgtacgccatcatctgatccatccttcccagcacggccattgctaggaatgcacctgcacgttatcattatttgaggaaaaatatgtcaggtgagccttcttttctataaaatttattggcaaaaccatcaaactctcgacggcttttgtggttttgccactactatatgcaagaaatagtctttttttttctctgcacaaccattcaacaaaaatatatcacagagaggaaaccaagccctcgctgaattcacttggcgaaaaagcacggagattcagagacccagccaacgaaggccgacgaagaagacaagtttcaagtttcagactcaccggcggagggccaaagaacatcgctgacgctgatgccgccaggcgacgacgacgacgacgccggcgtgacaccggcggcggcgctcacttccgcgacaacgacgccgctcaggtccctcctcctcctcctcctacttaagccgatcctctgagaagaaaggaagctgctaccctgcttcttgctgccattgacatgcaggaggacgggtagacatggcatattggagtgggacgccgctgctagacattgctgcacccttgctcgtgccaagacgttgctgcagccaatgccgagcatccccggtcgttgctgcaatgccattctctctctctctctctctccccttctctctccccaagaagcacagtatgggtatttaaatgggcaggataaagcggcgaagaggagatagggtcaagagagagagagagagagatggatggcctcttgggtggacgtgaggggaagagaaggcggcttagctcttcagcgccgtggagagtcgcagatgttgatgcctggaataagaacaagtatatagtaaacaaatactactgtactgacaagtgcatatgcttcccatgttttcttccgtttttgatccaggtcatatgctggttggatcacaggggagaggcatggatccgttgctgctccttggcagcttcttgctcatcgctatctggccacagcagatggtaccagttgctttcacatgctgttcatgtggtcagtggtgacaggttacacgggcggcatgaatccaagcgaaatctgattatattttggtgtgaagatcatcattggccgcaatgctggcaagtgctagagatggtctatttaccacaggttctgacaacatccccaaccggtaagaaagaaaagaatctgagcattttatagccttattaacttggctagttaaatttcaatatttgatattgattgttcttgtctcctcacaaattatgggtttgtatattccttgtactgcacgagtatctgctccttccatcttaaattttgcatatgttaatcacaagcaccaaagaagcccccaagaaggccctccgttcgttgacgctgctggtcgtctgggagagatttggaatgaaagaaaccgtagaaccttccagcaaaaggagctcttgtcgaatagcttgctgacgaaaatcaaagaggaggccagagcatggatcttagcaggagcaaaacatctgggaaattggcttataacttagtttgttaggaccaaagctttggtcctgttttttcttttatactgtgcagtttactccttccttgtttagcggctcgccgattcgttaaaaaaattgcatatgtttgcattggatcagttccaaacttacctcttttgcacctaactgactctgattcccccaccatgagagccgatctaggggctagttcggcctcacttgtcggagactgaactaccgctcgcttacttgctgatcaagggcgtcatttccacttattctaatctttgaaggaagaagattgaaaaactaacaaacaaattgtcttcagccctacttagaatttattttctgttgttccaactgtaagtctccaatagatatttcgttacagcaccttacattagaagatggttacaacttctgaccaccaacaaactggggtctgacatgcgcaatttgcttaatttgttgaaattattttgcatgtgcaatgccgggtgcccatagcctggctgtcgagtgtcgacattgtaatccagcctcctaggaaagaaaaataaggacagaatccagcagaggactacaggaggcggctcttgggactgatcaaagaggcaaccactgagctaaccaataaacaactatcgaaggatgggctagtagcctttttattatgctcatggtggtgcaaatttaggtaccgaaagaagttcatgcctgtcaaaattgttccgtattcaaatagttgactaaaactaagatacgagttgaaacatctagttaaagtcctatctaccattgttattggccattcttttatttttttaaaaaaaaggatctccagagatgtaatatgagatgaatcttcatctaatctaagaataatgtgattacatggtttgtgctaccctgatggtctgacccgatccaacgtgagtacgtgaacaataatgtttttgttcttttaagaatgacaacaggttaacatgcaaactcgaatctcatcagtctttaccatgtttttttcccagaatgtactagggcacaataacatacgagtatccgaatcagattcctaacttctttagtacaccggagatcagccgaattatggtagtgaagaataaaaacaatataatcgtcccatcaatgaggatctgggaacgtacagctgattgacttttttttttaactgcgtaaagttgaacacatgtgatcgaaacaaagaaaataagtttagggtacagtttttatacttctatttatatacttttttttttcgaaaagaatacttctttattgttatcagttagtacaaaacaacaagctgaacatgtcgaaaggttttgaaagcaaccaacaagcctagtgtaacttttttctctccattttcacatgtaaatccattaaattttatgaaaatgaccttgctaaaatatgaagtctaaagtaagatacagagcaaaatgggagtgttcgcggaataagcgaaacgacatatatccaaacgaaaagtaatttgtgaataaaacttttatatgcatgttcttaacgatctaaaagcaaatgctgaaaaataaacttcgatgaaaaaaaccttaaaatcagctccaaatttaaggttaaaaactccaaaatcccttaacccccaaagatgaccttaatcacacccccaccccccctccccgggtgccgacagccagcccacatgcagctagctatgctagcggcatggaaaaagtccacttagactcccttaattgttcaccgaatctagttcgtgactcttaactagaaaatcaggtaggatgactcccccaattactagaaccagtacaaatcgactcctccagcggttttcgagggcggttttgttgacatggcggcattgacccagtcttcgtcccacgtggcgcttgtgtggcattagaattaaaaaatatctatgggacccatctgtcaatcacacacaaaatatattgtgggatccacatgtcatcctttctccttcccttcttcctcctccctctctctcccttcttcctcttttctctccccctttggatgcacctcgggagcgggagtcggatcagcggcgatggcgagcgggggctggagtggcgacagcggcgacacagatgcagatcggcctcccctccagtcatcaccgccgccgctgctcatcttcgtgtaggggagaggggagaggaggcggcggaggacgtggcgacgggatagaggataccgtgggcggcggtaacatgagagcggctgtaagttcaagtgccttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcagttttcatctcatctctctatattgtttatatcgggttattatccatcaccaaagagagaaaagattgaaagatcttggattaaataatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaatgatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagataggcaccgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtaacatcttgtgggtatgtccggtgaatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtcggttgagctgaaaagttacctgcggtctgaccgtgggccttaggacggtctgaccgggtctgttagccagtctgaccggcgtggtaaggccggtctgaccggccccactggtctgttgcactggtctggtttttggtagtgatacagagccgccagagccgcaaccggtcagaccgagccgacggcggtctgaccgagccgtggacggtctgaccggccactacactgcggtcagaccggccaggttgactgggctcaatgattgccctgtaacggctagttttctagccgttacggctagttttctagccgttacaaagtagtccggtctgaccggcctcacaacggcggtctgaccggcagagcacaaagttggggatttcggttccaacggctagttttggtggttgggggtatatatacccactccccagcagcaagggtaaggttttggcattccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggtttccgcctcctagacggctcgtggaggtgttgcccagtgacctctccgaggagattgtggaggaggcccagcaccgtttgtgagtggtttagagttcaccaccttcggagtgaaagaagaactaccccgagtgatcgaggcttgggtagtcctctccgtgggccggctcccgccttgcccaccccttgacgaagggggcgtgcggtggcttcgtggttgagcggtggagttg

SEQ ID NO: 8564 - DNA, 30503 bp, Oryza sativa
cgccgccgccatcaccggatatggacgagaaggggaggggggacggccgcagtccaccgctgccaacacgcatgcggcccccagcgccacccaagccgtcgccccatctggatctgacttagctcacgatggtccactgtcagctacttatctatttccctccatcctcagctaagttcacagtgctgaccacggtcaaggtgccacgtcatcgaataccgcccacaatactaccataggagtcgatttgtaccggttctagtaattgggggaatcgtcctacccggttttctagttaagggtcacgaattagattcggtgaacaattaagggagtcaaagtggactttttcctagcggcgccgtcgacaggctgacatgttccatgggatgggccgccgactcacccaaccgcgcgcatccccgcggcccaaaccaaccaactgcctactcgcgcgctggagctcacacaccgcccccgcggccgcgcgcgtccgtccctcttcccttccccttatccgctccgctccacagcctcgccccgattcccccctcgtgatttcccccttccgctcgctcgcgccgctccctaccggccaccaccgcgcgcgggacaagcaacctagctgctccggctgccaagccatcgccatggctccgtgccccgccgcgaccacgtacgtccgctgcacccagcactcctcctcctctctgacatttatcaccttatcaccttttgcttctctccctctctcgatcgtcagaactcgcattggggcgccgccgttcgccgcgacgacggctcgccgacccgcccggggcgcgacgacgacgacgaaggcgcgggcgtccgggctgcggcaggtggagggccccgtgtcggagagggcgtactcgtcctcctcgcccgctcccacccacaaggtcaccgtccacgaccgccagagaggtgtcgtccacgagttcgtcgtcccacaggttaatcaatacacacacaccttcgatgccgtctcaagcagcagtagcgcaattctccttcttgtgctttgtctgattcgtgccgtggttggggggcgcaggaccagtacattctgcacaccgcggaggcgcaggacatcacgctgcccttcgcgtgccgccatggtaggctcccatcctcgtgcctttcccaggacacattttttcttctgattggctacactttgccctcactactcactcgctcactcaagcttattagggcagtcccaaccctccacctagtatggtgtctatgacattaactacattgccatgtaggacttttagcttatgcggcactatattaattaagagagagattgaagagaggaagaaactgggtctcatgcaagacacagcttcaacacgagaacctatgcactagacactatcaagttttacattgggagagaatagtgtcttcataatagatgaagattaaatatgattggtagagaagagagatgatgtatttattaatggcccactttaaaaaaccatgggttgtagagtgtagttttgattgtgatgtcttattaacatggcaccatagacactgcttatggatattatgagttgggactgccctaagagtcaagttaatctgtgctggactttaaggcttagtcgttgcttagacaaatccatcatactctgctagattttagttgcacaaaaaggaagcatttttttacttgtttgtcaaatgttattcgtattgtattatgtatgcttaatcacggcaaaggaacacattaagcaagaaaaacgtgtgccgtaccatgttgatcaattgacacaagcggttgcttacttttggactcagccagtgtagtctctggctagcgtatcatttctcccttttcttctgatctacaatatagataagcaaatgaattactttagggaatgtgcaaatggattgctcactttgtattaagatggagaaagaaaagttacatcatcagcaattcggcatgcaaaaccagcagattgaccaaaacaaaaaaccaaatacaaccaggcgactatacttctgaattactgaagacacatttttctaatcaggttgctgtactagctgtgcggttcggataaagtcaggacaaataagacaacctgaagcacttggaatatctgctgaactaaaagataaggtgcatccatctttttatgctttgttgtcactattaattaagtatatcatgtttttactgtttctgctacagtttgcttgccacttgatccgcctcattcctcaatttactcagtggtttcaacagtgtctatgttctatccattagtaacacacgatcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagacatagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcaggttacaccgttgtccaattctgcgtggaaccaacctgagaatgctcaattctctgaaactggagtagccgagatgaattcagacaaatcctctgcccaattaggccggaaatcagccaacttgttattcttcaccgaattagtcccacgaatgaattcggcacacctcttcccatcaactaaatcagactgcttaattcatgtcagcaaatacggtccacaaatgaatttcccaaaccaaaatagcaaatacccacagaagtctacgattggatccactagtgaatttggcccaacacatccatcaacgagttcaacccaccctcaacgaattcagcacaccaacaaatttggtcccagttaactccatcagtgaaattggcccacgaaattcccgcaaacaaattcggcccgctaaaagatttggtccatctgctacccattagcgaattcagcccaagcataaattcggccgtcttattctcgacatcgtattcagcccatgagtagatttggcctcatagattctcgtctacaaattgagcccaagagtaaattaggccgactaaattctgtcaactaatttggcccaaaaataaatttggtccatctattttccgtaaactaattcggcccatgagtagatttggtctcatgggttcccgtcaacaaattgagcccgagagaaaatttgaccctctaaattccgtcaaccaactgggaaatttgggctactaatttcatttcaacgaattcgggccatgagtaaatttggcccactaattcccaataacgaaatttggcctactaattcccaataacgaattcagcccaccacggaatttgcaccactttattcttctaaaaaattttggcccgctactaaatttggcctgctaatttgtcatcaatgaattcggcccgtcaataaatttggccgactcaattcttgtcaacgaattaggccctcaatcgtattggaacgacgtaactcccacgaacaatttcggcccatcactaaatttggcccacttaattatcgttagcaaatgatttcggccacctaaatccagtcaacgaaatcgggccacaggtacatttggcccattaattttcccaaacagtttaggcccaataacgaattctttccgctaattaatttggcccaccgccgagtagataaggcgcgtattgcgatttgcgagggaagagacacgcgcctcgccgccgcccgccgcgatgctactggcgcgcgctccgccgccgccggcgatgccctcggcggtcagctcgccgccgcaacgggagagcatactccgcccatactgcgttccctggacccgcggctccgttgcgacggccgccgtggcgaaggctgctcctttccggggcgagcaaaaccacaagcaggtagcgagcgtggcgaaccccctggtgaagcactgcgttaggctcaggctctcctccgcgtaccgccgctcctgccgccgcattctcctcgtcggactcatccccatcctgtaaacttttctctattctaagctgcgaaattcccttattttgttttattctgagatgaatttttttcctaattctgcactcgtacgccttggtgcagggagatgtgtagcttcgaattctccaccatcgaaaccttgcttctcttggacggcatagagctaccggaggaattgtacgggttctctggcaatgtcgtgtatgtcagcgccgctgtgatgaagaaagtttctgggatgcaatcagttgattcaactgaggcaatcgctatcattcacatgcctaagtatttccgcgaccttgacagcgaccagggtggagctgttcttgatgagtggctcggctctgcaaagaggattttggttctggatgggattcaggtaaaaagaagtgtgcaatattccgttattatccatagtaaatggatgtcattttgtgcataagacggcacataatatgttgtttattgtttattttaagtttgaactagtccatttgattcctcttaagcaagggttctaaatttttactgtgtccataatggttctatcctgcaggaccctggtaaccttggaacattgataagatccgcttgtgctttcagatgggtatgtcatttactactaattgttgaagcgtctctgattgcatttctcaaaacttgatgtttcatggtctcatggatcacaccatcctattgtttcatataaagtagttatcacagcttgttttacttctcaataataaggtagaacttaagtgataaaaaagctaatactactggtagtatgtagaattattaggtttgcacttgtttttacatctaaggatgatagtgtaatgctattaatgacattttgaaagcaaaaggttagtacattctgggttagaaggctagaaaccccatacgtgttctacatttccacaaaaaattatgctcctattatacagcatcagatgaagtttagttagcagttagcacatgccaatatgccatcacacaaaaatatctgcatggtgtgtagcctaccagaaatttatactaactcttcaagtgctttcagtagtgttgttcggttagtctttaccaatttctatgcttctaacagcatttaaaaccaactaccaacaggatggggtatttcttcttccagcttgctgtgatcctttcaatgaaaaagctcttcgtgcagctcgtggagcctcattgcagcttccagttgtttctggtaactggtctgatctgcatgctttgatggctaaatctgatatgaagatgctggcaggtcatccagaaagcagcagtaatggatctgaaagaacacatgttctatctaaagaactagcggattcactgatgagtgaatcagtgtgcttagtgttaggaagtgagggcaatggcctttcggcagatacccttcaagcctgtgagcttgtaaacattcctatgcaaggtacatttgaatctcttaatgtttcagttgcaggtggtatcttcttatttatgctacaaaattaacagcaaaaaatggcagaacgttaactgtttaagtcatccttgattttttaataattttattgttcttgtccaatctgttacatttggttcttctttctgacatcattgctgatagcttgatatcaatccaaagtgaaggaacaaactgttaagaggaatgcaagatcttggttgacaaacaaaacaaaatgagaacattttattatataccctccctttaaattgaaatgaattgtttaccctcctgcgccgctgacatgtgggatcatctaagatcgctgacatgtggaccaggagggtaaatcctcaacttcaatctaaatggagggtatatgatcaaactttacctgttttgtcacaaggatcattggatggcactatatgaaacctagtaaatgatgatggaatgaactgccgaaagaattttaaaatgaactcattgttcagataaccaacacaactttgtgtaattcttgtagtatgtatttgtacaactgaagatcgctatgcaatttatgaaagggatccaccataatcactgcagccttgcctttggcccttgaatatagtagcttcaatcaaacacggtggtcctttatcaatacgagccttttggaacaggccagatcagtagtcctggtccacaagcttatgtaagttatctgtgaaattttgttgattgttacaggaatccttctatcagcccaagcatttactatgtagaattgaaatgttagagtacatttaacagtagtcagttgaatcattatgcaaattttgcggtaaaatgtccatttagacactggattagatcttccgtatctattgatataatcttccaaacttaaataatctaataggaagctttaagacttagtccagttgagatatgattcattgattgagtccaactttatgttctttcttgagctggaccgtccaaatgctataaatgactagcagctttcagtattgcttctcgctgctgtgggctgtggaatactcaaactgtaatctaattaatgatacataagatcagcagaaactcctggctttgtcagcaccgtaatgacaccttccacatatttattatgggatcttacatgtgatccaccattgctgactgaaaaaggtatcgtccttaatcgagacatcttgcacactggattttgcagcactacaacttatttcagccccaattagttggtttccagaggaaggtatgtcttttcaggtgaaagcttctttgtttagcctgtgagagcatcctgagtcatatctcatatgcatacttagttctttgattattgtactatacatgtcatctctgggaatgcacgtctgtcattcactgaaacggtggtgctccagtttccctgtttctcttgtagtgatacttacctgtactcctgtctatagctgatatgtggattcctctgacgacatacatgctggtgtaaaactgctcatcttaccgtgaattttgtattttctggaaaagtatcattggctccccaaacaatttttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgatttatttattttttaaaaaataggttaatatgattttttaaaacaactttcatatagaaattttttacaaaacacacattgtttagtagtttgaaaagcgtgtgtgtggaaaatgaggaaggtaagttgggaaagatgggggaagaacacagcttaggagctttgggaaccaattaagaacatgggctgagaccctcaccaaaggagatatctgtatgatgacaaatcacctctgagttttgctcttttgaaaagaagttctgatgatctaggggcatttatattaattatggatttgggagctggtcagacttaaaatgacaggcagtggatattttcctacatgaagtggtggaacaacatttgtcaacttctattttattatctgctattctttggtaagcgattctttcgtcattctgcgttatacattcagtgtttttcctgtgacagtgattggttgatagctatactcatttcaaatgatgattgttttgggattactcacaaaacgaaacatcaccagctcattttagaactgaatgtggacagttttcaatcccagtagtcttctgctggccaattctctgccttgtactgtagcatgctctaaattactctacctgcaactattacaaccttgtgcccactgtattcttgttatataattgctaatttcacgcaatttgtgcatgtgtactttaatactggatctgtgctaactgctaagcatcactgaagtgatcatgtgcttctagcttggttttcacatgtctagttcagaagtgcaatcataaaccagttcgactaagtcctcaaaaaggagaaaaccagttctcgtaccagttcagaagaagaaaccagttctggactaatcatgttattaagatacatacagatagaatatttattgcatgttgggcatgctgttgtgtactcatctcactgtactcaacctcagtgcatacccaatcaaaagctatgatacctagatgtttcctttcatcatctatgtgtttagctcactaatcaacattatcgctttgtcagcatgccaatacaggcaagttgatttagtagtgtggccagcacatttcccaaacaatgttctctgttatgataaaggtcttaagacccatagatatatgcttttgttgaattgttgggtatgaatcatcaagagctggtgccatttggcatcaactcatttttttttgcagtttgttagaaagggattggtgtggttgtgtactgacaaatctatggtattcaataagaaattagcatagggtgatagggaggtcactgattggtgcatcatttgcttaattaagtactgccaggttggtgtgttagcctatctggagagagagagagagagagatcatgcaaatcaaagctttttggtagctcatgtcagtttgatacgtgtgcatgcatctgaatgtagatcggtatccttccatttgtctcttcctttgcagatttggggattatttgtgtcctcttttttttttgtcagaagagttcagggcattgccatgtggctggtatatatattcctgctttatcatttgctgaagtccccagaagccacaatacgttaaactctttatatatcagggaggaaagaagtagattaatttgtcggtgttgttaatacatttccctctagtttttcagctgtaaactcctgtgcctagaaaaaaaataaaaagggggtactatcacgtcattatgttaattcggtatacaactattttacttctgatcccacagatgtaactgtatcttgtatataattgttaattatgtttctccaaatacaattttctgttctatgcacagctatatcgatcaatcctcgctattaaaatttggactcatcatgatctactggtttacaaagttctctgtcttctattaatattgtaatttctaggcctttggaatgagtacagtggtttttttcaagtttgttttgataatataatagattgatgtcatcgacataaactttcgcataatagaacttggaatcgtgttactatttttctagagttattttttcaccgtagttttctgtagctagccatgggaatggtgcctacctcgactggcagggagctgttaggagcagacgagcagtgcaccagcctgagtttgaatccctttcagtgcatgttgttggtaacttttttggttacgccgtcaatcatgatgaaaacacctaatgttttgcggtgctacaaagtcgtcaaccatctcgatctagataaatctaaaccaaggtggtttatgtaattcaaaactgactagttgaagctggcttagatgaaatagggataaacatttgtctcgtgggtggaacggaaggtttttgggacagacctacaaagagattcgcacacccacatcgaggatggacggctttcagtgcaaaccgacaaagatggatgaaaactagaaagaaaaaaagtgattggctaattgtattgaaaagagattatgtgttcagttgaaccggccatagcctttataaagagactggtcttgtctcctacagaatcttctccacgtcttactcaaggtagataccaataaaaactcaaaaacctcaacccaagcaaggaagcctgagacccgacgaaattcgactcgaagtcggacttagacggtttgaccgtccatttgtcgccaatcagatcgatcagccacacaccggcgatcatactagccctatgtaggaaatcccgatcttattcaaatttgatcatattttcttatttcatgtctagatgtcaaatttggatgttaacacatgttttctcactactttatcagcaatggatgctaagatcctctttagtaacctaacacatttttttgtttttttttaaaaaaagttagccatgagtccatgacatcctaggacaagagtaaaaaaaaaatcaaaacagataaatcaaacttaaaagaacacccaaaattcataagatcgtcgatgtgctgcccaagttgccgtccacggcgacgtgacaagactacaagagaagggaaccaaaaggtggcaatggcaaaatccttggttctgctcgactgctcctactcatcagtcaccgaggcgaaaggcatggctgttcttgctccaaacccgtaggccatccactgcccattcgtctgcgctcacaagttgcagttaatgctaaacaccaaaggatgcatatacgcaagtatatattccctccgtactcataaataaagtcgtttaaaacaatatttaagtcgaaccttgaaaatatatattataaataactctcgagttgttgagtttgtaaatataaaaattatatgaatagatttgtcttgaaatttttttataaaattatatgaatataacttttccataaatattttttatagaaacaagaagttaaagttatattttgaaaactgtgtcgctgtagtccaaaacgactttctttacgagtatggaggaagtatgctttacaagtaggagtaggtcagatgaatctgatacagtaactatgagtaggattccatcatagagtttgcatgcactggcgtataagacaataccaacacgatcatatgagccaaaaaaaaggaagtccaataattaatccaactatccaagtagtactcgtttagattctcttaaaaaatcagtcgagtattgttaaaaaagaaaataaaatcagtcgagtaattaattcaagtactcgtttgggttctcttgaaaaatctctagctcccttcaaaggttggtgctgccgcttcgtcgtggcactttcctgctaacgaattcaaaaaagcgacaggggaaaaaacacttcatggctgtatttagttcacgctaaaattgaaagtttgtttgaaattgaaacgatgtgataaaaaagttggaagttcgtgtgtaggaaagttttgatgcgatgaaaaagttaaaagtttgaagaaatattttggaactaaacacggcgcaaattggataggaattgggaaaatcaaatcggtgcgttttttcaggtgaaaatgtcaagcagtcatgctgtgtcttgtgcatttcacggcacgatggtgaactcactcgagctattcaattgtgaaagctccaaatcttgtctcggtcatgtgagacatctccggcgacgacgatgggtaaattactctgtcggtttatttatcttttctttttttttaaaaaaaaagacatgtccagccacgtgactgaactatgggtaaattactctgtcggtttatttgtttatttcaaaaaatataaagatgaaatactaagaacatcgtgcccctactccattcccaatatagatttttggggatttcagtcggaaaaaaatacactaatagtttccctgctctctcacaaaaacgaaattcccttatctttcattctcactctccacaagttgaaaaccattctctcccaaatttcatcttttgagcgagactgcaactcaagagcaagcaggagaatgaccctgctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcaatatatatatatatatatatatatatatatatatatatatatatacacacacactactatgctaccggtatttggtgattttcggtatgatgtattctaatttaaaaattttatgtatgatatattctttttttttagaaaaattcaggagtaaatttcactttgggtcattttttattactgatgttttgtttttaaccaccataaaaacaatgttttcactttgaatcggatacttttacctttgtggcactttgaaccatccttaattcttttatccatctatattaaacttataatatgctgaagaaatgatctcatatatagctgaggagttcattgacaagtagaaaactgacataatcgacataatcgagatcgttcagatgctctagaagtaggttgggtggtctaaaataaaacaaaaacaactttatccggtccaaagtaaaaacattggctaaatggtgatccaaagcgaaatattgataacaaaaggtggaccaaaatgaaatttactcatcaacttttgaccattgatttatcataaattatatttttaatagctataaatccaatatttttacacgttaatatatacttctaattgaactaccttgatcaaaacctataaagtcgattatttcgtatgagggcgtttataatttacaaatatgccatgtaatagggcctatttagatggtgaaatgaaaattttcgggtgtcacatcggacgtttgactggatgtcggaaggggttttcggacacgaatgaaaaaactaatttcataactcgcctggaaacgcgagacgaatcttttgaacctaatttagttgtcattagcacatataggttactatagcacttatagctattcatgaattaattagataaaaaaattcgtctcacgatttacatacaaagtgtgcgattaatttttctttgtatctatattttatactccatacatatgtcccaatattcaatgttatgtttttgcgaaaagtttttgggaactaaacagggccatagtgtttggcatgagaaaattatgaactcagagcccaagcaggagcaggaccgaaaacgcgtgactagtgcaaggtttgaaaatagtactccttaagagcgatactttcaaatctttatctggagaggctcaagtcttttttttattcattttttttagtttcatatttaaatgtcacgtggaacttatgaatcctaaacacaatgcctaactggcgtcacatcaccgatcacactccacccccattcaaagtttcaaacaaactccaccattttcgtatgaaattgggtgtgctcgcgcgcaacttgatccacacacgtacgcgttgcccatcgatctccaacagaattccgaattcaacaaactctaatcatcaccaaagcatggcccttgcccaatcccagctttcttccaaaaaaataaagaagaggtttccatggcttccaggcttagatcaccgaaattcaataaagtttatctgtcctttactttgtttcgccattgccatttatgcacggcggttttcaattaaaaagcagtgaatagtgtagccagatttaccaaagtgtggttgctaccgttttcatgtcaccagtagttgtctcgtcccaagatcacggccaggttcgatgaaccggccgcggcaacccaggttttgaggatgatgaattgatccgcatttgaatcaatgctaagctttgcgttttcgtatcacagatttggcgggtgatggacggaattggcgggaatggttaagtgtgtgcaccgttagctggaacccactaattaaatggatgcggttttgatcagcttaattgggacaggtgacaacggccggccgtttctgatgcagagatagaggtaagaggtatattcagctgatgaatctgttctccaaaaaaaaaaaaagatgatgagtcacctcactggctgatgctgatgctggcgtgtatccaacggatctctctcttgcttaaccgtctttttagctgaggtaggacagtgcctttgattccttggtcgagctaactgatggatcaatgacagctattagcaaaggctgtttggattgtaatttaagcaatgagaggcaagagaccaaaaaacagtactaccattattactactgctcgttcttgaagaacgatttaaattttagttttgctgttaggggttgttaatttgtatctcaggttttgttaaagctggtttaccttaatcatgttttagatcaaatcttgtttgtttggcataagagaattgtggatatatataaaaaaacataagttctctcaaagtaaaaaaaaatgttttattcccttcgctcttctgccttttctcttgtgggccaaacagaggatttggattttacataaatctacggtaacagaataataaccttaaacctaataattcgtataaaacttgtttttacttttcccatccaaacaaccactaaagacgtctgattagctcagtacttaaaatacagaaccttatgggattttatcttttttctttttgaaaaaaaaactactccctctatccttctctaaaagatcttatttttatctatacgtttggagtatcttttactccctccgtttcacaatgtaagactttctagcagcatctatatgaatatgggcaatgctagaaagtcttacattatgaaacggagaaagtaatacgtatctaaacaagtatttgcctagatgtataaccagaaataatgtcttttaggatagagttaatgtgcagttaattactccctccattccaataaatacatgaatatatccaaaatttatttaaacattgatttttttaggcgaagtgagtattaattaggggtaatctctaatacatgagtcattaatctctactgtttttaataaagaatcattaaagatgtccccttaaatctctataagggttcttctgcgcaataatagcatgtcctttaccatttgaaattacccctcaattgctgaccagatatttttaatggctcgtttaattgttaaggatcacagtggtgaaccattagatattaggctctgagtagaagtacgtgacttgaagatttgtgcgaacctttcaacatgttgaaattaatccactaggtaagggatttattggggtgccggacattaacagagggggagacgaccaataaccgatggtgcattaattggtgtggacggtagaaagagcattcacgtacgctgccactcggtaatgcttgaaggagggcaatgcatgggtctattccctcggtcgaaaaaaatgaacaaacatttgtattagaatatgacatatcctaatacaataaatctagacatactttatatttaaatttggtgtatcatatcctaatacttgattgatttattttacaccactagagaaaggggctttagtcccggttgggaacccctatactcctggttatacaactgggagcacaaatccaaaattaaagatgcccatctttagtctcaggtgaaataaccggagtaaaatggagccaggctaggtgcggttgctttttcttttcttttattttttttcattgcttttaacattgaatattgatttcactccatttccaaatcatcccaaattcgtgaaatcccaaatcgatcatcacatcacaaattaaaaggatcctctccaaatcctcaaatcgatcatttccaaatacatcacaaattcttaaaaaaaattacatcacaagttctaaaaaattcatcacaaatacataatatattcatcacatcacacacaaatcaaatacatctcagatatgaataaaaaattctcaaaaaaaaaccttagaggcgctgcccaccgctgccacgctggcctgccgccgtgccacccgcttcgctactacaagatgagaggagaggataagagcaagaaaagaggagaggataagatagagagagaagagggagagatgaggaagatggggagagagactttgcaatagtggatttgaggataagttttagggattatatacgacgggttgagttttagtctcgggactaaagatctaaataatctttactcccggttggttgggactaaagttgtgatctttagtaccgactaaagattctcggccccctgacaggcctctgataggagatgaaccatgactaaagatcatctttaatcccggttgatcaaaaaaattttaaccgggactaaaaataaattttagccccgattcttattagaatcgggactattgtggaaatcagccgacccagcaaagaccacttctctagtagtgttaggaccaagagagtatatttcaaagggggcaatgaaagagtgagatacacagattttatttgtcaatgaaagtttattgtctcaagttgatttattttgatatggaagtagcagttttggagttcggatataaatttgtagaatacatagatacatgccggtttgatgatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataaatctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggaggaggaggagggggggggggggggtagggagaaggaaagatggggaaaggaagagg

SEQ ID NO: 8565 - DNA, 14338 bp, Oryza sativa
cacgtggcgtgccacgtaggcaaaaccacggtcaaaagtggctttggacctgaatgatacaataaatcaagtttaaggatctcgatgtgcgctttgcaagttcgtggacctaagtgaaatctcctgacaagtttaaggaccgttggtgcattttactcaaaattaattgatccatgacacataagccccctcatctagaggttcacaaactgcttaacattcagagacatccatcatatggagttgtttaatcagcatcaagaaccgcgtgtaacttattatgatggttatgcaccaaactttcattataatgtctatcagttccgaaggaaaaaaatatgttaatacgattttccatgttttgcacgagcagctacacgagaaaatagcacgagagttttggtagtacaaaattgggccaactcgctgccagccacactactagagataagataggtgtctaggttcgatgaaccacaagcggtaccgaccgtgaccggtccgtgttgtggatagacgtagccatcccaattgctgtggagctcccaaaagttgtggaccatccaagtcaaccacatcctgaatcaatggttcggttcacttctcaatcgacgatccaaagctctagtggagccaaggacgatggagcaccgttgtgcgaggttccagcccactactctcaccgccttacccctcttcttcctcccgctctcccttgccactctatacaagatacccctgtgggagcagcactagcccccatgaactagctacattggggcatggttgtcggtgatgctcctcagcggattgggaggagaagcagtgcagttgatgggagagtggaccggcgcggcggatggggaagaggcggcaggtgaaaggagaagcggcgcgacggatagaagagtgaagcggcacggtggataggaggcgaggcgatgcatcctgagagtaggactgagatacacttccttaccttggtcacatgcattgtaggctatgtgacctcaacaattactcaccctaatttaagctatgaaaaaagtaacgtgcaatggggcgttcgaggccttgggccaatttcttagtttcagaaggactagccacacccatagcgtatcttgcattgccgctgctcttatctactactaccagtagttgttgctatagaagaaacgcaccaacacagtgccaagtcgcagcgactattcatcattaacttacttgggatgacactgtgcacaagatgctgtgcaatacaggggttcaacattgacatatgcttgtaaacgtcgggaatggaagcatatcaagaagggttagaagacatgtcaacagctcaacatgacatagatgtttggttgtgtttagttcacgctaaaattaaaagtttggttgaaattggaacgatgtgatgaaaacgttgaaagtttgtgtgtaggaaagttttaatgtgatggaaaagttgaaaatttaaagaaaaagtttagaactaaactcggcctttatagtgacagatggtgtaatagacaactttccacgagggtaccagagcatatgaacattttctaatgtaggaatgtgggatcatataatttggttgttgatgttagaaacacacttaaaacggaacaacctagtacttgcatacgtaggccttgttcggaagacctacttaccacacggctgcagctgcacagcgcagccaaccaacggctgcaactagctaatagtagctacaacctatagatgttgaagctagcaagtgtagggagcagtagtttttgtgcagccgaacgaatgacggctgtaaaatttgggctaccgaacagacccgtaaaacgtaacgactcgttagaatataattaattaaatattagctattattttaacataaatatatcaatttatatattttaacataaatacattaacttttaagacaactttcgtataacggtttttccaaacatttatagtattttgataggctttgcatggaaaatgaattacaggttttttcaaaagtttagtattttgataagcgtgagaaattgagttagatagggtacagaaggcagcctcagttaccctttattactatctttttcatggttttacttcaatttctatcatagaaacgtacatgtcgcacttcttaaaatggttagttaccctaatgatttgccctcgtataaaaaataactcagtctgctctcaggcgagccacaattttgacactagtttgaatttccacaaaaatttaaacaagatataaacgcagcatgaaaccgtcagtaaagttataagtatgcaaaacccccaaccagccagaatatgggccagaaccagtgacagaagtgcagtggaacgcaaggagaaatccgtccaaagtgagctcacgaacttgtcaaatcaaaacaatatcgcatcaaaacaaggcggcaaacggagactgctgtgattccacgaaacatgaaacaacggagcgtttcgagaaataacgggtttaattccataatatttatgacacccagagcaatgtaggcagttctagcattttaggatagtagaatgtacctactcccagaagtagcataccacaaacccaagcgtaccaacgattatcagagtacagccataagcagtggcaccaagttcatgaatttgccaagttattcatgtataatcatgagagtaacgcgaggcccaattaataaaagttccaaaaggccaccagcctaagcagatgcaccaccacggcggcactcgttcagcatatccaggtagaattggcacttgctgatgtcacttccatagttgttgatgcactgcaatacaaaaaaaccaataattaggatttaggacaacctccatgctagtgcgtagactcttgttagttacaggtagtagcatgcatatacaaattaattcttatcaattcaatctatgttaacactatgaagaaatgaggatgctttcttctgttcacatagaattaatcagatgatggtaaccagagaatggtggggatcaacatgcaagccagaatgccagatagagttttaagagtaaaattaaaatagataaatgaagcatcatcaaattcattctcatggctgcatgggaaatgtaagcacgagtagatggaagcagccaggcaacaaaagataactaagccaaaatgggcaggaaaacatacgtcttggaaggccttggaatggatgctgcatgagtcagatggagtggcgttggccattggggtggcagaggcagcagcctcggagacaacagtctcatgctgaatggtacggggacccattacagcatcaacagccctatgtgccatggcactaccagtaccaaaagccatgcctgcatatatgtgcaaagaagtacttattagaaactgcattgttaatataatgctattcatttcaattaaaatgaagcaaaatgatgataccttgagcaatagtggaaccaattcctcccaggatagagccacctccgttctgggcaggagctggaggaggagcctgccttgctgcaatgaacaaattacagatgtcaatcaaagaacacaagacacaacttgacaagacaaaacactttaaaaccagtacagattatacaggtacaatgagaacataaggcacaacttgacaagacaaaacactttagaacagtaaagaataacacaaaatttgtgaaaccccaacatggacaaatcaatacctggctgcggagggttcctcacgggagcagcacgtggtgcagggcgagaccttgctgcaaaataaatgtcaaagcataaaaaagaatgaaatgggttgagatgtgtcacactaatctagagcatatgcatgtagaagggcataatacatacagttaacaacatcatagtcttcgtacataagaaaaaagaaaaaagaaacaccacttcatatcagaatctatctaagaagggatgaacagaaaatcaggccccttccctcaaaaaagattctatttgctatgtgccccagtctgaaccaaatgcaaatatactaagcagctggttattcatgaggcagtggtgccaagctgcatagaacattatagtacagtactaacttatacaagtggtctgcaaactaattttagtcattcagatcttttaatctttgaacactatatatatatatatatatatatatatataaaatcttaatattagtaaatctcacgaattttaaaggaaatggattgataagagagaaatgctggaatatgcaaggccgatcaatgaacaaacccagaaagaagggacttgcacttagagcagccaaagcagtcaataacatctctatatgccccataactaagccaagatagcatgaacaactacagtggctactcaaaaaggcaaacagtatttgcagcccaaagcaattgaaaaaaaaaagcttaatgcacaatgtgcaaggctgttcaacaatccctataaagaagggagttgtacttaaaacagctaaagcagtcaatagcctctctatatgccctctaactaagccaagatagcatgtataactagaatggctactcaaaaaggcaaatagcatgagctccccaaaggaaccgaattgaacaatcttaatgcatgttcaacaccactttctgatgaccaaatatgaaatagagatagttgtatggaactaaagactgcaggaacacgtagaagatgtacatctagaacatcttggtatcatttcttgttatagaagatgaggtacccaagcccaagcaaatttcaaaacttccacagctatgatggctactcattaagacagaatgaaattctacaatagtgatgaaataaacacaaacagttaactttaatgactaaggcaaaatgcaagggtgtagtttggattgtggatggaaaactgtagcaagaaatagtatgaacataagaatttgatggaatgtctagagctgcttggggagcaccgcatattatggtttacaaggcgctccctcaaaaggcccaagtgggcatcaaatgcccatctgtatgcacctcctaactaagccaggacagtatgcacaactgaagtggccactcaaagaggaacatggaatggaagccattggtttatcatagcacatgcacgatgcaattcgcaatgtatataaactaaagatatatatgttggtttatcatagcacatgcacgatgcaattcgcaatggaatataagacatatgtggagtccatctaagaaaggatcaatggaaatttcctttccctaatatattatggattcaaactttgatatatgcccctgtctgaaccgcctgcgcattttgccacaaaacaattcgcaaccggttattcaagaagcaatcttttccccgttcctgatctaaaaaaaaaaaagaaccccttcgataatcccccaaacacgggtagagtcctatgtatacaccgacgacagatctgaccaatctagcagctaaatacgccaatacaagagggagggcacttcctgatcctacatcccaccaaacgctaaacgtgagaccacgaatcgcccaatcgcgcggcgcagatcgatccgaatcgaaaatctacccaatccaaacgaaggccacagatccgaacaagaacaacaacgggcgcgttcaacgcgagaacccaatcccaaacgccgcatggctactggggctaggggggagagagaggatgggggttacctgagctgcggcgagccatggcggtcggcggcggaggagaagacgaaaccctagatggcggcgcggcgaggaggggagcgagcgaatgaagagggcagcaacgggtcgggaggttgaacggcagccacgcctagggttaggcttttatagccgcgagtccggatttttttttcttttttttttacccgttcttgctctctctctctctctctctccaacctcccaccttcttgcaagacacgccaagctgacatgtggggccagaaatctgcggtgacatgtggggccattacttgtggggtccacatgtcggcggcacgcaagctggctgggagcctttgaccgttggaggggatatgctcggaacactctggattcctccagatgaccggaagcagcacgaagccgtgaacggctacgttttcatttttcgtgctcccgtgatgataaggtgaaaaatgattcgtgattcttccgatttgtacaaaatgaattgagcaatttagtcaaaaatattaagctcaaattagcatgcatttataaatgccagatgaaatatctctaattaataatcttctagaaatctcaaactaatatccatattaaggtttggtccaaccagctagatcccacacacacaaccaaacgcatgttgcaattgcacacaccattggcattgaaaacaaaagagtatgctgcaaaacatcaggaaaatatgctattaatccatgccaaatgctcacacaaaaattgattcgacttgcagttgtaatcccctagacgagggtgtttaattgtacaactcgcagtggctccatgtataaaatctcaatcccctggcctataaccaaagtggctgaggagaccattgtacagttttgcgttggcttcatcatgtattggtaactactgctactatggtttcacttgaacatggaaatgtcgaagatgagggcagagccatccgtggacacggagacgatggagttgccatcagcagagacggcgagggactgcacgacgtcaccgtggccggcgaaggccctcacgcactccccggagaggctgtcccagattcgcaccatgccgtcgatgcaccccgacgccacgaacctggacgggcccagccatgccagggatgtcaccccctcctgtttgttgtccatcacacaggcagaacagatatactgtttgagtgcatatctaagaaatggaagtgacggtttttggcgcaggcagaatctaagaaatgggcgacggtttttggcgcttacatcgtggttgcaagtgcatcggatcgattggcgaccaaggtcccagatgatgagcttctgatccatgctccctgtagccacccaattgtaactggcagaaaatactccaggtcaatgtgagaaatgtgcggtgttcacgtgtttaccatactgctactctatggatccagtaccttggtgagatgccgacacactcaatagagccagtgtggccgtccagtgagccaacaacctgcaaaacgacagcgatgatgatggtaccaaaatgccagactgcatacattttcaaacaaaacaagaaaaaattccagcctatgtaccaacttacatgataaagacacactagcttgagtcataagaacacttacctggcctgagtttatgttcacaacacacacagaattatcctttgaaccactaacaattgtttgggaatccgaagtaactgataagcatgttaatccatccgtatgatagccatggcctggagacaaaaaagatcagaatttgatgttcacgactgattgagtatatatgaattcaatcatatggtaatttacctcgaacaacatgtctgctttgtgcagttcttgggtcccatattctcaatgatgcatcatctgatccagtacagataagtttaccttcagaagaaggtatgtgcattagcaaacaatattttcgttcaaaaactatgttgccactgtagaacttctatgtggacagctaaataaagatggtaggagaaaatttccatgctaaagcatcccaaacaacttgtttactcagggttaactaacaaaattaacataagcaaattgttattgatcaaggaaatatattggtaccatctggagtaaaatcaccacatgtcactgtgctactatggccagcaaaggtattcagaatggcattatggtcagcattccacatccacaaattacaatcttctgatcctgcaattatcaaatgccctcgtggatgccatttaagccactacaataccaaagacatacagttacaccacaggactaatcatgaagtattcatatattttgggagaggaaacaagagtttgtcagcggcaataagttcaactaacaaatgaaatggaacagaatcatctcacctcgaagccagatccagaaccctcaagggttccctgaagtgttcgtgtagctgtattccacacatttatgcgtccatcaaaacttccagaagccaaaagattcccatctgaactgaaagcaaccgtgcagacagtatctgtgtgccctgtattgcgaagctattgcataagttcaataaaataattccgagtatcaacactctgtgataataatgattatgtgatgactaattacaacaataatgtgcatgcagaaaaaaaagaaatccatgggccataggaaatctcaaaattctttgatacaaagtatcgagcacagaaagcttctgggttccattgctgatatgcatgataagagagagtaatttaacacaaaatggttaataaaaaaatgagtaaatgatttgtctgcataagatcaatatataacaattgaaatgctaatatgttgatttagagactacaggcagtataccaaaacattccattaacataaatgaatacatcaacttaataaataaaagaaatggaagtgaaagcatatacctgagagttaatattttttaaaggtggaaaggaacagagatgttcccatgaatattttagacacagcaaattaacactgtaatagtaattaataactaaatcataccggccagctccaaaacatcctctgctgatccaatcttccacaggaatcctctatcgtctttccctccagaagccacaagtgatgcatctgtaggactgcatgccacagcgaatatctcgtctgtgtagaacaagaacaggaagtatcagaatatgtataacaaaatctgcatggataagtataactggagactggagtacaaaaaaaaggagcaattgctgcctgagttatggatggtgtggctcagagaacagtgcatcaaagttacaccaatcaagtactatattgaccaatgatcagcaccaaaaaaatcataaattcattcttttcaaccaacttgcctgtatgagcacgaaatgcatattgggaatcatcctcttgcatatcacctgaaattgaaaggatagataattacaaaccaaatttcacaaatcacaagtaagacagttcagaatagttaaatgcttagcatgtaaatgagcaactgaagaacagattgcaactaaaattctagaaaagagaatgttcctctaggatctgacaggacagctgtagaaacataaatacacaaccattgcagttttctttataaatcaaattaaggctggacaaaatatgtccaactgtcatatttctcacaattgttccatcttttttaggacgcaataatattttcatttgcaagttagataaagaaagcagttagccgattgctaaatcatctaaatgcagttgcaccaaacgagattaccataatgcacctgaatgccaaatggagcataagataaacagtaaaacaggcaaaaagcataatactaaaacagaagtgcactcaaaataagttttccggatactaataaaacagaagtgcactcaagagaagtgatccagattgtagctttgcttaagagaaccaccaagacaccaacatcaacaaagcaaatgtcaaactacgccccatgtaactccaacaattatataggcagtataacagcataatagtaacacagaaatgcatccaaaataagtgttccagcttatgtagcccccaatctattgcccatgattgtaattctgcttaagagtcgaactcatgatattctacagaattccaacagtattggagaggaaaatgttatattctacaaagcatattgagccttagcatgcaacatacccatcccatcgtcatcctcatcatcatcccggtcagggagatctgaaaaacacaaccaataatagtaagcaccaagcaaagcagaaaacagatagatggatagtactactactagtagtaatacaaaccttcctcgtcgatgggtatctcgtgtatgatgtcctcctcattgatgaacacctcctctccatcagagccttcgccggcggggacctcgcccgagatgctcatcgtgacttcacctgagttgggggcgactcctcggccgcaagaaacgagaggggagaagggaggaggaggagcggcgcctgtgtcggcggaggtgtgcccgcgccgccgcgatgcttgcctgcgacgagccgggctggggcagactagggttctggacttctcggcttctcccgcctagtgtcactcgtgtagtaggatggcaatggggcgggtcggggccgggttggtctggaacggccccgcccccggcccaggagtggagggcgggtcgaaatcgatccccggccccggcccctccggggccccgctgcacccgcaggtgaggacgcttggaggaggcggcgcggcgacgggcagaggcggagcggagacggcggcgacgagcggaggcggagcggagacggtgcggcgacgggtcgaggcggagcgaagatggcggcggcgcggcgacgagcggaggcggcgatgggccttgggctttgatccgtgggctgtgggtaggttttcccccataggcccaatcccacgagaagatggaacatcaaaaggtaaaaaaaaaagccgtggcaaacccgtaattattcgcaggaagcatcacttcgccgcaagacggcggcgaccaccgctcctcggctggagggagccctcgtcgccggcgaagcccgcgcggccacctcccctgccggagttggccatggtgagctccacctctctctctgcgtgtggctgcgcgcctcgctccatgttccggtcggcttattccttactcgcttcctctctctcgcgcgcgcgtctccgcggcgctcgcagttctccatcgcggccatcaacgagagcgacaccggcgggcagtgggagccgctcgcgcctaccaaggaagctcaggcaagtctcctccccccttgtcgccccgagcattctctcttcctgcgtatctatctaatgcttcgcctccgtagcttgtgattttgggccccgttagggttttcggttcttcgagcgcaatgtgatggattgattggttttaagtgggtaaacgcagcttaatgttgtggcaagcagactctaggagatgtagaattcgatcaccctgttctttgatgtgatgtgatgtaaggtaccatgtgttctttagcttgtgttttcgacaatttgggagcttgaagtggggtttttactatctatggtttcttccgattctgcgacttgcgaattcaaaataactgttttttgttcctttgatttgatgtttgcttatcccctaataaaaggataatgtaagatttcggttttcattatcggttgtaggtgtaggagggcactcaggttagacctttcaggttaaggggcagtattcttgatgttgagctatacatgctcaattgctcatgatgtagacgaatgcgtgatagcatagtactacattttttttccaaaaaataaaattgttaggaggttaaggtcgttttgaaagctagctgttggtaaagattttggtgtcatctttagttatgctaggaaccgatttaattgaaatacggaataaatatcttctaaactgctttacgagaatcggaagattaacacagacaattattataagtaaataactttgggatggaaatttttaggattactagctaattaccaatcctccttgacatattttgaattaacataagttataaactttatgaaaagttgtatatgtttctcagaaggaaaacacgtatatctatatcatgtgcctagattatctattatctagaaaacatctcaccaactcaatccataggagccttttgatttagatgttctaatgctccttctctattcggaaggagagatatgcccccccccccaacccaaaaaagaaaaaaaaaaccctgaactaaacttggtttggtgcaagtctttttcatttttaattaaatggttaagaaggatatctcagggaaattccaagttattattgttaatagccctttattgaacatgctgccatctgattatatatgtggaactttgtttagttagaggcatgatcataaaaaggtgctccaacggaacaaaagggaatcttccaggggcagatttctactttattttactcttttttaatccttgaataacattggttctattatgtaaacattaatttaggatgattcattgaccactctgattgtcttgatgttgctctgctggtcctggattacaatggaatgcatgtattaatttatagtttgataggtaatatacttgttcatctgcccttttattgatgtgttgatgtgttgggatttgggattggggatggtgttctctgtgctggatttttatggacggatacatgattggtaatttaatgcattatgtatacatatctactccctccttccacaaaagttagacctgttacttttttcaccaagaccaagagaaattaactcatttgcatgtaacaaagatcaaggagtatatgcacgcatgcaaccaatgaacattaagatggctcatcgggttctgattaaacatcaaatttacctctccgtttaagtcttggatgcatagagactataaataggaacaacttatttggattttggaaaaactaaaatatgaaataggtcgaactcttgtggatggagagagttctggctggtacacatttttatttaattttagatttgaagataattatttcggtatctttaaaattagaatatgtgatctgtattgtttcgagaattgttgcgatgcacagtcagtcagtcactgtgctagtacttcctccatatcaatataaggacttttagagttgggcacagttattaaggagaaatgtaaaataaaatggatggttgtgattggttcagatgaggaagtaggtggagaaattaaatgggagatggttgtgattggttgagaggtggaaaggtagctatattttgggacaaattttgaatgctaaatgtgctatgttttgggacggagggagtatatcataatataccagttctgatgtagttttacctgcaccaactagatgtgcgtggctatcatatcatgtctgtccaaggaattgattctgccagtcttgtgcaataggtaggtcactgtaattgatctgagaacacgtttagtagttaattaacagtatttaactgaaggattcttttgtaaatctcttcctgtgctaaggtcattttttttagttttacaacttacaagctctcaattttgttgccgcaatattactgtgttattgaaattacttttcaaaatgcttcaggaatcagcactctctcagaagtaccacgaggggctcctcaagttgcaagaaaaaaattatgtaaaagctcgtgaacttctggaggatgtcttaaaggacccactaatatcaaaaattcaggcaatctctataagaacatttcagatatcagtttgtttagacctgtgctctctataacaccaagttgtttattttaaacaggctgataacattgtcagtgatcagcatttgctgcagctaaggttcttttctccatacctcatttgtaatgttcatgatgtaattccatttttatttgttggttaaaatcattgacatagcgcgaagaattataccaagtggaataaacactcataaaataatgaaatttcttagaactacaacagctcttaatttaagaaagatgcatttgtgtcatggggtaaccacacccccatcatctaattcaccatgttgcaatgattcataaaattccaaaagagaaacaaactcatgtgtagtacacataaagttatacaagcctgcaaaaattcattccagatatcgaggaacaaaaaagagaagcaatcaattggaactattcatcatgtgctagcattacaacttctcttttttggatctcagctctcttttttggatctcaacttgtaggatgaatctgtcattaaatttgtgcagatttataaacattatgtttatattaatttgtgaagcataggaatgtgttggattcaacatatatttgccgtggagatggtcgttccttaggacaccatattttttagaaccatattttttggtgggacaattctctctcatataaggaagcataatttgag

SEQ ID NO: 8566 - DNA, 6420 bp, Oryza sativa
catcccaccaaaatcccttatatttagggacggagggagtattataactaaaaagtaagatattgataatatatcacaagaacgtaaatatacattactattacattgcatacagtatgcaatgaggataaaaaaagaacttgggatacaaatgactcagattgaattgcaagcatcaactaaatcaattctatgctgaattgcaacaagcagaacctttcaaccacatcccatcccaatttaccccaatctgattaatcatggttttggtttgatcatgttttgtggatagatctcttcttttaagtagctaatatcatatggatgatataatataatcataggcaactgtttgtgtgtcacgatttcttgaaggttgtgctatactacacatgtgcataattgggtgtgttgactcttcaatcagatataactgactaaatttcaatggctgataggtttgaaatctgcaacattaatttttaacgtgaggcttcttaatttcacaggtttcttacattgaaaaaccttgcgtctgtttttcttcaacaagggtcagcattttatgataatgctcttcgttgttacctacaagctgtagagcttgatgcaaatgattcagttgtatggaaccatctgggaacactttcctgctctatgggtttgttgagcacatcaagatgggcatttgagcaagggcttctatgtagcccaaataattgtatgatgtcttttttcattattcccttctagtttattcccactgccttttagttcatctattgttcctaaaatccatgatttttttctggttttcagggaactgcatggagaaactcttggaggtgcttatagctatctgtgatgaagttgcatgcctttctgtagcaaagttaatacttaggagttggccatcacatcatcgggctttacatgtaaagaagaccattgaggatgcagaaccagtaccctttgcacctcgaggtatcgacatacttgaacccaagcatgcaaaactcaaattttgtaacaaaagaaaatctggagatgatgaaacgcatcatgaaacagtgacaaagaagagtaggcagaatgctaaattgcagttgactgaagccaaatggatggcccttttagatggtatcctaagcttcttaagttcaaacaacacaaaatctaatgaagatcacggtgccaatacagagagtcaatgtgatactaagaggagtatcaatgggtttgcttataacatgatggatgtctccttatctacggaaacattgaaaactatggaatctgcaggtgggaatgaacatgatttgtaccatgatggtgaaagtgtgctgtctcatgactgcagaactgcagttaaagagaaggacaccaattcagatagagaacatcctcatgaaaggagaagcacacgtcttgagaggctgcgaagtcgtaaatctggtaaagatgaacatgaatccaatggaaaagatatatcacatgctataactcaatttctagattcatttatcttgaagcgcacaagtattccagaaaagatcgattgttctggaaatggtgatgcttctacccctgaagctctaacatatacacctgatcgtgaggcaagtgatgtgaagcaatttctttccaaaatatcaaaaaattgtggacctcttcatattggctatatgttacttgaggaaatagctcagaccaacataccttttcaagattactttgttaagttcattgaactagacaaaattactagaggctgggctcaagatagatctgcacaatgcagcttatttcttgctgaattatactatgatcaagctctttgttctggaagcccattagcatcctcagagttgtccaattcatcttaccatctttgtaaggtcatccaatcagtagctttggaattgccattcagaacctctgatggagcagcaaagtccaccaatttggatttgaatatggaaagccatatggaagaggtgtgttcaagcgataaaactgagaagaatgcctcaaatatgtccagaaactctgtaaattctgtcaactcggtttccagtaacattctttgtgatgaaacatctgaatgtgattcttcttcaaacactaattgtgttttctggattcgcttcttctggctgagtggttgtctgtccctttcatcagactgcaaagaaaaagcttacaaggagttcaacattgccctgtcacttatgagaagtagcaacgaagccaaaatcaatagagagtttgtccttctacctcacaataagcttgtaaaattgcttacagctgataggattcttcgtgaaattaacttggtcaagcttgaatctttactttggcataatgatgaaaacatcaataaaataactcatacagagttcatggaattgcttcctccacttttgctttccaccaaagatgtctatgttggcagtgcatatggtccaccaagagaaagtgagaaagttatttcactagagttaggtgccttggatgttttaatatcagcatgtgaaaatgctaaaccaatgaacatccaggtataccttgactctcatcgaaggaaaatgctcgttctaactgtggcagctggcatggttggatcggttaccaccaatgaggggtaaaaaatcaagtgatatagagtttatggaaacattgaataggaatcgactggaaagtgttgtagaagcagtcaaagatgtttctcgaaatgctagttaagcgaaagcctttgttgatcagtgtgataaccctgtcagttgactgctctattttctgtggattttcttgactgtcatttcaattcaagcctttcatacttggaacgctatctaccaagcttcacttttatattataggtcaatgcacaacactgcaccagactaaaagaatattagaaacaaggtataaaggaagaagtatgtgtggagctaaatgataatttcataaaattccgtaggtctatataagttggtgaagctgcatagaacagtggaggaggaggaagggaggaaacttaaatattcttattttatttattttgtggagaataggcaggagaactgtgtatcattgcggttagaagtgagctaggctcaagtatagggacacaccgctaagctaccagagagaaaaatgcacacaaaaaagaagctaggtatacaatttaagaattggtatattggtgactgccaaacttttttttactttgaccatttactcattagaaatatttgtattgcatgctcattgagtgctgtgaaaaataacctctatctatgattttaggcttttagtaacatatggtaataaataagtatcttgcagacagtataaaggaaattttcatgtttattttttgaacaaaggaatagataatactatgaataccataaatgatcacagggaattacaatatgtagaattgtatagcatgtcagaggtaaatcttttgagcttctctggaacatcaactcgcccccgagctatctaatatacaatttaacccttaaggatggttgttagggtaaaggttatgctgtgcattctaggatggtttgtactgtccttcctgactgtttactgctttatgtggaagttgtttatcaatggtgtgttccagtttagcttaacactaatgctatccagcatgagtgaaattagtatatgagcaattgtaagacgcccattattctgagatttttcaatttcatatttgtttctatattgcctgtatcagtttctttaatctatcaggctgaatatctatatttctaacaatctcggggatattattattgattaattcctcaaagagggctactgaaacgactgttttattgtcatatttgcaggatgggcaagacggtttcagttcactagtttctattgttggtgattttcaatcattgctcctcacaatcatgtgtgctgctgttaagatgatcctatccagaaaacactcgtgtactggaacctcctatcaggctgaccagttggagagttcctgccttgttgatgcagccatcgcattttgcaaacttcagcatcttgatcctatgatatctatcaaaattcaggcacgttctgcgcaccactttaccaaaaaactctctagtattgattttcatgattaactttagttgcttttgttcacatatgattctttgcaggttgacttgattgtggcagtgcatgatttgcttgctgaatatgggctctgctgtgctgggcgtgatggtgaaggggaggaagggacattcctcaagttcactatcaagcatctcatggcactagatgtgaaactaaaatcccaacttagtaggtgtttcctagcaaatttattatggtatcatgtttctgtcccaattaattactagaatttgtttattatctctatcttattgttagatccaaatgggatggaagaagatgcagcagaaaatgacagagcagaagatgttacgactgatgaggcatctgtttgtgacaataaacataattctgaggatgaggaagaatctggtaggccatattcattgcgtgtaactattccattttcctatatatcttgtggtagacatgatgtacaatgacagacaatactgtctgattatgtcgcatgcatattgacttactgacacgtaaatgcctggtgatatagtcaaattagaatccgacaaatgattgaataaggtttctgttaccgacttaccattgaccctgaaattctctgtttttgcagaattggatgaaatacagtcaagcattgacagtgccttggaccaggcctttttctgcttatatggtttgaagataaaccctgattcttgcagtgaagatgatttagcagtacacaaaaatacaagccgtggtgattatcagacaaaagaacaatgtgctgatgtgtttcaatatgtcctgccatatgcaaaagctctatctgtgagtaaattcatattgagttccttcattttgttgtttcagtttggtaagaagcatcaattgcagcgcatagtgccttggtcattctgttattcattttgcttcagaaaactggcttggttaaattacgaagaagtgctgcgagctatacgtaaacactttccacagccaccttatgacttattggtcaataatcctcttgacaatttcttggatggacctgattcatgcgaaaagattctctctgaaatttacgaaactaatggatctaaggaagctgtcctgaatgtactgttcccaggtgaaaatggctacgaagcattcaagaaactgtccaatgctaggttggctttgtgcattgtacctatagtccctcctctccttttatttttcttttgcactggaacaagtttagttgtggatataccctaagtacatttttgactgattgctgcagctcagagccatactcagaagtttatgggaacctgtatcactacatagcgcaagttgaagatataagtgcctctgacaagtatacaggttttgtgttaaaaaaagaagggggtgaatttgttcaacagagtgctaaccttttcaagtacgatctactgtataacccattgcggttcgaaagctggcagaagcttgctaatctgtatgatgaggtatgtttatttggttacagcagttgattgaacctgttccattgtatcatgcatttctgttgcataacaagtttttgtcttgttcaaaaacaggaggttgacttgttgctgaacgatggtagtaaacatattagcattttggactggcgaacaaatacaactttaatccaaagagttgagatgggtcgtagacatagtcgacgctgcctattgatgagtttagcattggctaaaaccgcttctgataaggtgtgtcctcttgttctgtactcatctatgagatgccttaggtgctatttttcttctttctatcttgatgagaacttcactaatattggcaatgacgtctaactcattttctttcaggcccaaatgcatgaaatgttggccctagtttattatgatagcctgcaaaatgtggtacccttttatgatcaaagggctactttgccagtgaaggattcaacatgggagacattttgtcgaaattctatgaagcactttcagaaggcgtttgaactgaagtaatcttacataccttgttagtaatctcatattctgtgtgttgtttgccacaagtaggatgataatgcttatttccttcacagggctgagtggctctatgcattttaccttgggaagttgtgtgagaaactggggcattcccctgctgaagcattttcatactacaacaaagctgttgtgttgaatccaacggcagtcgacccggtttacaggatgcatgcatcacgcatgaagttactttatacccaaggaaagc

SEQ ID NO: 8567 - DNA, 513 bp, Oryza sativa
gcccggcccggtactagcccgacattttttgcttgcgagtggagttgaacggaccgcaccggcgtcagctcacgaggcaggaaagaaaccccaaacccgcgtcgccgacgccgtcgccggcacactcgccttcgcctcgcccaccaccaaaccacctccgatggcgcccggctcctcctccacctcctccccgggaggaaaagccgccgcggtgggcggcgaggcggggaaggagggcggagccgtgccctcgcccgcggcagctgcctccgaccacgctccggtggcgcccgacggctcgccgggaggtggcgcgctgccggcgggcggcgaagcggggaaggaggacgagggcgtcgcctcgaccggctcccgcactccgctggcccctggctcctcctcgggagaaggcgcgctcggggaatgcggcgaggcgaggaacgacgacgaagcgccagcgccagcgccacggctcatcgcctcgcccaccgccgccgccgccgccgccgccac

SEQ ID NO: 8568 - DNA, 6399 bp, Oryza sativa
gattttcatgctgattttgttatcagctgctaacctctgataccatgtaaacagtgtgaagcagggacgaacagaagaaaaggatgctagttctgatgttggggaaccaaaacagcctcatgacaaagatctgtgggacaatgaaggttgcaaactgtgggacctttcagttattgaacctcaggcagaacttatggtacttatctctatacttgatagttgatatcatgtcatagttgataactgtgcattgaatttaagttctacgatgagatattctgcataattattgattatgattgtgaaattttcggcatgcctctatcccaatagcatgccagcatcaatcaacatttgaacaggaagattagtatcttctactaggagtcgattcttatctattaaaatatattatttacaagaaagcttttcatgatctgcgggcatgtactatttgtaaaagattgtgctactgcaatagaaggtgaatcatcaattgagttctaagattcactgaaactactgcttgcaccatcatcgaatttttgtactgttgtattgtaagtctttaagtgcattgactgcttgcgggaagcgctaactgtgcggatctttaattcttgtaggttaacaaccttgtacttgaagtacttttggcaaaccttcatgtgagacaatttcttcgagcaaaggtgaagtggaatatccttctactactgcctccacgtttttgctagcaaatattttaataagtcttgcttctctgaattttgttctccacaggaaatctgtattgggatcataggaaacttagcttgtcataaatctctggccaatgcaatcacttctcataatggattaattgctactgtcgtggatcagttatttcttgatgaccctggttgccttactgaaacattcaggttggtattcatggaatatggtgaatgtgcgcgtaattatgtagtggaaacctggaaaccaccacataaaagtttccaaaagttttttaaaaaaatctcaccaacgaagtttgatattaaaattgtgtgtggttttctaatatcatctttactatatgtaacatttttcttgaaattttttggaaacttttacggggtggtttccactacatatttacctatgatgcacggcttgtgctaattaagactatctacatagcactttcttgtttgctctgacaagattaaaaacaataagcacgctattgtccctttgactcctttagcaaattgtaaattattgaacctgtaacaatatgtttttagcaatacaagttcttttatcacctgaaattaagcatttatcatgtggaaatgaatcaggcatcttactataatttatgcttacaacatatgttacatgcagacagatagtcatacattacacatatacagcatcactatttagtggattgtggattaaaatgcttgaatatacagctgttcttaagaaaaaaaagtaaaatgtaacttcttttagcacttgtaagtactccttattatgattccttattatgcatctccttttcttcatacacattcatgttatctttctactttttttttccttttctatttttgtatatagactatcatgacaacccgagttctgttctgaagtttactagttgtgcagtcatagtcacacagtctatttgtatacaggttattgagcaccatttttcagagcaacgcatctatgtcatgggctgaagctctcttacctgatgagattctttcacgtattatgtggataattggaaacacagtgcatgctaccttacttcagaaggtgaagtacttgtctatccagtcaactagatcctaataggttgataacttgtattgaccttagcttgatgttgaacattttaggatgatttatctatttgacattctatgtaataattgctacttttattcttttacaaatgatagttagttagatgtgtttgcataatttgttctttttcagttgatcttattatgattcagtgttagaagggcgttatgtaaatcatttctgttgattgttacatgtatggccactatcaatgtaatgaccagacctcttaatccattgtaatgtgtccaggacatccaaacaacttcttgattgcccttctgttaggagttcttatttatttcatcattattggcaactttgatcttacctgcagttgtttctcatgtttcccatgaggccatgagtctgcagacactgaagatataattgcaaactagttttgaccatttatggcctatgaactattttggaattcatccaaaaagctgtgcacttagatatttgatttagtataacttaatatatttgatttagatatttaatatagttatatggtgaaattgtggtacggctgaaatcatctggccaactgacttatggcattatcttttgaatcctgtacatgttcaaaatttgtgactatttcctttgtaaattattgggtgcagatactggagtttctatcagctcttgttgatgatcaagatgtcattaccattcttatcgagcccttgataaaagtgggtttagttgactgtgctattggtttgctattaaatgagcttgaaaaatcaatggatgggaacaatctagacaggtatgatttctgtgaattgaagtctgaactaacttcaaaattgcaaaagtgtacagttcatgtaaaattatctaagaaataagaacagatgactgtcaaatctagtgaactatactctatttacagttcataaagcatacaacatatcctcttgctataaatctaatgcatggataggtccataaatgccatctgaaatgcgggcacttgatgttcaccgataatttagtctttgtattttacagttttcatgttccttctgcttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctgaaaatttatgcagattagatataattatgttccagatgagcatgctgatcatgttatatattcacaaactatgcttcaggttgagggctattgtgcttctgtggtaatcataatagcaaatgttttgtctgatggagaacatctcacacctattctgtcccatggtatgccacattttgctgagcaatatctcataattcttagccattgtttgcgagttgaaaacatgactatttagatacagtgtcacagtgtggtgttatattcattgtttcagatttacccttactggagggcctatttgacattcttccattgatctctgatgataatgaagctcgaaatgcattttggtgtatcttgacacgtttactgcaacaagtagaagaaggagaaaccatcacgaactcttcaaaactcgagcagtttgtgtctatcttcttggctaagttcaccctcatgaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggtgctagaggtttctgatcaacttgtgctcatggcttaacgagatgctggcaaacctattttgttgcgaccgttaccaaattgcttcttgttgtttcgtgtggtaacacaccaccacgattctattgatgcaaaatgagttcatgcaactccgtgatggtatgggctatgtaggttgaactggaaaggttactttaagttgggtatgaaaatttgggaatatttgatactaaatttgataatttgcaaagcactgtaaaacgtatatgcatcttcacgaaccttgtctcgctttagggagcttctagcaagtataattactcttacaatctccaactctttgaatagttcaaattcctattccagattgtatgacggagggttgttaatggaaccttaacagtgatggtgtttttgggacaaagttgcttgtacgatggtatttcataaaactcgttcttgtcgatgacatttcttgaaattgtgcgcatgtcaatggtattttttggattttctcaaaaatgaaatagacacccccattaatgaatgatggcgtaggatgtggattggggtccccagtattagaatacaaaatgcagaggtgctatagaaattacagcaggaaaaacctgcaccatctagcacaattctagacctatgattaacatccacaggatgaatgtgatagtactagctataagataaaatcctgatgctacaatacatgactgatttaaactattagtttttattgtgactgctcaagtgctttgtaaaggcaattgagtagcaactttgtattagcaattcaaactgcagaggatccggatcccgtaggaatctgctagtatatatacacatgcgtgaattgttcagtattgtcgtgtgccatctttgaaaaataccttttcttttaaggattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaccacatatttcgatggttttaactgaaaaaaagaggtgacctcgttttctttcctcaatgagagcagaggcaagagaaaaaaaaaagagtaaagtccatcaccggtccctaaactttaccgctgtgtcatcccagtccctaaactcgcaaatcgatcgttcaagttctcaaacttattcgactgcgtcatcctggtccctaaacttgcagatcacttatttaggtcctccaacttgttcggttgtgtcaccccggtccctaaacaggacggtctaaaaactttatatcaaaaaataattcataactttttcatgtaaactctaatgaagacaaactttatatcaaaattgtagccctcgacacgacctacaactttgtagttgaaaagtttttgaattaaaactgtttagggtcccaaaatattgttgaatatttatagattttg

SEQ ID NO: 8569 - DNA, 8394 bp, Oryza sativa
atttatagattgtgaaattttaattttaaaattacatattgggacaaaaaatgacttaaaataaaaaaattcaactacaaagttgtagatcgcatcgagggctacaaatttgatataaagtttgtcttcattagagtttacataaaaaagttatgagttatatttaaatataaagtctttagaccgttctatttgacctagatgatattcaaatccaaatttaaggaccagggtgacacaactgaacaagttggagaatctaaacgagtgatctgcaagtttagggaccgggataacacagtcgaacaagtttgaggacctgaacgatcgatttgcgagtttagggaccgggataacacaacggtacaagtttagggaccgatgatggactttacttaaaaaaaaaaaacaaaacaagtgaagtgacctcagctgctgcggtgctgcctgtccctccgcatcaccacacagcacgttccccgagctcggccacacccagtaccaagtgcacagccgcagcgccgcatcaccgccttccatttccacatctagggtttcagttgagtcgagttgagtccccctccccccacggccccacctcgccaccgccggccatgcccgacgcggcggccgccgccgccgccgcccaggacgccgacgccgtgatgcgcgacgcacccgccgacgcagcagcaggcggcggcgacaacgacgacgacgacggggatgacggcacagaagaggacgaggaggaggatgacgacgaggagggcgatgaagaggagctgccgccggccgaggatccggcggccccggagccggtctcggcgttgttgccggggagcccgaaccagctgacgctgctgttccagggcgaggtctacgtgttcgaatccgtgacgcctgagaaggtcggtctctttactccgctcatcacctcgtgtcgctttccttccgcaatcgtcctggaaatgtttagctcaaaaaaatttcgtgggatacgatgaggaatttgacgtgttagtgttcgtgcgccgcaatcggatatatgattggtatattgtggtttcttgtttgtttcgagtcattctgtgggtaggattcttacagttcaggaattctggattagtgctgctactcccacgaaatgtccctctgttttttttttaacttgaatctcctttgctactgtcacttcagctagtttacaatgttgattgttggatactgttacaccaaaaaacgcaacactagaaatgtactaatttattctatttggataatatggttgatttggtttgaagtataccgtcatgttcatgtagacttgaatattggatatacctatcttagactgttagtaacttagcgcagagcggtccagcctctgaattagtgtaagctcgcagttgcaatacaacaagtagccactattatcctctggctcatagttttagtaacggttaatatgattctctctccatcccaaaatatagcaacttgatactacgattagacaccacctatattacaaatctggacaagatgtctatccaaattcatagtactaggtggtatctatcgtattacttgattgctatattatgggacggagggagtatgtcagttcttatcactcacgtagattactagtaacacatggtgatgacttgctatttcctacaagttagtccttggaacttttcagttgtgcagtttgtgacccgagttttctgttgtttttgttcttggctggaatcctgattcatgtaaacaatatgatggcttgtataactgcttgctataatcccaagttaaatttattccagagttgagttttctgaatattcatttaggtataggtatttcttttgttcccttttatggtcctgtcttttcataagatgaagttttttttcccaggttcaagctgttctgttattgttaggaagaagtgaaatgccaccaggtttagctaacatggttttaccaaatcaacgtgagaacagagtatgtggaaataaatagttccatagtcgcttggcaatctgtattgttttcttcgtttatagttcatgttagaattatctgcagggttatgatgatttacttcagagaacagacattcctgccaaaagggttgcttcactcattaggttccgtgaaaagcggaaggaaagaaatttcgataaaaaaatacgttacgccgtacgcaaagaagtggcactcaggtttgtatctagtctgattgagtattcaccgatcttttgcaaattctaccacagaagaaggcatagatgaaccatgtggatttgctacagtcttctaaatttgtttagatcaatcatcattctttttcattcttctagttgatggaactgctttagtgtccatggggagcacatgaacattttcattaggggttctcaatttgattagcaatcaatgtgtctactgcttgattggttccatgatcataccatgaacatctaccaatataatttgcaagaaaaaaatgcaagctcaattttttgttgtccctggatgctagttgctcaatatgttccaacaattaattgcatggctccattagaataaaaatgtaacaaattaactgacttaagactggaggtctggagctgtacttctgtgtagctttaactaagagcaagatgtaccatatccattgtatcaatgagcaatggatggatgttatgagtcttttttgtggtaaaaaaaatctaatgatttatgctgctacctattactttctgtgtccgattgttttagccatcaccattgttgtcacctcaatctttccagctccatctcctttgtgaattttgtgtttgttgaatactgacagacaagaatgattggggccctggccagcagtgatggtacaaatagttcgcatacatgctaggcacagcatcaatggatagaagctaggctggagatagattaggcataggtaggaggtaaaggatgggatgatagatcccgtggattacattgtttgcagacccaggcgcataaaattctgcacatcaagctatggaatcaactagcaactaaattgtatgactagataaacattacttggcttgaaaaaattgatgttgcttctacttactctcaggatgcaacgtaggaagggtcaatttgccggaagagcaaatatggagggagagtccctatctccaggctgtgaacttgcttcccagggttcaggccaagattttctatctcgagaatcaaagtatttcttatcttttgatagtctatatactcgttctgtctaattattgtttagtagaagacttatcttctttctgtaaaatacttgttgcaggtgtcagaattgtggcactagtgaaaaaatgacaccggcaatgcgccgtggtccagctggtccaaggactctgtgcaacgcctgcggactgatgtgggctaacaaggtattgttgcatgtattaatgagctagtttattgtttatctttctttctgataactaatgggcttctcttcatctttgttttgaggacacctatcccatttcataaattgatagcattagaatacagtaatattctcgtggaggtggattgcataattacattgcttggttcaactggcaaaaacattcttcatggcatgcatgcctcttgttatggcgttacagtacagggcatgttaaggcagtggccctgttttgctatcttatgcggttgataatgcacttgcagcaatggtgtatatgcagtaccaactagggtaaaaagagtcatggtttttgaaccatattatgaagacatggacacatggttatatctgtcatattgtaccttttcttttatttttcgttggctttctaggtacgccgttgacttcaatagctatatgtcagaattgcgggtatggtcattttggaaattagggggtatacgaaaaaaataaaagtaaagagagcctaccattgttgttaattaagccgcttgtttcatgttattgttgactgattctctgtgcaaggaacatatctcaaacatcactatgtgacttcttattctgatgtttgcaatttgcctttgctggcactagtccctgtgtctggtaattgcctaattggtatctgcagggtaccctgagaaattgccccaaggcaaaagttgaatcttctgtggttgcaactgagcaggttcatttttttaataattattatcaagagtttgaaaatgaaatcattgctgaactgtcaatatttccatacccgcagagcaatgcagctgtctctccgagtggaatcgacaacaaggaattggtggtaccaaaccctgaaaacattaccgcaagccatggcgaagtgtaagtgccacatttcccgttccaaattttgttcaggcagatgatttgattgacagtggatcatatcctttccagcatgggcgacagcactccggcaaatgaagccgagataggagcgccaaaggcgcagtcacaataagtttatgtttaacctgtcatgattgaaaccaaaagattctggattctttgcctacaggctatacagctaaacatcacaatagaaggtctttttcctgaccaaagtatactgattctcctcaagtgtacaattcttgcttgccagcacatgtaaatgtaattgtaattaacataaagagcctgattggtgcctgttgtgtaaacccctcattctcatgacatctaagatagcacatcaagcagactgtcatgtacttccggctttggagctgcttctgaaggggagttgtctgatggtgcttagtgtcccttcctaactactacgcctgtaaagttgtaccaactgatccttgtacagtttgtattaatgtgtcgtctctgtctttcgttttccgttttgctttgtgtatgcctctctaaaattggcatttcgctgtcaagatgggaatatgggatgatgccatcgcaaaagggaaggagcccctgtgatgatgcgacggtgcctgctgggttacgaaatccctggggaaagaaaaagcatccactcacagggagctcgtgctacggttgatgaattatgatgatggctggctggttggctgctgtgtgtagagcaccccccctgacccaaacgtccagggtgcatcctcctatttcgtttgtatccaacgacgttttctttctgaagctaaacacgttacacggacaaatattgtaatggtacatatgatcttaacagaacaatcgatcactttaaaaaaaagaacaatcaattttagtactctctttatctcatattatataaaacttttgtattataaggctgcattctttcaaaggagattggggagagattggggagattgtcactcgttttccgcgcacacgcttcccaaactactcaacggtgtattttttgcaaaaaaatttttatatgaaagttgctttaaaaattcatattagtctattttgaaatttaaaatagttaatacttaattaatcatgcgctaatggctcacctcgttttgcgtattttcccaatcttctcaatcccctcaccctcaaacacagcctaagttgctttgattttttaaagactttttttacctttaaccaagtttatagaaaaaaattagtagtatttacaacaacgtataagtttcattaaatttaaccaaacaaatatattttgataatatatttgtttggttgaaaatattgctatattttttatacatttaattagacttagaaaatttagctaaaaaaaagtcaaaacaccattgaaaataccaaaagtaaactcgaaatagagcagtaacaagaaactgaaaagtaaccactctcactgaaatactactaagcaagtctaccggaatactgttacgctgacgtagacatgagtaagcgcccagattacatacacacacctatccaaaccccatcatccagttacgccgactttggggattattcgcgtcttcaccgacctaatataagcgtggttacaaatctcaaaaccaacaaaacgaaccatcttcacctaaacccgtccacacgccgggtggccgccagttcagcgagtgacgacgacgaccccccacgcgcggcggccgcgcccatctccgtcgcctccccgccggccatgtcggtgccgcccgccagccaccgccaggttccccctcttctccacgccatggtagattcctctccctccgcatcgctctaccgtggctgattttttttttgtttttttctggttgctgtaggtgtccctgaggggatcgagcgcgagggagatcacccgcgacgcgctgctgcagaaggtctccgaggagcgccagctccgcagccacctccgccgcgccgccgccgcggcgctctccatccaggtacctctccactcctctcctctccgcggcctacctaccagcctcccgatcttatctgggaatctcgtcgttcttcatgagatatacttttacttttacgttttattcttttgcgaacttcgattagatcgtgctgtgccttgttggtgtgttagaagcaatgcttttctggagattgtgtggagatggatttgatttgtttgaattaagtgcgaggtcatatgaagattttttttgggaggttgatgtaattattggtccacaatgattacgaatttaggatgcgcatatcaatctgaatgaaagtgttgctggtgctaaattttgagagttggtttaagcatgggtgagaggtctgacaggtagagaatattgagaaacccataattgctcagtgcctttctagatatttcattaacaaagtcctgcaaagatactgagaagcttataattagtttttgcataaataatatcagcagctaaccaagtctgcgaaccaccttatgtggccatttcaaaaagaagtccacagagtcattaggcatgtggctgttgttcatatgtgggtatgagaaacacaaaaatgatggatggttaaaacataaaagtaggatagaagtcttcatgatcctcttgttgctcgatgtggttagattggcaggatggttttggtgctacagttgtctgtgaggtggagaaatcatggatggctactagagtactagacaggttgataagttgattagtggcttgatatgtaatatatttaacgattttgtgtttgcacgaatttgctacattagggtaagactttcaatttgatgcaaacttgtgaggagtttgtgataatcctgtctttgtaggtagccttaacacacaatagatgtgcagatggtcaaatcaaatggattaatttattgcaggttcaacatttaaaattaggtttatatgtgattttccctcagtgcaaacagcaccgggagttctctgacaagaaacttgatgcccttgcaagctgctggagtacttaaaatatgtcttgattattaacgtgtttggagatcagttagtcgattgttatctcctttctctttatagacacaacctcagacagtagaatttttttaggatcatgctaatccactatgtttctttttcctgtgtgtgggtcgttcttctgaccattaagcttgatgcagaaatagttatttttatcatgggaaatatacatccaaagtagacataaaggccctctcagtgctcttgtatatgatctagatttctgctgtacttctttcaaactactctactgttgcacttgtacacttatacaattgatgcttttgttttttgctttgttatgccagcgtgtttggagaagatactcagtcataagaattgtttcagaacagctccatgaagagtgggaagcattaataaaccagcctgacattaatctgacaaaacaatggatatcaagcatgatgcttagaccatttcttttcttcgttactcaaccatcaagctggtacaagggacaacaggacaagactctaaactcgatttcggcatgcttcaaaatcatcttgaatagcataaactcaatgggtatgcctttttcataatcaaagtttgactttaccgacttccatcttgacctttttgtactttattttctcctccttaatgaaatgacacgcagctctcctgtgtagtttgaaaaaaaatgttttactttacccattccactagttgtggttaactcctataaaaatttatttatgtaatacttccttttgctgtaaggattataatcctttatattattcaatccttgtatggcgatgacctaattgttagttctagaatggaattatgtacttaacagaaaagaaattgcagtcgacgtgagataagcagatactccctccgtccctaaatataagggattttggttggatgtgatgtatcctagtactacgaatctggacagag

SEQ ID NO: 8570 - DNA, 2347 bp, Oryza sativa
  unsure (1)..(2347): unsure at all n locations
atccaaccaaaattccctatatttagggacggaggtagtatttgttttgatatatatatatattagtactgtttggttgagcagtgcaatatggaaggaatattacagtaacttttttcttgaggctcttgatccactgagctggcacaaatgggtagtctcttctcggtgagatttttttttttttttttggggggggggtggaatgtagcctctagatattactgtttcaagaaaaaagaagttctttgaatttgaatgtaaagtgcatgctatgctttgatagacaagaagtatgaagtgggtctacgatatgtaaccttgtttaataatggacagatgcatgctaagctacagagcgaagctcccaaccagctggcctccatgtttaaagataatacaaatattaccacataactagtttagaatgcataggtccataactgtccttcaattatcatttggtagatgaggttaaacacaaaaagcatgaactatcttggagagctagctttcctttaaccattacagtaacaataagaacagcctttagtcccaagcaatttggggtaggctagacaggaaatccaagtcaaaccacatgaaccacaagaaaaaaggaaaaaaaaaactacttaaaccacaaaaagtgattttctaggccatagttctggcacatggatagctactttccacaaactcttatccaatgccaaatctttcgatacattccaagccttcaagtctcttttaattccttcatcccatgtcagttgtggcaggtcatgctttgatttaaccattgcaccttccttttcaactgacatgtatctttcctctgtagatgcaagcaaaaatttatgttcctttgctgtgggcacgccagaagaaaggtctatttggctttatcaggcaaaaaagttgatttcactgtgctcattcattcttgccaggtgtaaccattcttgctgtaaggatggaaacatggttcagattactgacactgctatgaggttggctgtgtctttaactgattgcaaaacatggaaaaaaattacaagtgaggatactagagctgctgatgcatctgtggagagcttgattgaatttattggtgcaagccagagtggtacatatagttgtcttaggagatatatagtaaatcttggttctcatgccttggagaagaaaatttcttcaatctcaacagatgatcagttcctgattactgctagtgcagtcaccattgcgctacgacctttccattctatgagagcagggaggggtgctgatctaaatggtgcttcaaaggaatactttacacttatactcacaattccggatctttgcaaacgcttgccacctctgttgttgcctgctataaagcacatatctatactacaaccatccctagatattttactggtaagagtttcaagattttgatatggacaagtcactctattgcattttgtatagtatagcatttagctgccgtggaagccttgactctcctagaagtcataggttcaacagttcttttgctgctaacatgataattgcacactatagttgatctactgattttcaaatgactctcctagaagtcataggttcaacagttcttttgctgctaacatgataattgcacactatagttgatctactgattttcaaataataattaatttgttaatagcaggtatttattaggtttattgatgtaccatcataggagattgattttaaaatattgacatattgtgagtgcgaaactgatcaaggcatggcaggtggtagcagatctccaaggacaaaatatttgaggaaataactaaattggagaagtcaggggtttctagtggtggttctggtaccattccctactgtggatgggctcttggaaatcttgtaactttagctacagagcatgatgatttatccaattcagggtgctttgttcaagggctagattgttgcctatatgttgatgcaattaactgtgtttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8571 - DNA, 683 bp, Oryza sativa
ctcaaaccagttcatatcgaggcctttgaattgagcaggcccatcaggagacgagatgagaagctcatcaggtgcaagtcgatgtaaagcactagaccgctggatagtggagcaggctgatcagttgtttccatggattcaggcagtggagtgatggatgcaagtttgatgagaatacaacggcaccatgccagagaagcgtgcttgcatatcttggcgaaattgctgtttgacagtttgggtgttttaaaacgctttcttatcttctcatttagtccttcaagaacatccagtcggacatcactctcaagcaaatggatgtattggtggatataactgccacaaggaaataaagtatgaaaaccatctggcttgagtaactatgtattttgcactctaatctagtaattacctgtaaagattgctttctgatagctcgggactattgacctctggaatagtgcttatatcagcccataagtttgcatggtccatgaacacaccaaacattttctcaagtaggttctcaacggaagcatcgccagaaactctacgaatctcaggattgcggattgctgaagttagaacttgaaggtacttcccaagaccaacaggaacgatatcgcccaagcatagagcaaactacaagaaaaatagacttattattataatatatccacaaa

SEQ ID NO: 8572 - DNA, 604 bp, Oryza sativa
cacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaac

SEQ ID NO: 8573 - DNA, 613 bp, Oryza sativa
gatatatatatatatatatatatatatatatatatatatatatatatatatatatatatatatatatatatatatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacagcaatcaacaaatattaaaacactctcctttctcactccca

SEQ ID NO: 8574 - DNA, 352 bp, Oryza sativa
aagtgagtattcagctagagctgggattagttgactcactttggaggagggtagtttcttgggatgattccccagaagacggcgtacacccactgggagtcgcttgggtgcagatgccgcgcagcgtgtgctgcaatagctgtgtcacagccagtgggttcagctgctcctccattgcaactgacctgaagctgcttctgttgctagctgatgctgcacacacaatcttatagacggccaaggaatcaaaaacaagatactctaaatgcttgctctcattaactatccacaaatcactgtgtatgtcatgaaactgccgcttgatttaaagctgaagggctacctagaaaaa

SEQ ID NO: 8575 - DNA, 1313 bp, Oryza sativa
tgaccgtctggatcgcttcccaccttgaatcattccctttgtgcggcttcgtggtggcgctgctcatgctgctgcgtgagctctcatcacttatgtcgctgctcgtgctcgcgcgacacatgctgctcttcccactctcagtgaaattagccctgtcacttgtcttagcactaccactggtcttcctcaaactattcgtcccatcactcactttagcagaagcaaaactatcgctcgtactactcttctgtgacgtcttcttctcctgattcccattacaatccaagttttggatctccttcagttcgccggaatcttcctcctccgcgactaacgaatcatccaggatcccagactccgaagagaggcctgaaagctccttgtccagcgtagatgccggagaaccttgatgctggtcagatggtgttcgctcctcggaaaccacctcagcatcacctccctgttccccagtgcccttcggctttgccgcttgaccaggcatgctttgcagcggtgatttggacgacatgaactaagcagtttatcagaaacaatcaagcgcggaatcggacagcaaggtgaacaaaatccctccacccccaaattcagtacttcagcagggcggtcaataattcctcatctgaaaaaaaaggagagaaaaatttccccattagcattaccatgttaccaacataacaactagggtttgttccacagtcactccgatttcattcacacaaacaaacaactcgaggggatcaagaatccaaccaaaaaaaaagaagagataaaaacaaagcggcaccgatgaaccagccggtcaaatcgagcagaaacccacctgaacctttcgaacaaagagagaacccaaaaaaaaacagaaagggaaaaaaaaaactttccgcgattcaggatcaaagaaacacctacggattcgacagatccagccccgccacatcgccactctccaaaaaggggaagaagaacaagaacaagagagtgcttgctaggaggaagaaaaagatgaaatcacgaggcccccggcatttcccacagaaatagggggtggtggggaagggaaggggggaacaatgggccagaaaagaggagattaataacaaaagctggaatctttaagataatcccctctcctcggctaaaggaggaggcagccacagcacagcacagcacagcacacacactgctgctcctcctcctactcctactatacattgcagcatgcaacctggaacagcacagcacaactgcaagctcacaagaagcagcacaccatgacacccctcctcccccac

SEQ ID NO: 8576 - DNA, 9309 bp, Oryza sativa
taaaattgattaattatttgctcccaacttcacaaaacatgattcttataccgtattactaaggctgtttttttaaggagtttaaaattatgagagcttctgaaatttttctatttttctgaattctatagattgttaaaatccaaagatggtaatttcgatcgtttaggggagttggagattctagataaaccaaaaagaagcttcccaaacatagtctaagtttaagctatttatcagtataattttaccattcttaaggaactactaagagatatcataatttttaatgtaaaatttggtactcacatataattaaatatctcgaggtattttctcagggattgcttattctcatataagtaatcggtgattattattcgcttaaaatttaaatcaactgggccctaacctctctttttttttttcttacagtaggattttaagacggctcattaatctatcttgcttgtgcttttaggactttgggggtgagtgagtgagtggtgactcactaatcttttgctggttaatgcttaagactaccaactaatataatctcggtgttgcttcggcatttggggtgagtggtagctgctggtacagcgtgcattggcgacgttctctcgtggcccggacccaaaaatattatccacagggctagcttggaaaaaatctgaatgggaaaaattaatcctgataattcactttactgatttctaaagaagtatctggaaattcgtagggagaaggattttactggattttttttgtcagataagtgcagttactcaacaaaggctacccaagcaaactcatatgcttgtactatacgatacatccatttaaaacatgattttttttgggatctttatgtgttaaaatcacatgttctatgatgtatgcgtaaaaatttcttcttcttctttttttcatgtccaaattgtcaacctcttatgtaaggcttctaaattattctggttttctttccttcgggaaaaaataaactattctggtatgtccaaattgtccttttatgtagagtggtttccttttcttcaatttccttttttctggtgatagccaaactttagatttcaccagccactgttatttagctgcactgcaaacgattgtgttcactaaccggtgccgagtagcaataaccatgcaatcaccactgatcaatcaaatggtttccagtctacagccggcagtttcggtaatggggataaactatgttgctactatcagcattatctaatctgtaatgtccaaagcttaccttgaactaatacatcttaaaatctctattagagtggggctaaccaattaagcttactttgatgggctggttaatctcactgtggggttcaccaatcttgagagctagcaataaagctagagccaagaaattgtaatcatagctgctacaatcgagggctttgtgcttaggtcacatgtatcattaacaagggcatgagaaataaactataaagaacagttccatgagcaaactcaaggtacacatggaaaattactgtgtgattactgaaaagagttgtaaaactcatgctttagggttcatctttttttgcaagattgaaacagtgatattttttcttgaaactgttggtgtttcttggccaactggtgccggttgcaaccatcatctgaccaaaattttcatatctagctaagcagtcagtgagcaaggcaggcagacttagctatcaaccaggaatttggtgaatcaaatcagaaaaccacatcaaaactggcacgtagatttcgacaattccatcagaatccattgtctgtaaagactgtaatctgaatctccaccattcgcctcctgaaatctgaacattgcaactgaccaaaacagtttggcacctccaagcagacagcaacctgaaaacagcctatcgacaagcaattcggcgacgctcttaaacatatgcatctatatctccctatcactgtacatacactcatatagataccacgtggtccatggatctacagatacataattcagaaaaaattttggaatctttgaagtgttaggcgttaggtatgcagaactctgaacacttgaccgttctctcgctcttaattttaattaaactagctgggtggcccgcacaattgcgcggctagcacccaaacaaaatcatatatttttttaagtatgattttacttaaaatttattaaatagctatctcattgtcttaagactttgaaagaccaaaccttatcatcatcgagtttctaattatatagtttttaaaagtcacaccagttgctaccccttatgtctcatctccttctttatttgcttgctagatctaccactatttctattcattcttattagaacctttaaaaattagattttatagtttttagagtttattgtcacgttgggtttcatttttataatttctagatgtctcgtcaaacattgctattatactcctctatgacacgtccactgtcttatctctttattgtcattgagaatttaaaaatcgaacataattatcgtttaacttcatttttactttttagaagtcccgccaaaccgttagcggctttgccattgtaatcctctacggctcgcccgctgcctcccttctttatttcattttgattttaaaatcgaatatgattatcattggtttttttacttttcagaagttccgaacctttaaaaattggacttgtagttttatttttaataatttttagaagtgccatcaaacgatgtcactatgtccccgatctacagccggtccgccacctactctttattgtcattgtgattctaaaatttttttttttactttctacaagtcccggcaaccgccttacttgtttgcttcacggttttagatgttacttaatatatctcgtcatgtgttttagatggttttttattttaataatctttatttttatcaaaaattttagttatttataaattgtattcctaattgaaatcttatttttcttgttctaattttagaattttttttaaaaaattatttaataccgtattgtgttattttaatgtttttattttttattttcaatttcagttgtttcaaaattgtattcctacttgaactctcttttattgttttctaactttggatattaatttattttttattctaaattttattgcttcacagcctccctgacgtctctccttttaatcgtcattatgattctatttggtgttttattaacaatttttatatgtcatatcaaccgtcaccactctactcctttataggcatgttacttaatatatctcgtcatgtgttttagatggttttttattttaataatatttatttttatcaaaaaatttagttatttataaattgtattactaatttaaatcttatttttatttttctaatttttagaatttttttaaaaaattatttaataccgtattgtgttattttaatgtttttattttttattttcaatttcagttgtttcaaaattgtattcctacttgaactctcttttattgttttctaactttggatattattttattttttattctaaattttaattaatctcgtattgggttcttatatggattcttttttcagtatgcttatttttaattccgaatttcagctaattttaaattgtattcctacttgaactcttcttttattttctttttctaattttagatttatttatttttattccgaattttacttaatctcgtattgggttcttatatggactcttcttttaatattccttatttttaattccgaatttcagctatttttaaatcgtattcctagttggactcttatttccttttctaattttggatcttattttatttttattttgaattttgattaatctcgtattgggttcttatatggaaacttctttcaatattgcttatttttaattccgaatttcagctatttttaaattgtatttctatttggactctcctttccttttctaattttggattttattttatttttatttcgaattttgattaatcacgtattgggttcctatatggactcctctttccatattgcatattttaaattccgaatttcagctatttttaattgtatttctactttgactctttttttctttttctccgattaatgtgggaatttctagccccacggcgaacgtggtgccttcgtttcgagctgtcttaataatataatagattctacagacaatggaacagtatattagtgacctgtgagatgagatggatagctaggcagggattattaattaacaaatggtgatgattagtttaatctctacacaacaaaggctaggtttggagccatgagcactggcacatggagcccctcatggccaaaaaagctagcttcagtaaacaactcaactaagatggcctcaccttcaaaagaaaagaaaacgaagaaaaaaaaagatggcttcagagactagtactactgtttgaaattcagaggctgcatgtgcagatgtacaagctggatgaatgacttggaactttgatgacgacagagacagatcagaccaggtaactagtacgagttaagtggagattacaactactaacagtctatcagaagtgatgactggtaagtttagtatgcacgcatatgcttgtcatttgtcaagatgatgcaaagtcacagattgatgttgaagtgttgaacggtgcaacgaagagatgaacaatctggtcgtcgggttaatctgtcccaagataaactagtaaagatgatggtgatgggaaattcagagtagaaaattttgcagttgttgcagaagatgcccaacgacaaagctcacaaaagagacggactttaccggtcacctacatacaactacaagtctaaagataagcagtcgaattaggataagccagggaagaaaaagcacaagacctgcaaagcatgacacgcaccagcaacttaactgatgtgcagagaaactaacaccatggaggcagacagaatgaaagaaagagattgttcagatgaatccaagaaggcaggagagatgttggcatgcagttgcaagatgatcaaaagcaatgatcaaaagcaatctggtaggttttggcaggcaagagagcttcagttcagctgatcaggagatgcagcagcatcagcaaattcagtaatgcatccaagcatggatgaagcgagagcacgacgcaatggacagcgacatggcgtgtgatgtgatgtgatcctggtgtgctgatacgcagcacatgccggcgccaaagttgcaggcttcttgcagccgcatgcaggttgtttaattttcttcccccccttgcttttctgaaagaagaagaagaaaagttcagacataaatctccatttgttggttacagatttgatgccgagaaaaaaggttgcaggtgtgaaaggaaatcccacttacaaaaagaaatttcatgcgggggaaaaaaaaggcaagaagtaatcaatggaggctgtacaggagaaggccaaattggcatttgtttttagttccaacacacaagactgaaaccagaaattgtgaagaattttggctgacaattggttggttttgctttggataaaaatgaaaaggaggatacaatccaactccaatactccatcgaatgaattttacctaaattccagtgtatatgcattgaatgattccaaatcaaagaagataaaaggttcagaaataatatacaggctctaaagagaacaaaagaaacaagaaatagagatcgtataactgggcctgaatcaaattgccaaaatgaacctagatcaaattaacaagacgggcccaaatgggcctacacgaatttatcaaaatgggcctaaactaatttatcaaaataagtctaagggtacgtttaagagatgaagattgaagaaaattgacaatatacacaaaactaggtaagtattagtacatgattaactgagtattaattattttaaacttaaaaataaattagtatgtttttaaagtaattttacttcattttttttaaaagaaaatacattaataattattttaaacataaaaatggattaaaatattttttaaagtaactttactattttttaaaagaaaatatatcgttcagctattcagaaagcgtgtgcgtggaaaacgtagaattttctcacactatcttcctctctctcaaacactgctctaaaccaattttactaaatgggcctaaccaaactgcctgtatgggcctaggagtacatgggcctaaatccataggctcccgtctaaccagtgggctaacccacttcccattctcgagggctcgtgtcttgtccgagtcgccggcggcggcggcggcggcggcgatgttgcggtcggcgctgcgccggggaggggcggccgtgaggcacgccgcgtcgtcgtcgtcggcggcggaggcggcagcggacggatctccgggtgcccttctccggcggaaagtggcggagcgggagcgcgcgcggaggcggccacgggacccgtcccgcgacgagttcttcgtggcgacgccggagtcgctcgcgtggctcgactcggcctccctccccatggtgctcacggcggccgccatcgcgctcttcaccaagctgctcatgatggtatcccttctcccgccgcgctgattagccttgtcactggggcgatgtgcgtcccccacccctagggtttacttgctgatgatgctatcttgctagcgccgtgtgtttgcttgaaatccgagtgagccacatgatgaatgcgcctgtgtatgaccacattatacactggattaaattcccatgctgcttttgcgaattgcgacggagccattttgctctattatgagcgtgtgcagctgttaacctttaggaacaagtagaaatgtctttcggaaatgattttgtaaagtaattgaagattgtttggatatggaaaatagatagatatagaaatgccaagattttctttagttgtttgatgtctgtctgaatgtatagtttacagaaaaatgtttcctatgggatagggcttgttgaaatctgcaattcaatcatggcctttggatatgcatttttgtttgatattacacttcaatccatatttgtctcactccaatttcacttcattacccatgagctaataactgccttaagttttgatggtaagatttgggaattcttcttgactcttgtgaactaaatcaaattagttgttaccaactgcatgatgtgcccttccatgggaaatgacaactgtgctgaattttagttgtatgttgtgggaaggaacatgatgcagcagatcaagaaagaggagacgcaagataaagaatagccaccctgatcaaggaaaagtaaggatgcttacgcgtgaagaatgggatgagatccaagaagtcaggccaaggaccccttttgaatcgaagttagctcgtccgcatgcccgtataagaactggggaaccagtacggctggttagtagctgacataacttctacatcgatgcatttccccaatattaattttgatattcagaattaattgaagttggcattctgatattcagaattgcttcatctacactgtcgcttccatgctgaaaaaaataagtgttgatgatatatgctagatagtgatatcgttacatgtttaaacaaccgagagctgcaagacttccttgcagcttggtttgactggcatcctaagctaattaagttacttcttacctgtatacagtttacagttttatgcttttaaccacctttctttacatagcttatgttaatgcttctctttataacccttctttgtaggaggatgtcaaggattgggctaccgatatgatcatggatgcttttactagagcagaagaaagtgctaagaaaaaatgattcagaagaaatggacaacactaaatacgtatgctttgaggttcacctgaatgcatagttagttaacttttcttttaatttcggttcctgtaaatggccacttttgtgagtcatgatatccgtgtagaataatatttatgtacttcctccttttcatattataagactttctagcattgtccatatattcatgtctagattcattaacgtatatatgaatgtgggcaatgctagaaagtcttataatatgaaacggagggagtagtaccaatatatgcttttggaactgcacaaagctgcccccaagcagcccatgtctgtcttggcctgagcaccagagattgaagttaattgtaccattttcattttcatagataaatggctgatggtccagcccaaacccaataaattgtgagttcgagtggctcaatggcccaaactgtcaccggttgagcaaaagtggtgaagttttcaaaggtttcttctgaggtggtgtttggatcacagggactaattttagtccctgtcacattggatgttgggatactgattagaattattaaacgtagactattgacagaacctatttcataaccctggactaattcgcgagatgaattaattgagcctaattaatccatgattagcatatgtgatgctacagtaaacatgtgctaattatggattaattaggttttaaaaaaatttcacgcgaattagctctcatttatgtaattaattttgtaagtggtctatgtttaatactctaaattagtatccaaacatctaatgtgacaggaacaaagtccctggtccaaacaccccgtctgttacaatactggcaagtggtgaaccacaccaaggatccgtgaatcttcatcgtcagtctggccaggttcatctggaaaggtaataatgtacttactgtataatctctttaaccagagtttcggcactcctcgctctcgtgattgggcgacaatcgcgtgagtcatctgagtttggatagagaggccaataattcccatctgagtttgtgacttggtcctgattgctcagatgtgcttggttttctcacttcgccatcttttactccttggccgatactgccacatttactgtgattccctcgatgcacgcgagtgcacgtcgttgacgcagacgccagacatggaccgatagaacagggacagtttttggaatctgattcgctgagtgaagagtgaagtggcataatagatttgtttgtcatttgtgaatattttcggatgaagactgatggatgatagatttgtttgtaaatgtggctgttaccagttattccctccttccttttatatactatctccgtccttaaatacgaagg

SEQ ID NO: 8577 - DNA, 783 bp, Oryza sativa
agtcttcatcctaaaataatataggtcgtcaatctcacttattagtaatatgacaaaaaacacatcaccctcaaaatcctagatgtttttcgtttcgggagggtcaataactggctatggttccacaatattcacaaagggtaaatatctggtgatagttcaacaagattcggacatatgtttgtctcattgtccattttccatggatgtttggacggattatggcaaacacttatagcatgaataaaatattaaattacctctatttttaatatatgataccattgactttttaataattttttgactatttgttttattaaaaattttctgcaaacataaaagacctttaatataaattaagtcacaacaaaattaatggcaatcacatatctttttttcacataccttttttaaataaaataatttgtcagacatattttaaaagttaatgacgttatatattaaaaaacggaggtagtatattataaactaaaaatagcttagaacaagttatttaagcaatgctagcattttttttgcggaaattgtacttagtatggcaaaaataatttaacataatccgtcaaacatattctaaagaccgtaccttcgtggtccccaaagaaacataaatcttttacttttctgcgatacaagtaaagcatgttttatatttgagtaaaatatatggccggtccttaaacttgttgtgtggtgtcacttaggtctgtaaacttaaaaatttcacgtttaggttcgtgaacttggtttaatgtaccc

SEQ ID NO: 8578 - DNA, 245 bp, Oryza sativa
gcatataactagcatatacatgatttaaacttgttaaaacctcaaataatcgtgcgtaattaacatatgccatacatcaattgatttaatcaatacatccaaaatagtttacattgtgtacacaataattacggcaatacatcggcgctgacggttgaccgcacgtactttctcctcactattgttccctccttgtgatcgctacgtgagtaaggggtgtcttcagttgatagaaggatgctagg

SEQ ID NO: 8579 - DNA, 404 bp, Oryza sativa
gtttgttttttgcatcaacaccaccttctcccaagtccccttcccctctcccctcctcttctagggttagggcttctcacgtgcgcgctgctgctgcggcagcgacaacgcacggtggtggcaggtgtggcgaggacgctgctgcatcacaccccctcgccatggctccgttgaagctccgccgctgcggcaaggagaagtaggaggacacggacgtggtgaccgcttcgagtgttctttcttccactggtttctttatttgtcttctttctcccctttgatctgttacctagatttccagatttcctcctcccttagttcttggaggtccttaaatatgattgtttgattctcattatggcatacatttactattatttgtactgcaactttggcttttctga

SEQ ID NO: 8580 - DNA, 2336 bp, Oryza sativa
ggggcgtgcgtgcccttcgctattcgccggctggctcccgccgacgtcgaccgtacgttggcgtctggtatcgaggtaccacagtacgagatcggtacgaaataaaacgggatcgcctttactgtttcaccaggtgaccgaaaattgagaggtcacctagcccaggtcgttgtatctcacaagtccaaaatggctaagataagtaatagtgtgttcagcctctgaacgggggaaggcaccaactaagtcggcgacctccgaactctagcaggtttcacggattaggttttcatggttagaactttgtaggagggatagggtgactattatagggatggtgggcggcgagatgtcaaagcagtggacaagatcggtggcgagggcaagagaagcctcgtgggcggaaaacggcatctacgtaggcaaatctatcggcgtgttcgaccgaatacgggggaggagatgcgacatggaggagtcactggacttggagacaacagatctaggaaggaggagttgggaggtgtcgagaagggcgtgtgactagctagcgccacctctacattagtatcggcgagatggaggtctgaatcctagtgggttggggtgggatgagacagagtaaatgaagataatagatagtgctaggcttataaaagactgcactaatttaaaagcaatcgtgaaattcttgaccgttaaaaggttaataagaaaaataaaaccagttgaaaaaaaacagccacctaagatcgtatggaatgcattcaatcggagaaacttgcttagtttattatacacttatatagctgaactgtacttgcgtgacattcttggttagtgctttcaaaactaagcgttgagagacttgaattagtctcgctttcaattatcgatattaatatatttttaattatttaaataaataatctactccaaatttctaattttgagaggtcaaaagtataattgttgtagttaaaacaataataaaaaaaccccgatcatagttataggacggaatgagattattgtatacagaagagagaattttatttattttgctttcaaaatattcatattaggggcctatggccaggtcatacacctccacaagttaataaccacacccattttctaccgacaaatttctttaatcactataaaatcattcaatggaatgttggatgttgacatgacccaaaacatttcctccccctatcacccactagccgatctcttcataaaatagaaacaaaacaaaataataaaatcagggcaaaatctccttttgatagtgtgatatgcgctccactacaaaacatcccttgggtccacggctcaggcagagtaagagtagtggccgtgcagtgcagtgaagcccgcgccgcgccgtttcacgggtccacgacgccgcctggtggaaccggtccaccgttcacggccaccgccaccgcgggcgcagacgccgaggcgcgcgcggcctcgccggagaagaggaggaggatggcggagaaggcggtggggcacgggcccaggacgaggatccgcggcggcggcctcgccgccgcccccaccgcgccctccgccgccgcgaggttttgtctcgcctcccactcctcgatctgcatttttctactagcggggtttcgatttgaatttgattttggaagctttgttttgagatgcaggaggctgtctgcggtgtcgtacacggcggcgccgaatctgaccaagaaggtgggtttttcgttatttttttttattttttttgaaaaatctttgattcttttttggggcttttggaatcgcttctttgtctggtcagtgaaatggtgggttcttgtgttcaaagcgtgaatctttactttactttgttaccgatgagcagtagtacaatatgtgtgaaaaatctgatgccactgcacaaaatggatagtgtctactgttctaactgaaagtatgtatgcttgttggtgttgtctcaagtgattgatctctcctaaccatcttcgtgttcaggttcctgacccgaaggttgtgaagccagccaggaaaacgacgccggtcaagaagcggccgcaggtagatcaggcgcagaagcagagagaagagcttgccgctttgcaggagcagctgagtggcctgcaaaagaagttgcttgagaaagatgaggccctgaggtcggctgagcacttgattagccgaatcagcgcggcgaatgcagcggtcgatgaactgagagggcagcttactgagaaggaatcgcagattgaatccaccggatcagattgcatggtgcaaaggtgaattaagatctgattttataccattgg

SEQ ID NO: 8581 - DNA, 13652 bp, Oryza sativa
acgtgatcactgaatggcataagcttttgtctgcattacatatgaccatattatgcgtaatatctagaagtaaaattttcaaacattttctcacaccatacagttttcataaaagaatgtgatgtagcccaagtgcccaactgtctagtatcatctttaaaacagtctaatctgaaaataggttgttacgtgtacatcatcttttctaagcccattccagtttagttagtctgtccttttgtcatccatagtggattcatttgttggactgcactgaacaaatgaatttttgatatgctgatttgaggttctaactacactactgcatggcattcaatgtggatgctcctttggattcaacaaatacaggtgcaagcatggaattggtctctatttgtgtatttttacttgattagaaagatatgttcccaccactgtgtattagtgctgttcagaagattcttgtgtgtttgtccttgtctttaacttcaattggcagactataaaaaagaagaaaaaagaacattgctctttgcattttaatttatctttgttgtagtgctatatgggaatatcaagcctgattattctgaagtgcatattattcctgttcttgccgtaatataaattgctaagtatgcagtgtaacatcatgtggaaccaacattgtgtgcgtgtgttctcacttgataacattttttattataacagtgtttaacacttgctgattgaatgttgtttgctgtagattcaattggcagagaaacaagctgcactggagaagttagagtgggaggcaaaggtttcaagtacaaaagtcgaagagctccaagtagatgtggcgtctatggatgttgaaatctctgcgttaatgaagctatttagaaaaataacagaaaacgaccgagccccttactcgagggagagagccgatgattcatctttggaatgtgaaccggttcaacttgacgtaagctcattttttccttgttatagtttcctttcgctcttcaacccaaagtacgtcatgtagttttaccacctctttgatgagcgattgtttttcctcaatacaattggctaaacgtcctacttgatatgggcaggatatggttggtgacatcgacatggagaagatggagcaggaaatgtctgcatacgctacagctctcgctgccgcgaaagacaatcctactgacgagttcttgaaggcagtaacagaggcaagactaagactccaagccttcgtactctaatttggattgaagcactgacatgccctgtactacctgaaggagtagctctattttgatgggccatcatgtgttatgcgggtgtcataatgcatctaaactgacagctcttgcttcctggatctcacatttcaaaaagatccatgtttgcgttctgtcggtctgggtctgtctgatgatgccactgagcttgttattgttgtaactttgtaagctaagaaccgtatgacactatgaccgaacatctgaacatcttagtagatgtcacaccgtgtaccattttagtgaagggtgaacagaaggtgagttcagtttacctgaacgacctaaagattgacgttctctgtggtttgagctttggagccaactgaatttgatgcagcattttacccagaaaacgaagtcacgagctaacgtatgatatgtacacatttgcccaatcatgaaatgttaacgcgcacgcggatagctacagtatttcagaaccattcaaaccacaacaaatatatctatttggatctaagtatttcagaactagtcctttatcacatttaagcattgaaccttccggattccgattgaaggattttccatagggttttaaattggagtgcaggctttaaatcaaatgaacactggatttcaaggggggaaaaaatgcagtggaccgtaataagaaaactagaataaattatgaaatgagtaacgaccaacataaagagcgtatatacaggttggtgatctaagacatctaacagacctaacaagattttctgcttggttacatttctaagagttacaacatcaaaaacaacattctttcgttcagatacagaaaaggcactcatgattggcataatacaacaaaacatataaaaccaagcaaaatcagacactcccaagctaccttcagtgaaggactgagccacaggaatgttgactgtcgagtcctctgtccgccatcagcagaagggaaaagtgagtaaaagccaagtcacgagttacaacttacaactcacaacacagaccagaggatcgtcctaatacaaagtaatagtacagagttcttttatccccactagaaaagaaattaagcagaaagctacttaggggaatcacaatacatttgacagtttttctggcagtaagctacttgagcactatattatggttaatggtaggggtgggcaggcagcagctacatcttgaattagaggaaggcaggaagttgaagtcacagccgcagctacatcttgttattccaactgcttttattactgcaaacaagaaagcaaaagtcagtactcattagccgcagagaaacagaaggcaaagtaacaacaccagaaaaatagtaaatgagcgttgatagtatggaaaatctactggtatggcacaagtataacaataaggatctgggtaagcataacatacgaaacctggtgcattaaaacgaatgcaacacagtacagtatgataagcatctgaacagcatttcttttaggctgatagggaaaacttttgcaaagcgagtaccaattaaaatattaacaaaatcatgtgatacttcagcagcttggattaaatagcatacaacatatatgagatctagtccatgtgatgcaatgtacccaccacaggtttcatatttatgttatttaaccaacactaacttgtctccgataataatttcttgtgcttcatactaatttttcttaagcctttcagatatggagtttcaagtcaagttctacacacaagggattagtaccaaatagagagcatattgcaccctaaaaatgatgcattcctcgaaccagagtaaatttgtgctagctcatacatgtttgctatcaccaaataatatgaacaggaaaaaaactaaggagcattgatctctatgcaaatttgaaaattaaattttcatttgaacagtacaaaagagcgtaaatgataaaaaataaaacatgccaaccgtaacattgtacaaatctaaagtttatcccagtgcaaaatttacagctaatggagttaatcttgtttatagctaatggagtagcataaatacaaataaccaagaaagcaccaatgcactaatggagtagtagaaatacaaataaccaaaaaaagcaccaatgcacagtataattgtgcaagcattgagtagtcatatactaagaaacatatttaaatatgataactattaacatattcaaagcgcagcaatccagcttggatcagtacagctataacattgaaatttagttagtgaaattgattttggtactgatcagtgctaagtacaactgccaaaatgtagcatgctctgttaagttgaattgtggatgatttttttacatatatttgaagaaagaaacttcttttttcttataaaaagcacagttaagtccagtcatgtgtagatgaaggaactcttttatgcattcccatattatactttgcaatgatttgtctacaccttgcatactaaacttcaagcattggcattccctttcaacatacaaatgatatttgtttaggatttttaccccaagactgctgctcttttatacatgatttaatgtgctattcttttctggctttgttttcatgtgatactatctagtccatgttgtaaacttccacaggtacatgcttaatatttcattgtgcaaatactactgatagcaggggcttgtgggctaattggtatagcatcctctctataaccgaaaggatgatacaacaattccaggttccataaagatagataattttgcaaacttacattaagttcaaaggatacccgctgcaatattaatccagtttctgagaaatatagcccacttgttacaaagtcagttgcagagtagaggacaggaacctttacatttttgtttgagaatacatataatcagcaaatggattacaaaaaggtttgcttcctacagcgctatagttacatgttaagcatacaaaactaattacattctcggcttgagcaattcctttatgctacaaaagaataaatggaaaaaagaataactatacacaacaaaaactggtatacatgatgaggttacatgaatatgatgctatacactagtatccaacaagaaattatatacaggtatacaacgacaaaaaaaaagaatatttacataaaaaaggagaacagattaagaacttacatctcaattaatgctacaacagatccttggagacaagcaggtaaaatccaccgatgttataagcagtaaacagttgacagttgcaagctgattcgctaaccaaaaggcatgtgcaaaaaagatgccgccgcgaattgccgatacccctacactaaacatagcccatccagatacattactcaggcgacatccgccgccgctttgagtggtcaacctcccttgatctgctacgcctcccagatgatcttcccctatcccagtcttcattacgatccgactcacgcttcccgtgcctatgataatcgccatggcgatctctatcatcccggtaccgttccctctccctgtctcgatctctttccctttcccgttccctgtctcggtctctttccctttccctgtccctgtctctctccctctccctctcccgacctgcgtcccgttcatcacggtgcctcctctctggccagtctggtggaggaggcaaatctttctccctctcccgcctcctatcagatgcccctgaccattccctctctggtggcctcttcttaccatggctcccaccttcaccatattggtgatctgatgctgcatcgtcgccatagcttgattgctcttccccaccccaaccacccatgctcgggtctggccacatcccgaccccaccagcacccataccaccttcttttccaaagaacgctgggtttacatgaggtgcaacaacaggtgggaatggctgcattaagcctgggaatggagcagccccaggtcctccagggaagccaccaaacccaccacccatcctccccattgctgcaccatagccagttggatcaaaaccctgccctaacatgcctccaggatgaagcataggtggtggtggagctaccatccctccgttccccattaatccacgtccaccaaccggacccatccgattcctcatattcccagcttggcctctaccccccatacccccgccaccccttccccaatttccaccgccgcctccacctccgccaccacccggtccacctcctccgcctccacgaccaccaccataattcccacccacctgagctccacccggacctccagctgcaccaccacctctaccacccttctgcacacccgagttttgctgagccatcgattgttggttcttcacctgagcttcacccatgcggcgcacggtgtgaggcgaggcgaaggccacgacacaggggcgtccattgaacaagtggccgttcatgccctctttgcaagaggcagcagcgccagggtcatagaaatcaacctggcagtatcccttggacttgccgctcgccttctcgtcgaagaatctcacctccttgacctgcccgtacttgcttagctctgcctctagatcggcgtccgtggtccaccagtggagctcccctacgaagagggtcgtaccaccggggccatcaccacccccgccgttgccgaccacaatcgggcccccaccgtagtttcccccaccctggcggtggaagccgtcgcctcctcccggctggatctggttatgcggaggcggcggaggcgcggcggccaccggtggctgcggctgcggcgggaggtggaccgggttgggccggtcgggaacgggggcgggggggacagccgcgacgcccgggatgtgcaccttctccggctgccgctgcggaggcggcggcgggagcgaagggggcgcctgcagctgctgctgctgctgttgctgctgcggcggcggcggtggcgcctgcaacggaggcggctgctgcgaaatcggcggcggctgctgctgctgctgcggcgggggcgggggctggggcggcgggtgagacgactggaggaagccgtccccgacgttgacgtcgttgtagaggtcgtcgtagtcgtcgtcgtcgccatagtactggtcgacgtcctggacggcggagatggcctcgttgcggtggaacgagccgtcgccgtcgggatccatggcggcgggcggcggagccaaaccctaggaggggagggctggatctagaagagaggggagagagcgcgagggagaggaggaggtgggaaagggggcaaaacgcaaaacgagctcaactaatccggtgtgattgggttcggatttctggaggcgtctcgggttcagagctaacgagcgggtggtgcggtgcgtatgacgggtgggccccacgcgcgagatggttcgtcgtcgaggggggaaggacgtggcggggctcgagtgcacgggtgggatttgacctgacgtcatatcgtgtggatcccgttccgaccggcgcaacgccccccgcctgttgttgtagacttgtagggccttgtttggtggggcttcgattacagcccatcgaaagcccaaacagaatgtgccagaattgaggccctttgacatgtttagattgtgcccaacacagtttgactaatggtagtttagatcgaaagtccaaaaaacttttttttcgaaaatagtaaaagtacacaattggtcttaaatcatgtcacctatattagggcacccacaatgattatctataagctatctacaagagatccatgtcagcatattttcctacttggaagatattaaatgaagagagagagcaaagctatctactagattagagatagtctatagagaaaaacgaggcaatgcatgagagaactatagatacctatgtagacatactattgaggtggtttactattaatctagtctattgctgagatgtatatgttttatagagagcaccctactttaccattgcgggtgctcttagaattaaacgggccagacctaaattaatcatcttaaaatttaagagcacacattaacattagagattaatactatatgaaaaaccaacggaaaaaatttcaacttaaatatgctacaaattgaatgcaccgtttgaccggttaaactggtggatggaatgccacatgcgcatgcgccgagccgacccgggtggaggcgaggaatggcgtacgagcgagcgacggagacttctccgtcgggtgatcttcggactgttattgtttttgtagaacgaaactgacggccatgctcatatgtggtgctttagatattcctgatccttgtgatctgcccgtacggatctcctggatgagtaggcatccaaaactctatccaccttagtaactatacgggtaagcgggcgattaattttttttatagcgtgttcttcgcatgattgctctcttcttcgtcttcctgtacatcagcattgccttttttttgggtggagtttgtgatcacgtcgaccgtcaacactaggaacgtgaacattggcattgggaacggcaacatcggtatcaggaacaccaacttcgctactggatcttggagtgttctctaactatgtcttttatttcaatgttaatcatgttactgaatgattttattatctttgttagcatgttcatgtttagcactggttttgaatcactcacatttacaaatgttatgcttgttatactttttttactagattaagttatgttgaatgatgactaagagcatcccagcagttcatccaaatctcatcctctatatacccatatggatggccatccaaaaaaagattcctcattcatatcccttcctactccaacagatcatctataccacatcatccatattacattctctatttttttagtaatatctttcaactaaacttacatttctatcttttattaagggatatattttcaacaactaaatttcaacggtattatatatcgcggtgttatttatcgcgataaaaatttcgaaatgagtaaattttaacagagataattttacctggtaattttttaattgatatatttgaattgagtgaatagtagcaagaaaaatcataggaacaaaaataaaatgatacgggacactgtaaaatcgttatttgttcaaacgttccaaaatcaatatgtcaacgatagcagccgcctgtccagtactacccttctttgctctccttttctcttctctcctcttctcttctctactgctcagcggacaaccggagacggcagcgggcgggcgagggttttgggcggcgaggtgcgggcggcagccgcacggccgcgggcgcgggcagcggggtcgcgggcggaggagcggcgggcggcagccacattgctgcggggcgcgggtggcggtgtcgcgacgaaggaacggcagccggcagtgggcgggcctccgcctctactccgagcctccgccaccaaatccagtaagtatctcctctctacttccattcctctagccgacgatgaaggggaggtcgtgatggagcaaggttgatccggaactccggatgggggcgggagcgctagcgttgaggtatggcgtgaggagagagaatcgtcatatttgacatatttcttctcgatttggcgcatcctctattttttgaggcattgataccgtatctgctggagcgccgttttctcctcttatgcactatatttcggatggagtaccggatgaaagatctgctggggatgctctaaggctgtgttcttttgagagagttcccaactcaccaccctcatttttcgcgcgcacacttttcaaactactaaacaatatatttttttgcaaaaagtttatatacgaaagttgctttaaaaaatcatattaatttatttttttaaaaaaatagcaaatacttaattaatcatgcgctaatgagtcgctccgttttacgtgcacaggaggtaagttcccaacctcagcataggaacacacccaaaatttataacaatctaggtgcacaactagcccttatttagggacctaaataacacaatcgcacaggttctaagaccgttgtgcagtttttctttttcatatatacacagagtacaaactataatttgcactatgtccgtattaatgaaaatctattatctaaaaataataatttgcactatattacaaaattttacggccaaaattcaatattagaatgcatatcaaagttccctcaaaaaaaaaatcgttccctcaaaaaaaaagagaatgcatatcaaataaaaccatgcgtttatcgatggagcataccaagacatacgttgtactcgtgccaattaacgtgtgcatcttgtatcacacatttctcaatacacaaccacggtctggaagtcatacacaatgaggtctaagtcaaatcgagtcaacgaggcacaacggtctggagtacctttcaaaaaaagaagggggcacgtggccaaacgacgccatccaagccgcccgttctcgaccgaggccaagatcgaacggccagggcgctgcctcccgagctaagcatgcgcgccaccccttcttcttccccgccgcgaccccgcatgccgcgcgccaccacccgcgacgccccccgaccatgccgacgaacacgcgccgcgcgccaaagatagccatcgcctccgccgcctcccgtataactgcgccttcgtctccggccggccatctcccctcgacccaacccccatcacggccgcgcgacgagaacaacaaccaccgctcgtcggagtccgtccatcgatcggcacggctagcgcgcccggccggccacgcctcatcggaagcttctccctcttcttccagttgcaggatcgaacacaccgatcaagtgcggcgagtacgtagcctctccgcgtgatggcacgcgctcccgcgctcgccggcgtcgtcctcctcctcgccgtcctcctcgcgatggcgtgcgccgtgcacgcggcgtcgtcccagcccccttccccggccgcctctcccgagtcgtccgaggccgagtcaccggagtctgaagagtccgagtgggctgcggagggcccggggatgctgtctgaagcctccgaggagcttggcttgggggccgggccgctcaagacgatgggcatggacatggacatgctcgacgacgacgacgacggtgctgctccgtccaagagcccggctgccacggcacctgcaggcgcagccgccgcgccggcggaggagggagacgaagaggaagacgcgagcaccgcgtcgccggcgtctgcgcccggcgcgagcgaggaggcggagggggaggaggaggccccggcgggcgcccccgacgccgaggcggaggaggcggcgagcggcccatccgaagcgtcctccgaggagccatctgccgccgccgccgccgccccggaagaatccggcggcggcgaggaagccgagccggcctcgggggaggccccaaccgccgaggccgccaccgccgccgacgtctccccggccgcggtcaccgtctccgagggccccgcggaaggtcccggcccctcggccgccgacgaggaggaggacgagagcggcgcgagcgccacgacgcagcgtggcagcctcgccgccaccgccgtgctcctcgtcggcgccgccgtctttgccctgtaagatcgacgtggccggctggcgaatcgacggtggagcttggagtgtatccatgtcgcaacgaaaaacgctgcactactacgacgcactcgttgttccattggtcaagtgtacaaaactacaaattgtacgatgagttggcccgatgcatctgttaggccttctgtgtctccatgacatgcatagctgtgtttaggtttacctttttaacttggagtaatttttatcaaactacatatattttaattaaacaatcgagaaatatagacttaagacggtgtatcatagcttccagagcctgcgtccctgtcatcctcgcgcgggcgaccggggcgaaccctagcctccggtcgccaccactcttccctcctctcccccgcctcgccaccgccgaagcgcgtcggcggaaaccgcgcggcccgccgggatggcgtcggcgaggctcctaccctcggcggcgcggctgtctctgcgcgaaggggcggcgcggaacgccaggaaggccgcgcggtggcgaggcgttgtggcaacgaatctagcgccgccaccgccggatctagcaccctcgcggctggatccgccgacgccgccgccggatctgggccgtggagacacgggcgcggcgtcggaggcgagacgtaggtgacggcgacggcggcgaggcgcggcgtggcagccgcggaggcacgacatcggcagcgaaggcatgggcgccggcgacagcggacggccgtggaagccgtggaggcacggcgtcggtagcaaaggcgcggggtgccggcgacagcgggcggccgtggcagccgtggaggcacagcgtcggcagcgaaggcgcgggcgctggcgtcagcggcggagacacgggcgaccgtggccgacggcgtggtggctgtggctagctggcagggccagcgccggtggtaactatggccgtggcctgaggtggcagcggcggtggctggcggtgcggaggcagaggctgttgcaacggtggcgtcagcggctggtcggcgacagtaggtggctggacgacggcagcagcggctactatggcgaccgtggctatggagagaggaggcacggtggcgactgtggttgagatgggagaaggcatggcggcctcggacgtctagccgagggcatggcagacggttgcatctggccggcgaggcagcgtttggaggaggggtcagagaccggcttggcgcagagaggcgcagccgatggagggaggccagattggcacgagaggcgcgtacagtgaaggaggccgacttggcgcgagaggcgcggccagcgatagaggaggtgaccccggtgcgaggaggagctgccgatggatgtgcgcggtcttcggcgcacgaaggctagccggcggggggcgccggtgcagtggtcccacatgtcggcaaatgttgagcggtggtggagcatcggtacgtcagtcgcggattcgcaggtggtgagcagcgggtgaaaacctagcccggccttggccggaccgacatcgatggttaattccccctcctgaggacgttgtcgtgctgtctcattcttcaagggtggttgttgggtgaaagccctgtcttggctcctttaagctccgacggacggcggcggcggttttccgtcgcttctcttcttgaagatgttgttttggcatcacctagccgaagcctctcgaacgattggtgcaagcacgctctaggagttggctttgtgttggttgtgagggcgttcttttgggcgatctcgtctgtattcctttattggtttagcggcggtcggtcacgcttagcggcgactagtccggtgttagctttctcctggaatttgtgtgttggtgatgtcggtgtgtgggtgtggtatattttttcctttttcctggttacgaccatccagagttgtaatcttgtaattttttcctgctctatcaatagaacctcgcaccgtctcgtgcgagtcgttcaaaaaaaagacggtgtatcataggctactgtttagcaacaaattcataaaaccataattttaataaaaaggtattatcacaaaactacatatttcatagtttaaatccattaattgcagtgtagctatggtggagttttcaacgttgtagttttctatttaaattatcaccaaatgtgcagctttataatagttttattgttggatatatagttatgtgatacttcataccaaatttgtagttttgttatatatcattgtaaatgtgtcgttttttctaaggagtaaatgtgtagttttgatatatctttagtcaagttatttatgctttcatgaaatttacttttatcgcgaggaatttggacttgcgtacgtaaggaaggggggtttgggcctcagcggtggtggaggtagtgggccgacttgtaggcatccaaaactgtttggaataagttcaccggagatccctcaacttaacaacgagattttttttgacgtcccttaaccacaaaaccagaaatctccacctctaaactatacaaaaccgttcactcaaggtccctacacactatatatgggtggtttcactgacgtggcatcctagtcagaaaaaaaagtatgtggggaccacatgtcagctgcacattcattcccttctcttctctcttctcttcttagtcagtgagggaggtcgacggtcagtgggcggagtggcaatgggagggtggcacgcgagcatggctatgggtggcagcgggcccatgtggcatc

SEQ ID NO: 8582 - DNA, 9078 bp, Oryza sativa
ggctgggcccaaggtggagcacccggcgcgttcgaacatatccgccgccgagcttgccattagggtagactgccaccactcctctcccaccgccgtcgtcgcgtcgatcgcctctctttccctctcccgccgccgccgtccccggtccgtcgctggccacctctcgccccctctgtcgccgcgcctgcttgagagaacccggagagaagagaagaggaaaagaaagaaaagagagaaatatgggacctataccattgtctcacttacatgtgggccccacatattaattttaattatttttgctgactatgatgccatgtcaacgaaaccacccatatatactgtctagggactttgagtgaactgttttgtatagtttaggggtggagatttctggtttcgtggttaagggatcttagaatatctcgcggttaagggatctccggtgaacttattccaaactgtttcgggctttgggccccgaaacagagcacaaggcccaaggcccagatgtttgctccttgtacaacctgctacacgttccattgtcgcgtccattttggcttcgtccaaaatccaagcagacaccatcatgtgaactgtctgttccaagtcagctacagtactactccaagtactaaccgcggtaaacaaacatcgttcgctgcaaacctgcggttttgtacttttgtttactgccaaattgctcaaactccctcggtgagtgtctcagatctcgagtgatttttccctgcccgcgcagtggcctatgctttgcatttcggtttcttccaccagttcaccgaacatgttctacagacacctgaacagcaaaatcggcaggtgctgagccctgatctgcccgtccttcacgtcaacatgccaccgtcgggcgtcagagatgcagatgccacgccggctacacacgctccggcgtgtgagggcaatagcattgtgacagaatttacctagcctcatatatacttcctctttttcacaatggaaatcattctagcatttcccacatgcatattgatatcaataaatctgtctagaatcattaacatcaatatgaatgggaaaaatactagaatgacttacattacgaaacggagagagtatcacctaaaccaaaaacattactagctatatactccacagtggcttatagtgggtcacatctcccactatatctcctctctttgtttcgcctcggcaaaggaaacaaagtggcgatactcgagcagcgccacgacggcgtcgagtggcgcgacccaagcaacgtcaagcagagtgattgaggtcgtagtcacgagtggcgcggcccaagtggtgccgaatgaaacggttgaggtcatggtcgtgagcggcagcagcttggtccaagcaatggcaacaagcggagcggcagcgcacggcccaagcagcgccgagcgaagcagcgacggatcaacctcgagctctcttcccgaaggggcgtgggacacaagattgtgggcccaaatctacaattttgataaagaacgtgcagcttattttggctccttattcttgttgaggcaacgaaaaatattaacatggagagaaatctctgggttaaccggttagggttatatgatatgtatgtgagtacactgctaacatacttcctccgtcccacaaaaagccaatttagaaagggattggatacatgttttttatacaacaaattagacaagaaaacatctaatcccatcctaggttagtttttctgtgggatggagggagggtggtatacgtcgcactcaccatcgtccgtcggtggcctttgtcgcgtcggccgcgtgttacagacttacaggctcgtttttaaccggagcgcgacactggtaggctaccggtgcagcacagcagcggcagctgcactctggcgccgtgcacgtggaatcccggcctcccgactcgcggcaacccaccgcgcgcggcggcgtgttggcgggggggcatctcgaagcttcgggcccatgcatctccccaatctgccgctcaccacgtggttaaaaagcttccggccggtgggtgcacagccgtcggatgcgggatcgggcggtgggggagacgcgcgaggttgcgtacaaacctccggattacaccgaggttagcagcagcatcagattcggggggacaatttttttttttttgctttaaagtctcgtcgcttcgtcagcctcgccgcgcgatggacggcgccgtcggcgagcccccgtccatggctgacgctacgtactactactactaacctacggagtagatttttgcggagccatcgtttcgcttatctacgaaataaacgaaacgatatatttacaaacgaaaaataatttgtgaataaaatttttatatacgtattcttagcaattactcccgctgtcaggtggatgtgaaatatcttattactacgaatctaaacgaagagtatgaacaaattcgtatagtagtaggatgtgacacatccaatcaaaatcacttatattataggatagatggagtaaaagaaaaggctgaaaaataaactttgataaaaaaatctcaaaatctgcttcaaatttaaagttaaaaatttaaattttgacagataaatataaatataagtgaaaagatgatgcccttgaattttcgatggactggctttttggacagcattttggtgcacgacatcggctgcaatttcatgggctccaaccgaaattcggcggcagttgagacctgtgtcctcggcggttgatgacagttgagaaagttctcaccatcgcactgactcagatatggactagatctagggccagatatgaccttttctctggagtatcaagcttttgaccctcgaaatacgatgcctcggtattcgtcatatcagcttctctcttcttcgcacaacgctagtactccacgttgcccacataaaagtactctactctattactagttgcttggatgcttagctacactctgtaaaaacttctctttagagagcaaatcattagagcagattcaatagtagactataagccaactataaatatattttaaaaaaaataaagaaagtttgagaagagcaatgggctacagatatgtagccagctgcagcgcggacttcaagacataatgtgtgtatgacagatgggactaggtattaatagaatagtaagtaactattatatgaattggctagagatgatttggagctagtagttagctatactattaaacttgctcttagcgaagacggagtactcctactagacatgcttttttttttacaactgcaaactagacatgctctgcaatccgtataagagcaagcttaatagtatcgctaactaccagcttcaaaccatttatagtcaattttatagccaattcatactatagatacctataaacatatactacacaattatacttagtcccacatatcatatacacatgtatctaggagtccgtactgcagctggctataaatctatagcccgctgtttttcactcttctcttttatctcctctctgtacctgctctaaccacttcatgatgcatccggaattccggatggaattcagttgccgtgctaattttgtctcgcttactgctgggcccgccgcccgctgttcttgcccctgcacactccaccggtcatgattcttctcgattgcaactcgcatgctcgaaaaggacatcgactagttcttttttaaaattttctttcttcgttttcaattccaggcagctcgagttagagtgaagacatgagcaagctctgcatgaagacatttcactgcgcgcgacaacttgctgaagtgctgatgaaaacagcctttcctacgtacgctagaaaccactgatagtaaatgaggacatcatcacatcaaacacaagatccaaataaagaggatgaaaagagatgaggaagatgagggcataaaaaggttattcggtggagtgcaagagcaagcggtgagcttggaggaacaagcattgccattggtgatattatattggagccgtggacatatgaatatattcgtctgagtttaaatcatgatgcttataaatattatgtaaaaatacgttttcagtagtataaatatatttagttaacctatgaatttatttttatctttaagtttcttttaaagtatacataaagtatacataagtatataaatatatgtacacgtgatgtccatgtgtaatgatatatgtgcacatatgcgtacgaaaactatgatcatattcggagccccatcggttggtcaaataaactaaagcaaaagctaaaatttaaatttcaaatttaattttaaggtattttcaaagtaatttatttttagcattggcttttaaatcactataaacaaatatataaaaattttacctattaataactttttattttttaataaactgttttggcttattaggaagtctcaggaactgaaaagaaaatatcaaaatggcaaagggttgcaattacctgtgaacccccggggcatcacgctgtgcgcacccaaccaagttaagtgagcgccaatctctatactgcgcccactccccctcactcccacgcggcacgcaccccgctgcaccctgcaccacgctccactccacccccacccccaccccaccccacgccgcgccgcgccatgcgccgcctccgcctcgccgccgccgccgccgcgccacacggcgtcctcctcctcctcctcatcctcctgccgctcgtggccgcggccgggccggcggcggccaaggcgcccgcggccccgccggctccgcccaacgtgacgacggcgatggcgaagggcgggtgcaaggccttcgccgacctgatcgcggcgtcgcccgacgcgtcctccacgtaccagtccgccgccggcggcggcatcaccgtgttctgccccaccgacgacgccgtcagggcgttcctgcccaggtacaagaacctcaccgccgacggcaaggccgagctgctcctgttccacgccgtgcccgtgtactactcccgcggcagcctcaagtccaacaatggcgtcatgaacaccctcgccaccgacggcgccgccaagaactacaacttcacggtgcagaacgagggcgacgccgtcaccatcaagaccgccgcctccggggacgccgcgcgggtcaagtccacggtggtggacgccgaccccgtcgccatcttcaccgtcgacgcggtgatcgagccggtggagctgttcaagccggcgccgtcgccgacgcccgcgccgtcgcccgctccggcggcggacgctcccaaggccagtaagcccgcgcaccacccggcgcccgtcgtggcggacgctcccggccccgccgccaccgactcgcctccggcggaccagaagaaggaggccaagaagagcgcggcggccggcgcgccgccgtgcgtccggtggttcgccgcggcgttggccgccgtcgccatggcctccacattggcctagggcaattgttcttttttttttgtgttcttggttgatgatccattggcgtgatcgtggtgtgatggcgtgttgatgtgcttgcgagatttgtgcttactttcgtggaagaactagtggagtgcttaaatattttgttagtgctttcctagattttcgtttttttgtttgtgcctgctgttgctacttgttaattgttaattagcattagtagatcatgagatgttgatatcttatcagcattttggttttgacttgatgagtgcagttaagttgctgagattttgctacatgaaccgtgcattttaaaatttaaacccattttgcagcttttccattatttttttgacagagagatttgtcacttaaattgttggaatgtttttctgtacatctcctcgagcaaatctcagatatgaaacttatcatggtgcccgttttactgacaaattggcaaggatcttttcgttgcatcaagtgcaacttctgcagctcatttcttgttatttcagttgtcggtggagccataaggccatttgcttcagaggtcaaaacaacccaacccacacatcaaaagcaacagtaaaaaattccttaaaaagcacacagtaaaaataaagaaaggtggaagtaactgttactagaaggagaggaggagatcgagacagagatatttgacgtgatcgagccggagagatttaaggtgagcttgaaagaggggttgagattgtgccttgacacagaaaacaaacgagacattagcacataattatttatatgcattagctatcgcaaaattaaaattttgatttacataagacttatatatataaaaggtttttaaatgtaaaaaaacgtaatgttgagcagttttgaaagcgtgttaaacgttctttttttttctttagaactcagccataattttagttgcattgtgtcttttttaccgagaaaacaggacacgagaccgattccgattcgggccaatttccccctaggaggggatgaaaacgagcctttattggtagcaccgacagggctgtggatccattcggacactgccgccactcgcagctgagcgacctcgcagtgttgccatcctagcccagcatcttttggcacgagaaagcgcttcggaactgtgcccgtttccgacaagacagtgggcagcaaatcttgtttcagtcattcctcttctttggtggtcagtgatgccgcttctctgatcacttggttgttggttgtttcagtcacggcctctctaaagcttcacaatccggtcacgaacggtatcatctaatttcgtggaatccgttgataaaccgataaagactgataaaatttgaataatttttgctgaaaaaataaattttagtttggttgttttttaactttacgtgaaaaatcgagtggtttttatttttggcctagtccggaaaatccgcattttgctaaattcgaatcgaattctactagaagttgtgtactctgtcactctcttctttcactccttgcacttctttttaaaaagaaaaaagtacgaattaaccccttttatcgcggtcgtccgaaatacccccctgaaccacaaaaacggatatttttcacccacaactatgcaaaccggacaaattacccccctcgactcagtccacaatggttttggtttacgtgtcgtacgcgtggtagtccagtcagcattctatttatataaaaaaatgggacccacctgtcatatcctcttccacttcctctctctcctctctctctctctcactcttcccccctctctctctcatgcgcatgcacgctcggcggctcgtcgatcccacggaggaactcgaggagcggcggtcaccgtcgccgtcgctggtaccgcgcgccgacgccatctcccctcgggccccgcccgcatcgcgtgccctcgtccgtcgcccgtcgtcgttgtcgccttgagccccacctgcgcgccgtcatccgtcgccatcatcctgcgcccgtgtgctgccgctgtcgcgtctcggagaaggcgagcgcggcggcggaggaggcgaggggacgacagaagagcgtggcggcggaggaggagagagggcgacggaagagtgcggcggcagaggagagtcctccacccagccagccgccgccgtagccgcctctgcccgtccagccgcgcccgccgtcgcagccgcttggctagccagtcgcctccgcccgcccagccgcgcccgccgtcgccgctgctcgcccagccagccaccgtcgtagccgcgcccaccaccgccgctgcgtgctttagcgaggggaggggatgaatatgtgaggagagagagaggaggggtgcacaggtgggccccaccgaatttttttaaaggagtgctgacttgcctgccacgtgtatgccacgtagatcaaaaaccactccagagattgagtagagggggttatttgtccggttttagtagttgagggtgcaaaatatttgtttttcgagttcagagggtaatttatacgaccgcgatagttcagggggcaattcgtacatttccattttaaaaatatattttagagtattttttttcataataaacttcttttccaacccaatccgctaataacacatataaaaaattgattcatcaattattttctattgcttcttttatatttctacggtttatcagtcatagctcaatcaatcaaagctgagctgaaaaaaaaactgggaggtttcaaactgattttgaagaaataagttcagaagtttttaacttgcaaaaaaagaaggaaaatgcttgcggtcggacgtccgacgcaccaaacaaaatcggacgtgatctgctcacgacctacatactactctctccatcctaaaatgtttgaagatgttgacttttttaaaaatatttgaccgttcgtcttattcaaaaaatttaaataattattaattcttttcctatcatttgatttattgttaaatatacttttatgtatacatatagttttgcacatttcacaaaagtttttgaataatacgaacggttaaacatgtttaaaaaaagtcaacggcgtcaaacatttagagaaggagggagtatatgtctagctgttgtcttattttttttctctcagcctactgcatggttgcacatttctctctctctctcttacttttctccttagtacttcactctaatatataagtgtgtatgtatgtagaaaaaaaaaagctatgcatgcattagtagattcaaactagttttctcctaaaaatatttattaaatctacaatccgattacactattatatctgttgcaattaaatctttacaataagatcttagttgattatatttttgataaaaaaataaataaaaagaataaaacactattaaatcctaattgaaacatttttattctatatatgaaacatcgagttataagtgttgcaacactgcacctatttattgaaacactagaaaaaacactggtgcaatatttacattgaactagtgaaacattagaaaatacttattgaaacatctaaataatatcacgtgcaatatttataaagatcta

SEQ ID NO: 8583 - DNA, 1641 bp, Oryza sativa
ccttattagctaaaagatgactgatactattctgacttcggtggacccttaaccaacttatctccctactaacatgtatgaggtccttgatttccttaactagaaaagcttgatccgacatcgctttctcagtagactttagaagctgtattgcttctaggcagtcagactcaacaatgatcggcctgagggaccaatgcagggccaatagtaatccttctctgtaggcaagaagctctgattctaaggcactgatgcagctcgccaggggtttacaggctgaagcaattacctctcctgtactgtccctgaggaccatgctgattcctcccttatcttgactagcatcaaaggacccatcaatattcagtttcacccagcccaaaggaggtctcacccacctgtgcttgacattgttctacatctgggaactcctgatggcgcccgtcgctacataatccacaacatgttttcctttcattaaatttgcttggggtttgttgtttgatctcaagcagagaacacatatagctttccaagaatcttctggaagactcagttgtcggtgcaggtttcccatgcgtaatatcattgcgaacaaaccagttgcgccacaataccatgagaaacatagcccgctcgggttcgagaagatgctccaatctatcaaagatccaacctgatacaaacgggccatcatccataatacaggatatattctgggactccttcatgaccatccaaagagacttggcatgtggacatcgatacaatgcatgggcaatgtcttcttcctcagtaccgcaaattgcacaaacatctgtggcctccaatttccttctcttcttgttcaccatggtagcaaggcaatctaatgccaccttccaagcgaaaatttttaccttctgaggcacattacatttccaaagcatgttccatgctttactacggtcgactgcagatgaggctgaacaagcattctcagaagcaagcgaaactgccaggctataagcacttcggactgaaaacctccctaatctgtctgggtgccaagccacaaagtcgcttacatcctgagagggaacacgaattttcagtataacttcagcatcaatgggccagaatatctgtcgaacccgatcgacatcccattcgcctgcatctgttaggaggtcagctacccatttggttctgcagttactcttcttggtgatcggtcgtcttgagtgatcacgcggaatccatggatcacgccatatacggactgagcgaccgttcccaattctccatattatccccttcttcagcaattccaaaccaaactcaattgctctctagcccggcgaagcattcccgccaaaacttgtgtcaatgagatttccatttaggaaatatttcgctttcagaactattgcacaaagactgtcaggagaatcaattagcctccaggcctgcctggctaacagagcttggttgaacaatctaaaatccctgaaacccaagccaccacaattcttgggtttagtcagcgtatcccaagccttccagtgtgttttccgcacccccttttcaccaccccaccaaaaacctcttgtgattcttgtaagttcatcacacacagattctgggagtttaaaaatt

SEQ ID NO: 8584 - DNA, 17509 bp, Oryza sativa
ggcatatgtgaataggagaaagcaccccctgctggaccttttcatctaagagcaaagatagtccgtcggccaggaacaggaataggaagggagataagggatctccttgacaaagtccccgagatggagcaaatgaatgaagaagggttccattgaatttaaccgagtatctcaccgtggttatacactccataatccatctaacccaccggtgagcgaaacccaacttatacattgcctgctccaagaagccccaatccaccctgtcatacgctttcgatagatcaagtttgtatgcacttgctgctttgtttggattcttgttcttctggatatagtggaagcactcaaaggctagaagagcattatctgtgatcattctaccaggtacaaatgcactttggttaacagatattaattcatccaagaggggtctcaatctgttcactaggcacttcgaaaccactttatagatcacattgcacaggctgatcggtcttaagtcttttagttcagtgggttgatcaatctttggaatgagcacgattgcagtgtcattaacccccgctggcataattcctgacctaaaaaattccttcactgccctcacaatgtcactcttcaagccaccccagttcctctgatagaaacgagccgggaagccgtcggggcccggcgccttaattgggccaatctgaaacatagcaatggccacttcctcctctgtaaaatcctcgcacagtttatcattcatcttagctgaaaccttagtttggaagagcctagtaatcttggactggtccaagcttggggtcagcagtgtacaacttctgaaagtaatcagttgccattctcttcatttctgttgtcgaactgtgaacagttccctctgagtcccgcagcttcaaaattttgttctttttggctctccacaccgctcgggagtgaaagaacttggtgttgcgatccccttctttcagccagctaactcgtgaacgctgcagccagagcatctcctccctatacaacaaatcattcatgttgtcagtcacttgtcgaactgttgccccatcagcgtttgcctcaaggaggttggacaaccttttccgcgctctctccagttcacggccaacgattttgcatttggttctgctctaggagtgaagtgctatcattactttactgagagccttgttaatctcccccagatcctcctttgtcccatattcactccaggcctcacctatcacttcagatattgctgcttccctctcccaaaagatctcatactgcaagcacttcttcctcccttgggtccgagaatcacccgacaattgcaacacaattggacaatgatcagagcaaggggacactaagtgagatagttgggcattactaaacacatctctccaattgttccacccctctcttttgttatcataagtatgaggcagtcctctaaaacccaggtcatgcaattcacagctatgtaaagcatctcggaaagctctcatctgagactcatttctaggtctcttggagaaatgctcgtattgccacagcacctcattgaaatctcccataaccaaccatggaagatcagaggattgccttatatcttccaaaagggaccacatacgatgtctattctcaacacaaggctccccatacacaaaagtaacatgccacaaaggaccatccacagtcattctcacatacgcatcaatatgtctttcattcatatttaaaacttccacataaacagtctcgtgccagaaaagagcaagaccaccgcacattccttcattactgaccccagcaaaacctttcaaacccaatctattacgcaaatgcctaattctttccactttttgtctagtctcacataaaaacactaaatgggaaccaacctccttaaccaaggtacaaagatcacgaactgtcgtggcgttcccaataccccgacagttccatacaagcaactcatttctcctgacgggatccaatcacagatcccgtcagtttaccagcagcccccgagctggttgcttccctgtcttccacctttatgctctcccctttctcctttttaaacctcttcaacgctcgtggagtgctgctaggagctagctgaagctgtttactctcctccgctgccttgccatactccaagagtgcttgcttgactctgccagaatgcttgccatctccctgctctgttgttcttcttttgtgttgactattagtttcatccattgagccctctccaaaggaagcttgctggtgcaggttcttcatcgccggaatcatctcctccgaaggtagctgatcaacaactatatcagtgataacctcccgagacaactcaccgtactgttctggacctgtctgtgccgaaacctacaaattacgggccttctctgcaagcagttgatctatcttcccatctcctgctttctccttggactcaaatccatcatgtgcatccaccctcggtgggatcgcctcatcccattgctcacccttcttctgtctggacgatgtagagcttgcactaccagcactcctgaaggacagcttgtgtgccacacctgaagactgcactggttgtattttactgatcttcctctcaaacggtttcaaaggggagcaacgcaggtctgcagagaattggaagggttgtccacctgtgagtagtttcttttcgcagtccttgtctgagtgaccgataaacccacagatgaagcagaagtggggcaccctctcataccgtaagtcaaaatgtctgacaacctcactaccttgctccttgatcttaatggcaagctttttccggagggggcgcttaacagggagatccacacggatgcggaaaaaatcatgtttattacggccgtcattctccacatccacctcccgaacgtgaccaagcttactaccatagagatttcctctttccctcgtcatcaacaccaagggcagatcatagattctaacccagatgggtaccacctcaaaaggtacctgcgacgggcttataatcccatcaaattgggccaccaataaggcgtcccccctatgcagccatggacccccttgaactacaaactgatagtcaccctcagatgtaaaggtaacgatgaacagattatctctgagcgacttataactcataccagatttcagcctccatgctctgcgcatatcatcaaaaagagctgtggggattggtgtgcgcattgagtaataccttgataggattgtccattgacccgcaagcttgacttgttcatcttcaagattcacctcaattgcatcttcttcttcctcatagacttctccctccgtgaaggttcctggaccttcagtgtagaaaccttcagcatcaccctccagggtaccatgggaatccctatcccgactgccttctccaacctcctgagatgcaagtaccaacgccgaggccattggtttccccttcgccgatggatcccccggcggctgttgagaactttcgatcacaacttatgttgttggcttcggacgggtaatcatcttatcgaggatccttttatcacccccaccgccaacagacgccatgattgtacttttacagcctttccaagcaaaccctaggaaccgaatatggggagatatcttcttggaagacaggaggattgaccgccccccggacgaccctcctcctgttttatatgatagaacctccgagtccggatctttgacgaacttccaccatgggtaccaaccaaaaccatatcttctttgtattccatatccaattactgcaggtttgttgcagatatcccataatcgaacccaccctatagatgtatccttatctgttctggacaggaatttcagcgtttggagattgaatgctgatccgatcaccaggaacaaagttgatttctccgtagaaaagcagaaacaagaacaatccgaaagcacgagcgaaagcccggccaaacttaccatcagatcggagtagaactccatccaaatccatcgctctccacgaacaatggccgccgccgtccgatcactcgggcgtcgccaaaaccctaacatccgggaaatcaggatatatcaactaatgaatagttttttgttcgtgatatcttgttatatagatttaattacaacgaatgcaacagtgcaatcagattgtaaattggataaatggttttcgagaaaaaatagtttgaagcttgtcactatccatgtacctctctcatttggtacataaacttttcttgttgtcgctcttctctacatgcgtatgtaatagtttttttaatcagatggacataaaggggtggatgtggatccaccagtagaacagacgtccgacgaaaacaatcgcatcgtacgtccgatccgtagtcgtctaaaaaaaaaagaggaaatctcacctggacgttgtgtacttgtgtcggagaaatgcttcagcgcctcaccgttgacagcgccggggcggaagaccaattctagccgcacgatcagccacgtggcggagatctaacggccacacctcatcagcaccagaaaaaatagctttagcttagcgacgagcgcgcgccaccgcccgagcacgagaggccggccgtttcccgccctaaaaaaagcccgcgaacccccacaatatataccgctcccgccaccgccaccctctccctcgtcgcatcgcaccatcaatcaatcgatcgatcgatcgcgtcgccatcggcaacgccaccgcacgcaagcagcaagcagctgatctctcgctcgatcgatcgatctcgggaaacttggatttatacccatggcgcctcgcgcagcgctcttcctcgccgcgctcctcttcgtcgccatggtggtagtgccggtggcgagggcggcggaggagtcatccgccgagtccccctcctccgagtcctcctccgagtcgtcgtcgtcgtcctccgccgacgcgccggcggaggggcccgacgggccggcggcggcgcccggccccggcgaggggatcgacggcctctccgacgacaacgacgacgactcctccaactgagcccggccggccggccggcctcgtcgacctcgcgtcgtgaacaatccgttaatttgattgatgatctggagcgattaataaggatatatatatatggtcgtcgtcctgcgatttgattacaacttgttctctcctcgttttttttttcggatgaaattttctcattctctagattaattagtttgtaatcgcagcctatcgtatttgtgttctttggacttcatttctcctgtaacagtttttaattgttgtctactaatttgagatatggacagttttatatttgttctagcatatttcaaagcacaagtatcaaatagcttgccgctgtattgggccgatataatgctccagcagaagctcgcataattcggcctgctcgtctggtctctgcttgaaagcccaatatggcacaagagcccataggtcggattacaggatttaaatttaaaattcgtttggaaaataacacgcgtgcctgcagcctgctgctaggatggtcgcgcaaaaaacaaaaactatctgtctttcgatttgtatgagctacctatattgttacattggatcgtgtagttgaaatacgattatgcgcaatccaaatccactcgaaattgatttttaggcgatccaaattcatacgagtacattcggtctgttattcggatccgcgccatcaacttcaacttacaatgaacggatttaggttaccattaggaggcctttctcggaaaaaaaacacacctaagtgtcaggcggtggcatgacctatgcaagatttcgtagatttgcgatgagtttttttttccttcaaaatagccatcacgcataagcctctccaaggagccaaaaacaactgtgaaaatggagaaaaacgcaatcgaagaaggtgttactggctctggtatatcatgtttcaatcaactgtttacaaccctggtcatctacaattcttctcgcaaacgaactccgtgatggattggacattttctactatagtgcgcgtcatcgcacacatcatattggctaactcttccgtttcaacatacaaatagttctatagattttaaaaatacattaagatttagtataaagagtatgtgactgtcaatattgtattcgtttatggcatcccgtctccctagttacgcccctattgtcatgggagtcagatctggtgtcgtagtatagagtttgtgccgtgaacaggaggtagaggaagaggccacgagactatttttgtccaccaccctcgtcgataacacgtgctcaggttggatccagtggcaagaaggatatcaattgctaccgacaattattagttgataatattaaagtatcggatctgatacctaacaggtattatatcatttggaacatagacgttgtgcaatagcaaccctctaaggtgtttaacatgtgaagtggagagaatagtttcttgtgcattatgacaacaaaagatgataccataccggagcttgctaaatccttctctacgctgcgcagtggctctcactcgcgacgaatgtttccaaaaggccagcttcaattcttactatttactccgatctatttcacaatgtaatactttctagcattatctacatcatatatatattaataaatctaaacacatacatatgtttagattcattaacatctaaataaatataggcaacactagaaagtcttacattgtgaaacggaggaagtatcatgcagagagttaagtcgtcgttgatggaccgatctttagttggcatagtgattaattatgtttgtcacgtgtcgaatgtcgcaactcattttactagctcggtcttgtgagttgtgcgcattctagtaatggtatctatcgtaatgttatcccagagtgtgttcggagacactgtgtaatgatttatcataatcaataaagcacaacttcctctaaaaaaaattaaaagttttatgattaatgatcgtgtcctcgttcgtagcccttgacattctgcacgtgcacagccacatcaaaaatcatgatacatcatacctgccatccacgcatctaatgctggcatatgcctgccatccacagttaattaagttagggttccaaattttttcttcaaaattttaacttttccatcacatcaaaacttttctatacataaacttcagacttttccatcatatcgtttcaatttcaatcaaacttctaattttagcgtgaactaaacacaccctatatgctcatgaatgaaacttttggtttccctattattttttttaactttttgttcagccatactccattaaaaaaaatcaacgtaggtaatgatttaacaccacctaatttattttgaacaagctcatatatccaattcattagacggttgtatcatatcttcacctaaattagtactccctccatatattttaatattttaatgtatgacgtcgttgactttttaaccaacgtttgaccatcgttttattaaaaaaaaattgtgtaaatatgaaaatttttatgtcatacttaaaaaacatttcatgatgaatcaagtcataataaaatatattataattatataaattttttaaataagacgaatagttaaacgttggaaaaaaaatcaatggcgttatacattaaaatatgaaatatagaggtactacctcagtcccaaaataagtgcaccataaatatccgtgtttagcgctttgaccatccatcttatttgaaaaatttatgaaaaatatttaaaaaattagtcacacataaagtattattcatgttttatcatctaataataataaaaatactaatcataatcttttttcaaataagacgaacggtcaaacgttgaacatgaacagtgctaaaactgcacttattttgggacggagggagtagtatttttttagagaggagtaagcattaccacggatccaccgggtgaccactcattcagacaaaccaagttaatccgtccttcccgcttcgcacgcgcgctcgaccacccgcgcgcaccggcgaaacatacggcgcggctgctgcacgcgcttcgcctccgccctcctcctcctcccattccggcgatctcctcgccgcccagatatacaccaccaccaccctccggcccgatcgaaactggcattgcgatttgcgaatctatcgacgccaccgatcgacctacgcctgcaaattaaattccgcagctagctagcaacaacaactcccgaccggccgcggccacgacgcgcgcacggacggacggacgacgacatgcctcgcgcactgatcgccctcgcgtcggctgtcctgctgctggtggccgcggtggcgccgccgctcgccgccgcggacgacggcggcgccggagtcccgggggaagggaagctggagagcgcggggtccgcgattaagtcggcggccgccaacgcgttcggggtcggctccgacatcggcggcgtcccggtcaacccgtcgccgggtggcgccaacgcttaatatatttacagtattacagtggctgtttccttgtgactttaatttgtcagagtttttggaggccatttcattccatatatacctaattaattactacctaaatactagtatatgtaattaatcacgcttgcttgtgtgtgtctgatcaatgttgccacttcttgtctggttcagttgtctatcatatatacttccaccgttttttaatatatgacgttgttgactttttctcacatgtttgatcattcgttttattcaaaaattttatgcaaatgtataagatataaatcacacttaaagtactatgagtgataaaacatctcataacaaaataaataataattacgtaaattttttgaataagacgaatagtcaaacatgtgagaaaaaatcaacagcgtcatctattaaaaaacggaggtagtatcaaataaactggatttgtatatgaaaacacgttcattttatatgggtcctctataagtaaacatgatagtaatatgatagcatatcagaaacatatattttttttaagttacggggatgtcccctcatcacttttcaaatacaatctaaatggctatgtaaagtatctcaaaacatttaataacgttgctacaacatacatataccactccacaattttaaatctaaactcaaactcaaatcatgaagagaaaaagaaaaagacatatccacgaatgaacatttatactattcacgcctagatttttccttttctctctcaacatgtagattgatctcaaacttagatttggtggaggaagatatcactatagacttatacttttttaattttcttttttaaaaatactccctctatcctaaaatattactcctgactgtttcattgaatttgagagcaaaaaaataagtccctctctttcaaaatactcccctttgtttgaaaataattattgtttcagagaaggacacaatctctaaaaatataactttggtcactaatttccgttataaatatcaacaagaatatgtttttattgaagtacttttaaaaattaacctttacctatggcctccatatttatatggcaaatattttggaaattgttttagtaaaagttttaaagttggctgttagctagtcttgtccaaaacgtggattattatcaacttgagtgagtataagcatttctgtctatgtatacaaggtcccaaactataagaactactgaagatgtatatggacacatagaattggtgtaatatatcaaaatacatagccataaatgtatattttcagacaatgaagaattcataaccactttcattgaagttgagaggaaaaaaatacatctattctataatataagtatttctagacatgtatttggacaaggcctaaaatataatataaggaatgcttatatatattataacaagagaaatacacgacatccggttggagggattcgaatccatttcccgctcgagacggagatggattctaattgctcggatgaatgtctaccaatttattgtatatcaactaaatgattatgaattttttttagaaaaaaataacaaggtagattgatatataacatatcccttcatagacatacgatttgaaattcaaattatataaattgtagctaaaatattaactttaaccatgaatatacatatactatttactggttatagtttgatttctttttttttctataactcacagaaaccgaatttgaacttgcattttttttcatttgtgaaacaagatattacatacgaatttatcttatcagtttttcttaaaattcttttataactgtttagttgtcatgtaaaatttcttttcgcaaatgcgttgaaataaaataaatgggtggatgttaatgtaagtgatcaaagatgtttacagcccgagaccactcatgcaatctggctccggcacatgcatgcaattgccacgccatgctccgtgaccatcgggtcaccactcaccacttcaccagacacctcgcctcgtcctcgccctcgtcatccgcacatcgctctaccattctcgctggcttatatatacacagactccatccacgacgacgacacacatactccaccaacgcacacacatcgaccgcgcccgccgcctgcagccgcgcgcgccgtcgccgccacacgaccggagagcacacatgtctcgccagcaggcggcgccgccgctcgccctcgcctccgcgctcctgctgctgctggccgccgccgccgcggtggcgccgctcggcgccgcggcggacggcggcctcgtccagggcggcggcgaggtcgcgaggtcggccgcgaacaccctggccgtcggcgccgaccccgaccctgcctccgccgacggcatcccggccgaccgggcgccggacgcccacggttaattaattaattaatcatcgctgattcgatcgtctttaatttgttggttttacttttatttcttttttttctgtgtgtgtgattgccagtgtggtgaagctactacaggctatatgatccaagagatgtagtacttaagcttgtgattgatcactacttcctccgttttaggtttcacggtgtaagattttctaacattgcttatattcatatagatgttaatgaatctaatcatacatgtgtatagattcattaacatctatataaatatgtataatgctataaagtcttacatagtgaatcggatgaagtattaattattatgtatgttatagtgggcatgtgccatgaaataaactgatggaagtgctctgtaattcttagttcgatggattttgttcgtgtttatgatgttttggtccttttggatggtgaatgtatatatagtggatacaatcgaaacaagcatgcgtgtatgagtgcctctgtttagcaaagtgtgttcagacaatatttttgttgaaccatacccatatgtaattaattttaaccattggattaatattcatcagaaaatatttttaaggtaaaccacgagaaataatctcgagaacaaagaggtcctacttaatattaggaagaaaaaaatgacttaattttcttaaaaaagacccgaaaagcatataactgcaattaattaaaagaatccagcaaaacctatacggagagcgaaaaatagaacaaattaatgttgccaagctagtcgcaaaacagacaagcaatacatactcctctaggaaagcataaaaatataaatatatgcaagtgaacacatttgaaaatacatggaaaaaaggtcaacaaaaattagtgattgatttttcatactggcgtcgagtgataggtcttttcgaaaatgcttaatctcgagcgttcgacgtgggatgaaatatcagacgcatcattgagtgggtcccagcaccgaaccaatctcccaccttttcctcccaatcctcgaacttatccccattcccttctctcgcatctcactctcttcgtctctacctctcgctctcttcgtcttcgatgccttcccgactcccgagatacgatagtaggaggccggcttcccaacctctaccaccaccaccggcctcgtcaaccggttcggtctctacatcctcgacgtgtggttggccttgcagctggtgcccacgaagaagcaaggcgtcatcccgaagacgcagtggcgacgacgctagacatggccgccggggatacctgatgttgatgcggttagtcctagacgaggtcgcccacttcatgccgctagtcgtccgaggagcagcaaccggagttgacaaagaagacggaggtaggtttaactttgtgttgcactttgtgtattaaggtgtttcattttgttttgattcgatgttgcatatattgattcttgatgttgcaatcgatatgttctaattgcatttggttgaaaccacctctgttgaagcgatgaaacatttttccctgattgatgaaacatctgaaacatttttcatcgagaagtgcaacatgtaaagcattttgcaacaatacggtgcaacaccgtttgatgttttgcaaaatatctaaaacatttttctctgccagtgaaacatttggaacatttttattgaaatattttttatcaagagatgaaacatgtgaaacatccctcaacaactcggtgcaacaccgtctgacgatttccacaagatcggacatccgatccgtagcagcctccatgtctttttcgaggagagagtaacgtattgcttcagagagaaatgtgcacgccatgtgaggacctaatgccagcttccatccacccaagcctccatgaatcccatacacagaaggagcgaattctataacagcggcattatccacgagctttactacttaaatggccttccactgatacaacactggccttttctccttttaatatgtgaacaaaatcttttaagtatcatatcatattctctcattgatcccttgctagatgctttacgtatgacacatcctgaaaatatatatgctttgcacatacgacgacattcttatgtgtaaagtgatggtgtacaggaatataatacactgataattaagcatggtgctggtgcagagcagactgtctagttagctctactgttaatttctcagcgatctgtatatatagttggattgctgctctcaccttgtgtttggctgattggctcatctctgagtcattttgtgatttactattagattgctatactttacaatacccaagatgagatctgaagtaaattacacgtttgagctcgccaaggttgcaagtgcatgggctggcataggattatgaatggatggtgcagatttcttctaatgcaatttactgtagcatctctgcattttgtactccaatgcagaggatcccaatgcgggctgcatgcgcatggaagaatgaagtatgaactatgaagaataattcttgtaggctaagaccagtgatccttgaggttgatgatggcggtttatgacaggaagcaactgtgcattgagccatcgatcgatcagacgatcacaatgacaggaagcaacctgcaagacttgatctgtacacgaaaacggcagcgggcaagaacacaggaaataggatttaccgcatgcatttgtctttaatcgacgagttcttgtatatcagagatgaaatggcaatatatcgaagtcttgaaccctctttaccccctacatttcaatcatgcagcgttgcagatcttcatgtttgtgtcctccactcgaccactcgtcctacgtagtgttctgaagaatttctgcagaccaccccttcatttccgcttctctgcaacttcaggtgccatttcttctgaaaatgttggcccatttgaattttaggaataaaaaaaaaccataggaataggaaaaacagaggaatctgacaggaatgaaatgcaaaacagagtattgcataacacaggaataaccgtttgattggatcataggagaaacatagaaatcaggtgagagagatagactcgaaggaaattttccaagatgttaaagctcttgctaaatttcctccaaaatctctataggattgtccattccataggattttcaaattttttttgaacgactcgcacgagacggtgcgaagttctattgatagagcatggaaaaattacaagattacaaccctggagggtcgtaaccaggaaaaaggaaaaaaaaaccaccacccactcaccgacatcgccaacacacaaacctaggagaaggctagcaccggaccggccgccgctaagcgtgaccgaccgccacttagaccaacaaaaggacatagacgagatcgccccctaggggatgccaaaacgacgtcttcaagaagagaagcgacggaaaaccgccaccgccgtccgtcggggctcaaaagagctaagactgggctttcgcccggcaatcacccttgaggggtgagacagcacgacaacgccctcaggagggggaatgaaccatcgttgtcggtccgaccaaggcctgactgggttttcaccgctgctcaccacctgcgaatccacggctaacgcactgatgctccacctccacacaagctctgccgacatgtgggacccctgcaccggcgacccttgccggccagcctttgtgcgccaaagaccgcgccacacccaccggcagctcctccacacacctaggtcacctcctccactgccggccgcgcctctcgcgccaagccggcctcctccaccggacgcgcctctcgcgccaatccggcctccctccatcggccgcacctctcgcgccaagccggcctccatctccgccgcccacgcctctcgcgccgagccggcctccgctgccatcggctgcgcctctctgcgccaagccggtctccgacccctccaccaaacgatgccgcgccggccagatgcagtcgtctcccacgccctcggctagccgtttgaggccgtcatgcctccggtgacggtcaccaccaccgcagccgctgctgccgaacgcccagccacctcgcagtcgccatcctcacctcgcacctgactccttccccgctgccgacgtcaccactgcctccatagtcatggtcgccgtcgccgctgccaccgacggcagccaccgcctccacagaccgccactgtgccgtcgccatccgccaccaagcagccagcaaccgccccgacgacgccgccgccggcctccacgccgtcgcaccatcgccaccagccgctgcctccgttgcccgctcgccccgacgctggccgcgcatctaaggatgcacccaccgccgtctgtcatcgtccagccggatccggccgtcacggagtcggacctcgtccacctctgctccaccgggcaccaccgtcgccgccgccaccagcaggccccgccgccggtcacctccccgccagatccaggcgtggatctggcggcacttccaccgccaccatctctaccaaccgccgctgctccctctcccatgcgccactccctctgccccgccggcgacgcctcctccgcccaacgccgcgagccgccatggcctccgcccgctgcaggaaacggcgccgccgacctccgccctcgggtccgcccgcgtcggaaaccggaggagcgagagctgcgagccccgctgccgccgtcctggcgagacgctggctttgccggcacctcgctcgagcggcggcgaggcaagaggcgagggtggtgggttgcggcggcggcttgggctgtcgccgcccgtgccgccctcacggggaggcgacgcggggaaaaaaagttagttataggattttcaaatgatagaatagtatctgaaactcacatgtttgttttactaattgtatgatataacctgactacaaatttccaagaagtcccagtttctcaaccataaatagttttatcaggttatgctagtgaaccctgatatctaacaatgcaatgttgtaccgcgtggtatgcacacatagttcaccttatgttattgaaattgattgttcttggctagaggtaaacttcaacctggatagataaatcttatgcatttgtgtctcagtaatggattcttgatagattacattagccttgaaaccctgctcggtaagtcttttcaaatgatagaatagtatttgatactttatttcaaagacatttgtaggattaaaatcctccaaaatttatatgttttttctccaaatcaaaggggttaactctacccggcatgcagtgaccctgtgtgtgattcctgaattcttctacagtgacatctgaaatttattaccagtgttgtcccagataacaagaagcaggtactattccaggtctcaccggagagacgacacgatgaagaacaactccagtgttgtgccttcttgcccgagatacgtcggtgcacacgactgctagctccatccatctccatcgagatgtgttgaatttgctagtaggaaaaagtccacttgaggttactcatagtgtggttgggtttcaaaacttgtctttaaaccgaaataccatataaaacatctctggtcttgggtcatattaggttgtaagcattattgctcctggttttttttatattgggtacgacccaatatgattcgattttgcaagattagggatgcattatatatgggtattccgggttaacgaacgaattttgaaactcgacgaaacgatgaggacctcaaaagtaaaccttttccttcctgaaaccagtggtagacattcaaatatgggccggacaattgtctcgcgtagaaaaaccggagccgttcgcggggcaccgagatgggccgcctatcacggagaggagacggtccatctcgggcgagtcgagcttatctcactgacaggtgggtcccacgggacagccgaacctccagcctctgccgtccgatcacttccccgcatcggcctcgtccccccctcctccccacacatcctccgcaacgcagcggattcgccacagatctctcgccccacgtcgccgccctcctctttccaaattcaaaaattcccgatcccctcctttcctccgccatctctctcaaactcaaagcatcggcctcccccttggccgcctcctcgaatgcccaaaccctagcccgatccagccgccgaccgacccacctcgagggagcgccatggaggagctgttcatgcaggtgttcgaacggcgggactgggtggcggcgcagttgcggcagcaggtggagtcctacgaccagtccctggcttgcgcgctcttggcgccggccgcccccccccgccgtggctcctcccgtcgcgccccgttgcgccgcagggtgagttgcttgctgctgctgctgcccccttttcctctcgctcggttccattttccgtggggtttgggtttgcgattgaagctaggcttgggcaagttgatgggattttttggtagatttaaggtggcgcaggcttaattt

SEQ ID NO: 8585 - DNA, 21323 bp, Oryza sativa
catgagaaaattaatctgctccagtcagaaggaagaagtgctgcttgtggccagaagaggtcagatgcagatggagttcaagtaaacggtggcccatcatctaagagaagaagaataaagcgtcaatcaaatgctgctctctccagctctcctaacacaaattcattgtctgtggtccaccaagttgatattgacaatcatgtgttaccccttggaaatttctcagggaagtctcagccttcaggccgttacttcttaagggatttagggtcctctgggagcatgtctctcaagtcagaggagaggaatgctgtgagtcacggcaacatatcagtatctagtatccataataaaaccagcagttctcctgaaagatataataaggctagtttagataatgaaaatgggaattctccaggacagttacaaaatacattagatgttgtgaaaacaaccgctgctttgcctagctgctatggtaccttaattgataatgagaaatcatgcgcagaagaggtacgtgttcatcaagtgctctgtttcctttctgttctgaaatcttacaaattttagttcacctgaagagctcaatcatactcttctattgagataatatgcagctaagtactgaactagtgatgctcagactggccgtaggatctgttatacttttactttctaataaatcttgaatatacagccatgtagcctgtccattttgttgttttggagtaagtgatatgggtacaattagatcataactaaattttgcatacagcagggcaatggtaatgtagttttgcatgtaatattgcactcattttcataaaaaataatttattagcatttttagccagtatgttaggcgatgctcacttttttggttgtgaatcagaatttaatgcactgaaaaatcgtctttgttggcaggaaaatccttgcttagaaggtaaacacgcaaatgatacttgttcgagtgtggtacaccagcaaatgactcttcagattgataacattgcatctcagagtgtaatattaaattcagaaaattattctagagagaactcaattactatatctgcaagttatgtttcggatcaaaatggtgatcaagcacatgcaccaagtgcattggttcgtgagaatttaagttatggctccagtgtagaacttgacaggagatgtaaaagtaatggttcaaagggaagtttgttgtctggtgctgctattactatgcaagatggggatgaatctgttgactgtgatgccacaatgccggaattcgagcgatttgatgttcctatccaatttgacagcccatgtgctgagacaaagacatctgaagccctttgtgagtccagaaaattagtcaccctcagttcaaagttctcaaattatgacactaacacagaaagtggtgtgagccacctattgtcagccatgtctgggaagcctataaacttccctgatgatttgcaacaatacagagcaaataatgatagaagcataactgacatttttggagcatgtggattgggacttgatgattccttttctatttatgatgtcacagcttcatgttcttcaaatggtagcagtgcaaaagagaacaatgacaatccattgaccccatcagttgaaaaatatggcctggggaaactgtcagctagatctggatctagttcagaacatatgggctctattcctgaactagaatgcttccgaattgatgaacatagcagcatcgcagaagaaaatgaataccaagggatgttacatggatctgctggtttgagttactcgcatcagttgccatctggcagaaaagcacttcaggatatcactggattatgtcaaaacactgtaaattctgcctctctttcctcaatattcttggatacaggtaatgagctcaatcatcagacagatctcataaatggtcatgccaacgataagccaaaaaacagtcttgctgcttcaaccaagagagagagaaaaatatctgattcccttcatcctagattaaggaggacagaactacataacagaaatggaagacaccagagtgaagccaatattgacaaacaatctaagcctagcaatattgttgccaatgtgacatcatttatacctcttgtaaaaccaaagttgcaacctacaacagcatgtggtaagtgctagtacttttaatatcattgtttatttaaaaaaatgttagtccatttggctagtgatgctttgagcttaaaaagaatttgaatggtgctcatatatagctttcataaattggacttctgtcttgtagtgaaaaaagatgtcagagtgaaggcacttgaggcagctgaagctgcaaaacgccttgaagaaaagaaacaaaatgaacgtgaaatgcgcaaagcagctgcaaaactagagcgtgaaagactgaagcaagagaaagaattaaagcaaaaacaggaggaacaaaagaagaagagagatgccgatgtggctgctaaaaaacggcaaagaggagaggaggaaaggaaggaaaagcagagaaaaagaaaatgcactgaggaggctcggaaacaacagaagcagcctacagaaaaaagtcttgctgtgaatgatgagaaagatgtttgtcgaaaaacatctgtgagtagaagcaaaatattttatttctatcagtgtttcctagaacatgtttttgttactgaatacattaattattgcaggataatatagagctgacaaaacctgatgggagaactaccgaacctgctatgaccaatattccaaacagtcttgaagaggtacgctttgtttatttaacttcgttgtgaaagaggggcatagatagaaatctgtatttattggtactggtcaattattgtgtatattactgtgtaactgatgtcgtaattcataagccttagaatgtgggcaaaatgtttagatacacacaccaatagttttatttgcagatggagcaaaacaactaaatgttgccaagttgacccgtttgctcttcatagcttttgttctagagtcaacaatagttctaacagtgtattacttcctgtgttgtttctgaaaacttctttcagtcataccaaatgtctccctataaggattctgatgaagaggatgatgatgattttgaacatgagcaagaatccagacgtaggaggaaatttattccttcgtgggctcggtatgtatccatctaatcaaatcccctgttcaaaattgcagcctttatttgagaaaaagttgtgtgtttgatgtgatgcactgatgcctaatgtgaaagctcatcacttgtgggaaacaaatgtagcttccgtattatgtcaaagattacatgatagtcttttgagcacgatgtgaagtgactatggaagcttctttacataaatgttaaacatattttctattttaacactgattagcatattgttgctatggaagcttctttacataaatgttgaacatattttctattttaacaacttgcatacttctttttgctgcttgttgcttctgtgttcataatgaagtactggtcctctagcttttctatttacaaagttgtctgatttgcaggaaagaaaacttggataaactcttgttgtccaatcagagtttagaccctagagaactttttgcacaaaagtgctccttcaacttatctgatggtaacctccagctcatctctgtcataaatttatttcggttattactgctgctgaatttgtcttctcttgcctgttctctccagttctttcagttcacataccacaacgtggcttcagataagtttccatttgacggactatcggcaatacgtcattgccaaattacatcatcaacagttgtgcatatgcttggacggcattttcttgtatgctagaaattaatcaacgtagcagaaaatttgtttcttgtggaatattagaatttagcaggacatgtgttgccacatttgtatacatatttgggcataaccaatttgtaccagccgagttatgtttatgaaaacctttctgggcagtacagtaattaccgagattatggatataaaccagacggcaaagtgaccacgacaatacatttggaaacgaaaactacgtgattttggcacacaatctcttcaaagtgacgaaatcaactcgtgttggaagtgaaatgattgaatgagagtatgggactgtgtaaccaacagttttctgttctttcgagagatacaaccagaaaatcaaaaggtaaacgaaaagttttcaggaagaacttctgtatgtctcccagttttcaggaagaacttctgtatgtctcccagttttcaggaagaagaatagccgttaactatggtcgtcgtagcttgccgcttgctccggcgctatacctgttcgccaccgcctcatccggccgggaccgtgtccgaccctcgccggcgatcgccgtgcttgtcccggtgtccggcggtgtacactcgagttcgtagcgcacaaaaagtatcacaacaaatatgaaacattaattatatgagatttgttccggtccaacaaaatatacctcgagataccgatacttcgaggtactttttgctgaactgtagcaaatctccgtactgagatgcacgatacttcgtcgatggccatggcggagagacgacggccggggtggcgagatggacggcaatgacagatagatcagagagcacacggccctggcagaagcgaccgccgtcgtcgctgctgccgggttgtgctctctctcttctgtcatcactctcaagtctcaactgcccccctcccccatgacatcctcctccatggctcaatcgtttgaatcctccctaaacaaaaacacgaaaagaaaaaagaaacaaaagaaagaaagagcatgatcagtcagactgaacagactagactcacgatgcattcctacaattctacccatgcatcatgcattgttcacaagtgaaaaaaaaggagatgcagctcaattaactttttcccactggatcacagctcctgctcgtcggatggcacggcgagacgaatagacgatagttgttgccagccaccagtgtgcgatcgagtttgtcatgtgtgtgccgcaacagtgtaagctctcgctctcgtgatggggggtgttgctactttaactccaggtttccccggaacgcggcgtgaacgtggccgcggccaggggcgcgccgcgcgcggcagtggctatatctatatgcgtgggcgcgacggcgacgccatggcgatcgagcgcgcgcgcgcggggcatggcgctggcacgcgacggggaccaggcatgccccgcgcgcgcgcgcggcgattaatttcggcgtgggcgcgcgcgtggttggcccttggccggcctggcccctgcgctgcgcaggcacagcgcaaactgtagcggctcgtgcgcggcgcaggcaggctgctcgcggcctcgcgtcgagagcggctttgggtcacggccatggcgctgcgcgaggcgctgagatgggcgatccggcagacagcgttgcgtgtcccagctgtgcgcgtgggtctccgcagagcccgtcgtggtaactggtaagtggcgttagggatgaaaacggagctgtttgttttttgtctgctccggtgaaaaatgaatacggataccgtatgtttgtgtgtcggtcatatttaatccttttttatattttgacataattcgtactcctctctgtttcaggttataagagtcaaaatcaaactgctttaagttttagaaaaaaacagtaatattttcaacccaagaaaaatttattatgaaatagattcaattattgatttgatgaaactagtttagtattataaatattattatatttgtctataaatttagtcaaacttaaaacaatttgactttaatcaaaatcaaaacgtcttataacctaaaatggagggagtatttattttttatctgagctattcgtgttcgtttctatgtctagcaaaatttacgaaaataaatatggtatgaatatcaactgttagtatccgctccattttcatccctaagcggcatagcgctagtgtagcgtgccacttgcagcggcatatgtgagtgtgtcatgtaattctcacttgtgggtgataggaccatctgtgcgagaaaaactgtgaattgcgatcgaagcaaattttaatggaattgtaacaacaaaaaatgtaacgtagatgaagttgacctctgtagtaagagtccagcaattcgtatcgatgtaaaaatttgttgttgtggtattagtcactgacgtgaccgtccgatgagctgacgtcattcggacggcggccgccaccggccacggtggcggtcacctcccggagcatcagccggaggcatctcctgtacccgccgacggccatctcgacgagctcgacggacctcgccttctccacctccgactcccgcagcgtctgctccatccgcgccacctcgccggctctcctccaggcctcgccgtcgcgcacgccggtgaagcccacgccgccgtcgcgtggcctgaccatgtctccggcggcggcgtcggcggcggcggatttcttgatcaccatcacgtcggtcaccgcgccgctgatccggaacgaggcatcgaggagcaacccgcttggtatgtcccagacgctgacctcgccgtcctccgtgcacgtgacgaggttcttgctcccgttcgccatgccgacgccgacgagggcggcgttggtgttgccgcttgcgtgccatgacgagctcgtgatggcggcggggcttagggacgcgacgtggacgcggccgtcggagccgccggcgaagaggcgggcggcgaggtggtccagggtcagcgagaacgcggtgcatgggagcgtgagggtgcgcaggtggctaccgtccttgagcgtccagaccttgcacgtgccgtccatggaggccgtggccacgacggcgtcgcacccgccgcgcccgcacgcgacgcaggtcaccggcgcggcgtgcgccggcacgcggtagagcgagaggtcggcggagacgctggcgtcgtcggcgtcggcgtcgacgtcgaggacggagaggagcacgaacacggctacctcgccgtcgtagccgccggagacgaggagcgagccgtcgtcgctgagctcgaggcacgacacgggggcgctgccgccgtgggcgcggaaggagcgcgcgacgtcgcccgacgggagcgcgatggcgtggacgcgccctgacaggccgccggcgaggaggtgggagtgggagccgccgcgcggcgccgcgacgagcggcgcgaccggctcggggaccggcagcgaccgcgcgggcgcccgcgaccaccagtggaggaggagcacggagccggcgcccgtgacggggcagacgtgggacgcggcgacgaagggcgccgcggcgcccggggcagcgacgacggcgaggccgtgccgcgacgtgttcaccggcgccgggaactcggccacgacgtggcccgacaccgcgtcgtaggccgtgaccggccggccatggcaggccgcgaggatgagctcgccgtcgccggccagctgctgggaggaggaggaggaggaagaggacgccgccattagcacgcggcgaccccgccgtgctgcgtgtcgcgggttcgccggtgcaaactgaagaagggaaaaaaaaaggagtgtgaagtgacctgtttggctctgattatttgcgcttttataagtataaaaatagttttaacttgtagcctaaactagtagccgtttcattcagagcttttccaaaacggtaagctagcttaaaagcaagcgatataaaagtacaaaatcaaaaaaattgggcttaaaagcctaagcggataaagttatgccaaaaataagaactgtaatattagagcaagtttaatagtatagctaactactaactccaatttatctatagccaatttaatagcttattcatataatagttacatactacactatcaataactggtcccacctatcatacacacactgcatcttggagtccatactatagctggctacaaatctgtagcccactgctcttctctccccttatttatctttttaaaatatatttgcagctgacttatagcctgtatctgctcttaaaagtaggtctcagtaactgtaacatacctctatgttttttactccttgaatgataacaaggatcatgagaaaaagaaacttgcaatttgataatgttatacacttatagagtatgtgcttaacggtgtcttgttatactttgccgtttacaccgatgattatttgcgttcttaacattttagggcttgttcaattaatcccatataaaaatgattaagaggattgaacgtgattaattccacgcattgctctgattcctacaatttgcggcccatcccgtgaaaagctggatcagcttttcaaaatccggcccataaatttgatgggccctaaataaattcgtgtcctccacgaggagagtatatgggcctccacgaagataagcccggcccaattttatcgctacgatacttctctatcaccactcctcgtcttcctcctcgcctcatctccgctccgctccccactcgcgctcgagacgccatccccagccaaaaccccgagcgaacgatggagggaggagccctcgcactcccgcacttccgctcgcgcgtcggcatcggctcgcccatcctgctctccgccgaccccggcgccgcccgcaggagctccggcgcctccggtagtaccccgcatttccacgggattgctcattgtttggttaatcggggctgtcatttgtagcttgcctctcatgggggatttggttggttgttgtttttttttatgtggaagggaggagtagggtttcgagggttaatccaggagcgtatccgagaagtgcaggtaaattgaggggagttggaggttgctgcaggctgcagcttcgtcgtgctgtttgattggttaattatggctttgccgctgatttacctgatggataaactgtaaatttggtctattccatttgttctgcgaagggagaggtaggacttggaagcgtgacagcccggaggctccacctcgccgatcaggtaaaaatgctgcttggtactgagaatcactcgtgtagcaaagcatgtttggttgactgattaggcactaggacagtgttttcctatatgaaattgaaccgtgtcactggctgcatgacattcaactgccttatgtcacatgtggcaaactggcaattaatggaatgaagatatactcacctaaattcaaaactagttgcacagcggtaaacttcacatgtttgattatgtgtacagaagggctgatggcctgatgcattttgtaaagtcggcaattcttgcacctggaagtcacttttacaaacttttggaatagtatttgcatgtgttatacaaaagtcacacatatgcttattggagtaactaaggtggacttgctgcctctagactcattttctggtaaaagaacaaaaatagtaaaggaaacccatgcttggggaaagttaggtgaactagcaatcccttctgtcatgtattctcgactgacgccacctcagatacttcagttgtagatttgagtactgagcaaaaggttacacttacacagtgagatagttgccactttcatgaccttaaactttagaacattgtcatgtgtgtctggaagtgatgaattgtatctttctaatctcaatccaggaaccaggattgctacatcttacatactgaacgtactgtgctaaacttgtgtattgtttgtttgcttgtctacctgcaagcacttgtattcgtcgcatcctgaaagcattgttgtttgttgttggtgtctgctgacttatcgtgcaagtgatgtgagtctttactaatccaaacattctatctttttcaggaattactagagttccaaatcgtagtcctgagatgcctactgaaagagcaggtatctcatcactacttgaataacgagagctattcacttctttaacccaattcgttttttctcttagggaggactaaggtttcaaatgtaaatttggaggtatctcatcacagagcaggtaaaacattaatgatatggtactatgttagcaagaaaatttaatggttctttgttgtatctattattcattagtttactatctaattctttggccatgctttaatttttcatggttttatttgtctttatcatttgcattgtttgtgtcgttggagcagttgcagcagtgaggttgctaaggattgagaaggggaaggcatttgtggaccttttgaatgagaaaggaaacagttccggagagaatgagatgagctatgtcgaaaggacactagggttcagcatacggtgtttggataacagggatataagattggtaaaattacatattccgcatgttactttgttattctattcaccaacttcgatttgttcaagaaggtttgcaccatgatggttatagctatcaaacggcaattgttgagttctgagtaaaagataaagtaggaggcggcctgcagaatgaccatatgtgatattgtcctttctttatttgataacatgtacctaactaattgtcagtgttgttttcttcacttatgtctactcgtacgtcatatgatataatgtgtgaatgatgctgaaataatgtgttcatgggttgacaacattccttagaagacttgtgtatgactctgttatacttggattgtaggttactgtcatagtcgctggaactgtgcgttggaaacggtaccttgattatctgatcatgtcactctgtagtgaggagaaggtgttcagggagatggaaccactacttctgcaggtttcttctatatctcttacagtatactatattctttattgacaacctatattgagaaaattaggtaagtaccatcacaaagctgtggaaattggaaaatactattgcatgttagatgacatgtggaaaataccaaacaatttggcctgcaactacagtagttaactccacactgtagaatctctgaagtttagcatttttggtttcagatattacgaattggtttctttgaaattctcaagctcaatgtgccagcttatgctgctgttgatgaggtatgttgattttttatatgtccttgggagctcccaagggccttaaaaagctcatgtctatgccaaccatatcaaattttgtatcaaaaagcaaaataatgtggaaacgtatatctctttctctgtatgctttgttccataacggagtttgtatgaatgctgttgttttatggtaatgataatacatttaaccatgatttctccacagtttttgtacttttccttttcatttcctgtagtactattatgagttttatggatggtggcgataaaagggcttttgaggatgattatgttcctggacatgctacatttttgttaaattatgatatttgccagtatactatatctaacctaataaagtgaattttattgatactgctgttataatattctgaagctgattcacctgtttcactgatcttttgcattttgtcctttctttgagataggcatgtcatactgttaccatttgtatttctaacgtacctgacaaatgtaaagaatctagtaatgcttctttcaaatcacaattttagaatgtaaggcttgctaaagtagctctaaggcctggtgctgggaacctggtgaatgcaattctgcgtaaacttctactgctaaaggtatgaattagaactaatctagccagcctgatcagtaggattgcactgtagtatcgttattttgttttttcaattcaggaggcaaactctcttcctcttccaaagatagaaggtgatgatcgtgcccaagctcgcgcactttccattatttattctcatcctgtcgtaagtttcgtttaccctctaaactttagtttgcttctgtttcttagttttctgtgtgctagattattcattaatcaacataccaattccacttgaccaattatcaatcaatgcccttgataactaggattgtggactcacgtggaattcaatctactagttctatctggcaaatatttgttaagaacacaacagaatatctgtagaaatttcattttttaatctataatttgttttcttctctgcagtggatggtgagaagatggattcgttttctgggcaaagaagaagctctaaaattaatgaaatggaataacagtgatcctcatttcagtataaggttttaagccaaatgatgtactgtaatatacagtcacctgctctgtttatgcatgtccatatggttgattcgtcttttttatgccttatatcatagggtcaacacagcaaatgggtatacaagggctgatcttatagatcgattggaaagtttgcaggtgcttccattaagctttagtaccttctgcttgatcaatataaggcttaataaagttcataaggaagcaagaatgaatataacatgtaccttgtgctatattatgcaatggcatttaattatgtcattcggctcgctgcggggtatataaattcattatatagagctattcaggactctaataccttatccatattgatgtcacattctgccttgattatttgctagataatttgatttccttttatgtaggttcattatgagaagtcaactatggatgaatttgtccgtattcaggagggtatgcaggtaaataaactgatagttggttttcaatcaacgactagtcactagtgctgtgttaaacttaaatcaatatgatgtattgacatccttgtatttttttctacaacgcaatatgttcagtatacttacaaaatagcactgtttcaaaacctaaatttgttcgtgcacataagatatcgacattgattgcagttctaagaaagtgaggctgagaggcagatgatctaaaaagaacttataagaaataatcctgaaataatgtttgtgcagtagcaagaaaggggagataattttatacttgtgatgccttagatgtttaatgattattatttcttttactgttcagagtataagtattgatcaccacatgtattggatcagtcaagttgtgtatctcagtagctgtacaagttcgtttattttgaaagaaacaacttttttgaagcctttgtggtttgcaactttggagatggagcaccaccattgtgccctttatacataacaaaatatctgcattcttttatatttgcatacttttatatgaacattacttttactgttcttattttcttgataatacctcttgggatattatttcagaattatcttaatttgttccatgtacagactgtcctgcaagctggactactgaaagaaggcatgtgtgctgtgcaggatgagagtgcaggcaagttatgatagttatttcttgaccgctaagcatatgccttaattagtacaataagattactatattgaagtgatgttgactgcaaataactgtacatggcttatgactatggaaatcgtttcagttttactgtccgtcacttccattaacctgagtttttcctttatccttgaggtttccatgtctaagtgatagtggtacttctcatttgagtaagcacttgatacttatgctaagacatgaagaatctattgtaggtcttgtggtgtctgtggtcgatccacaacctggggaaacaatcattgattgttgtgctgcacctggtggcaaaactttgttcatggcagcccgtttatcgggacaaggtaagaagatggaattgagagagggttcaatcatctgttgatatcacactcataacaaggtagttgtaggaaacttatttttttatgaacatggcacatataaatagacaatgtatttagcatgttatgtccataaaaaatgacgcacaccttcttaatgaaatgaagcacagttctcatgcgtttccgagaaaaagaatgacacactgaaatgaattacttttcacatcttactgcttttattaacttattataatattgagcacctgcagacattggttgttgagatctagttaatttgtcagatataaaattagtgagtgcagtatgtccatggagttaaaatgaagaatgtggtggctttcttaatgtttaattgctataagtaactgttcacgagttcatccttttgcatcagcaacgcgaaccagcatttgtaatttttagagcaaattccaggaaaccttgcattttattacaagcaaatataactcacatgtccaaaatagttttatgagaactcattttgacgttccatccagaggtagttccaagtcatcatggatgatagtagcttagagatttgatattgtggacttaccatgtagtctgattcagggaagatatgggcacttgacataaacaaaggtcggttgagaattctcatggaggcagcaaagttacacaatcttgatgctatgatcagtgacatccatgctgatcttcgactatatgctgtaagtttaagaggaaatcccttgtttctaaaccagaaaatggggaacaagaatatagaaagtccccataaatctaaggatactgcactccaatggaagtatttattaggaatatgactagtggctgttatgagcttattactaatcgttatccaaatgtatgatgtggaggcttatacatatgaaaaaattgcagaaggaaaccactgcaacatttgacaaggtactgttggatgctccatgctctgggttaggagttctttccaaggtatctttgttaagcaagttcattattttgctttcactgaactaatctaaatcttgaataacaaatgattgatgaactgataatccttaatcctttttccgttcccaagagggcagacttgcggtggaatagacaattcgaagatttggaggagctaatgtgtttgcaagatgagcttcttgattctgcatcaatgtgggattccttctcctgcaaatctgtgaaagaaaatttatatggctaacatctgatattactttctggttttgcctgtaggttagtaaagcctggtggtatattagtctacagtacatgttccattgaccctgaagaaaacgagcacagaattgctgcttttgttcagaggcatccggtactagttcgtcttaacatcaaacgtggatcatttactggaagttaataaactcaatattaagtttgatttgagaaaataagtcccttatggtttacagtgttgttggtaatattgagcatgctagtaaaacacgtgctaaaagcacatgatctctggtgcaacttagactgacttatctcaactaacgaggtaataatcacaaattcagttgctgttggcacatgttaatccagcttttggaagatcccatcattcacactacattttaatattgttaaccctgatagttcagatgtgagtttaacagtaatatagctttcaagcatattaagtctccacgaaatgtaaacatttaagcatgttttaccacttttttagtgaaccatctctataaccttgacatcatttatatactaaaatggagttgccacataatgttgtattttttcgcactaataatttcgcttttgacaatattttatgctatgcatggatatgttgtaaatcaattttatgctgtaggactttgtcctacagagcgtgcatggatatgttcctgctgaatttgtcacagatgagggtttctattcctcaagtccaactaagcactctattgatggggcatttgctgctcgtcttgttcggtccgtcctctaggagttcaacaaataggtgagatttattataacaaagaaccactctatttttctaacactgtgcatcgagttgctcctctaagaagcaaatctgcagtatctgcacatgcatgtaatctctcctttcacgttactcattaaacagcatggttctttggcttcataaaagagagagaagaaaattggtctttatattcctcgtttcataattttatattgcttctcattctgtatgcagataagctgtcacaatgaagaatgctgaggtcatcctgattcctggcaggcaaactgcattttgatgatgatgtaccacaagatatatatgttgagagctagaggtacccaaaaccatacctgctgacttggccttcacctgagcacatgttttatttcttaggaccacacggagtcacaatttgtattcagttctccaataatttaaatggtcgtacttggtgcctcggtgattaaaacttaaaagataatctctaaagttactgccttaatggtgaaatctgattggatgtttacatccaaatgtaaattggcatttattgattcagtttagtcagcaaatatattttttgaggacacaaaagagttacattataagcatttgttgaaatgcttgtaatactaaacatgtacttttacaggagaaaggtacttaaggaatttctataatgcaagtacacttcctgtgtatcatactattatgtgctttttttagtgaatttctctgctagtatctgtaggtagatgatcactaaacatgcatgaaatatatcaggagaaaatttattctaagaaatatctagtattttatcaggaaggccaacattacaaagccaagggaagctagtgtgactgatgatggtattctccctttgtccttccttaggaacattgcctcataaattgggatactagtgatcactatcattccacagaggatgacctgggttagaaatacattccatggcatatttcatacacctgtcattatttgacttagcacttccactaggcagacgaggttgagtagtgcaacaattacaatgatcacatattcaggatatgatgacccaagttcaatgatttcttgtttatacctctttgcttcatctctattacttacctttgctgtaaccgcaaatgtcatcttcgacagtcctagcaacttacggatggtatcaatgaggtcgtaaagatatgaggtaattcttctaaccatccacatcctttgtccattccaacatcctttcaatgtatcccctgataataatgcctcatatagactgtatatattcttcacagttcacacataatacatatacgaagggtgtagcccatggactcataatctaaatggcatataaacataggattagttttaataagagcaatatgaaaccaaagtgaggtttatcatgtaatattacctctgggaatagaggggtgcccttcacaagcctagtgatggaaacataacataataaagcgtaggcagtgagttggatgcccataacccaaataagcaatagcccatctgtagttgtaacttaatttttccatgtccaatcaagaaggggcagttctttgaaaaaaaaagtgttaaattatcctcaccccatctcttgcgctgcagtattgtctgggcaagtgttgctggacccacacccaaaagtgctgctctttgaggattgatgtaaactgactcccatcctctgcaatttatcgccaattcagtgaagattatcttctaccgtgcaaccatattttatttcaatctcatttccccactgtgtcctatgttcacaagtgcaggttgctaaagattttgccttctcttcaatctcatatatgtctgcctgtgttttttcctttattcctctcccagtcttccttgtagtctttgctgaacctcctacacaaaggatctctcttatatggaaacgtccagtaccaatgttatggattggctagggtaagggtcctaagaccgggggataggcgctcgccctctaatagcagaggcagggcttctctctgctgagctaaaagaggctctgaggcttagggctaactttagagattgattgattgattatagagtccatggggtccctttatatatatagggaggacagactagatacataaggaactagtctctagtattatataaaccaatccaatctctgtctctagctttctaataaacctcatctctttcctaactaggtaatctcctatatttatgtgacttatttctaatttatcatgcctaaactgttgcatggccttggcccatgcccataacaaccaatgtagggtgagccaacagcactgtccataccacacatatccaccttaacattgaattgttttgttagccgaataatgtatattgatagtatagattattaaaaacaagagaatgtattaaaagtacaatttgatacaacttacctcattgagaacaaggagggaatttccatatatattgttcttggtcatgttgtatagttctgagggtactgtacaaatccgattttgtggcccatttcttcatcaaggaagaagcacaacgtacctctgattgagtcactgttattggaatacatgtcgcagtccacattcaagataatagggttgttacatatctatatttcaggattgaaatttaacatattttaaaatactttcaggaataaggcatttcctgaatgttagaatactttgtgaaaatgctgcgataaattgttcattgaacaatgcacaactgaccatatggttctaactccatgcattttttttctgactgaagcaaacagtagcaatacataaccttttggttggttgttgcacttgtagaacctactagatacttcttttttttttttaactgaaacctacttgatacttcatttttcaaaatgaaagtgtggaacaacttgttgcattgttgtatttattacaaaatgggtaaggtaacctctaatggaaagtagggattttataataaatttgttaaccttgtttcaaggtaaaactaaacaaggttagggaacacaccaaagcgttcatagcccaagatttgaagttatggtggtactgaggcctcttctcacgtgccatgtataccaggcttggtagcacatttccgtcatcatctactacattttggcttttcccatctataagtatctatcaaagaagcaacattttttttagaacctgaaattcccaaaatggaagtagtatggatttctttactttgtaatcatgaaatttttaggacagtaaagcctacctgaacaattggcggatgatttttgaggcaatttctgagttccttccatcaaatcctttatgattcagtttaatttcttcaggaatttttcctaacatgacagctgtatcaatcctctgtcatttctttgtacaggtcctgccgataaaagaagatcagttgccataccaaatgttgagaattataagccgtaattatctgtgagtgcatattcatcccatacttgttgattatcgatgtcttaaagaagaatgttaagaaatgcacataccttgataaatgaccattcttttggggtgcacagattgtgatgcccttctgactccacgaagaaagcagctggtggccttggctcaatgttataactttttgcagaatggtagccagtgctttgcaaacacggaggcctcccatagagcatagaaagtaagaattgaacctccatcatcagaaaggtacactcttaatttttttgacgggtaattgtatgccatgactgatacgacggtagatatgacaagacttggtggttctgagtgtgggtctgccgtgcatacaaagatatccagcttttttttcatgcatgctccaaatgacatgttaaatgtgtttaggcttattgtggtaaatagctgtttgaatgttggctcgtgtgtaaaacaatagaacacattttaaagagatcttcccttcaatgatttaagctagctaaactggtctacctttaccttcctttagtttaccatcttcaattttttgagatcaatatactagaaacaaaccggacatgttctgaagtccttttgctaaattcaaagcataaatcatcaattttttgttgtgtactgttagagtataccgataggattctagaggattcaattgttacggtaggataggattggtttccatttcatctctgagattccttgatataccgacctgggaggctaaatacaacgaacccatattacacaatacatctctttctgtacacactttcatgtacaaaagatagttctgttccttttgcagccatttttagtaaagctgagataagaaatgttgatcttttagattattgtatatattttgctaacagaatctatatactcctattatactacctccggttttaaatatatggtacctttgattttttttaatttgtttgacttttttgtcctttctagaaatgtttgtgcaaatagacaaatatacaaggcacacttaagtacttggatagatctagggggtactcttttcactttacttataactaagtaattgaataaatattgctgttcaaagtttgaggagaaagtaatggtgtcgtatattaaaagaacagagggaataccattatatgcacgaaatattttgagccctgaaactctaagctgcaatagtttttttattattttcttggtgcattaatatgcgagttcctacccgttgtagttataacttaggcccttaaaaaaagttatgacttatgatatgagaagttgagagaaaaaatgatgttgtaagaaaaaaaaactgctgtcctggttgtccagtcatgagatttctttgttgcaatgtttttttttaagaattaacataagatttgcgcatgtgtataaacatatggagaatacggtataagatttgcatatctttgtattaagacatgaaggatacatataagatttgtgcatcttgatctttgttgaaaggctcgttacatcagttttttgaaatccaaatttggtcggtcaactgacatttcaaacactgtaagcgagacaccgttaggttgccttcgtaggaaggagatgagaaccaatctcttgtgcacggaaaacggagcgatccattagcgcgtgattaattaagtactccctccgtcaaaaagactcaattcttgggtttccgtgtccaacgtttgaacgtccgtcttatataaaatttttatgattagtatttttattactgttagatgataaaacatgaataatactttatatatgacttatctttttaaattttttcatattttttttaaataagacggacaatcaaacgttagacatggaaacctaggaattaagttttttttgggatggagagagtattagctaatttttttcaaagagtaaagtgtattggtggtcctc

SEQ ID NO: 8586 - DNA, 4759 bp, Oryza sativa
aagaaagggagaaaaagagaataaaaaagaaaatggaaaaactttaaatgggtcccatttgtcagtcaaaatgatgccacattatgtccgtgtggcatgccacatcaacgccacgtaggatcccaaaggggttatggcgatttggtacctagatgacacactatgacaagttctgggacttggatatgtattttgagagtttagggacctagatgacatacccctacaagtttaaggaccgcccgtatactttactctttttcaaaaataaattaatatgatttttaaactgcttttgtatagaaactttttgtaaaaaatacactgtttagcagtttgaaaagcgtgtgcatgtaatacgagggagaggagttgggaatatgtggtgccgaacatacccttagtgtggagttgtagacgagcagtaatatacatgtctttttttattttacaaaatttaatatactatctccatttatttttatattttaagtcattttacaattgtactaagtcaaacatgttcaagtttgaccaaatttataaaaaaacagagcaacaatttcaacacaaaataaagatactacaaaatcccaatgcaactctgtttcataaaaaaaaaagccaatttctatggatgaaaacatgcacggttcagattcatctccctacagtgtctttctttagacggaaggagtatatatatagggcctgtttagatcccctcgcaagttttttcacctgttacatcgaatgtttggacgcatgcatgaagtattagatatcgataaaaaaactaattacacagattacgtgtaaattgcaagacgaatcttttaagcctaattgctttatgatttgacaatgttgtgctacatgaaacatttgctaatgatggattaattaggcttaataaattcatctcgcagtttagaggtggaatttggaatttgttttgttattagactacgtttaatacttccaatatgtgtctgtatatctgatgtgacacggcaacatttttcaccattgaatctaaacacaggcatagtcttgtaatatgaaagagagagaccaagttcttgaccgttcgatttatgtgttaggattgatggtcattcatgtcaaaatttatgcgtgtacgaggatccaatttgaagagagagacagttgtaacgcacaaaagtgaccaacctctcggcgagcctgtccttgaacgtgcggcggcggacggggcacaccaccggacggcctacctgcgtgacgacccagtaaacggtgtaccgtgtacatgacctccgccgcctccatccctacccacgccgccctcccctcgccgccggccggcatgtgcgtcgccctgtagtacagcaccagcagtttcccggcggccaccgtcgccgcctggaatggaatctgtacaccgccctgccgcccatattctccttcgccaacagccgccgtcgtcgtctacatcgccggccgatcagctgtcctctctctctctctctctctctctctctagcaaattaagctgcttatatgcgttttctctacagtgagcacttggctaacatatatatagctctcgatcactagctcatacgaatcatttgactatgcatatctgatgcaggaactatagtaaacgtgtaatgtcatgctacctcttatctgcatgtaggaacataatacccgaagttatatgtcacaggtcataatacctgatcacatgttcccaaaaaagaagttcctctgaattatatttttgaggaagagggagatgcctctcccttcctgtgaattatatgttctttttttcctgaacttctgttctaggcatctatatgctgatgatcattaacatgtgtgaaatattcaagagaatttcatgaaatggcaatgcaatttattttcatgatcatcatcagaaacacccaatgttttataaggcatcaaatcccattttagggacctcaaactattggtactaggaatgccaacattacaaagccaattgaagctagtgtgactgctgttggtattctcccattgtcctttcttaggaacattgcctcataaattggcatattaatgattactatcattccacagaggatggcctggggtaaaaacacattccatggcatattccagacacctgccattatttgacttaaccctccaactaggcagacgaagttcagtaatgcgacggttgcgatgatcacatattcaggagacgatgacccaaattctaggatttcttgctcatacctctttgcttcatcgtgaccgcttacctttgctgtaacttcaaatgacatctttgacattcctacacattttcggatggtgtcaatgaagccatatagatatgaggtaatgcttttcaccatccacatcctttgtccattccaccatcctttcaatgtatccccagataataatgcctcataaagaccgtagagggtcttcacacaaaatacatatatgaagggtgtagcccatggactcataatctaaatgacatataagtgtagtgttagtttcaataataaacaataagttctaatgatagaaatgaatcaaagtactcccttcgtactcgtaaaggaagttgttttggacagcgacatggtctcccaaacataactttgacttctgatatatgtatatttttatgaaagcatttttcaagacaaatctattcatataatttttacattttcaaactcaacaacttaagagttattcatgatttatattcccaaagtttgacttaaacattgtcctaaacgacttcctttacgagtacggagggagtatggtttagcaattagcattagtttaatagtacctgtgggaataggggggtgcccttaacaagacctagtgatggaatcacaacataatagagtgtaggcagtgagttggctgcccataatccacatatgcagtagcccatctgtagttgtaacttgatttttccatgtccaaacaagaaggagcagtacttcgaaagaaaaattgtgagattaccctcactccatctcttatgttgcagtatattctgggcaagtgttgatggggctaaacccaaaaatgctgctcttttaggatttatgaaggctgactcccatcctctgcaatgtattgccaatccagtaatgatatcctctgccgggaaaccgtatttcactccaatgtcattaccccactgtgtcctatgctcataagtgcaagttactaaagatgttgccttctcctcaatctcatttatgttctcttttcctctttcctttattcctctgttccagttttccttgtagtctttgctgaatatcctaccacaaaggatctctcttctgtggaagcatcctgtgccaatgtagagacaaccaccaacactgtctaaaccacacatctccacctttacattaaattgttttgttagcgcagaaagatattaatttaatgatagaacaaattgttgcaaacatgaaaatgtattgaagttacagtttcatagaacatacatgatagctaacattgaaagagtttccatatatatcattttgggtcatattgttgaagatctgagggtactgcacaaatccaattttctggcccatttcttcatcgaggaagaagcataacgcatctctgattgaatcactattgttggaatacatatcacagtccacgttcaagataacagggctgtcacttatcactgatgatacccttatctgcattttaggataaaatttaacatatttaaaaatattttcaggaacaaggcatgtcttgaacatcaaaatattacttgagaaaaatttatgatcaattgttgactgaatgatgcacactccatcgtatgttgtagtttaatatgcagaattgataattgagaaaattatgtgatcaattgttgattgaattcatccattgttcaactatatgcattttttcttactaaagaaaatataatttaatgaccttttggttagtggttacctgtagaacctactagatacttcattttttaaaattcaaaatgaaaatgtggaacaacttgtcgcactatttttgcatttataagaaaattggtaatgataacgtctaatgagattagggagttcacaataaattagttaaccttgttttaatattcaaatgttaaaccaagttagtgaactcaccaaagcgttcaatgccccagctttgaagttatggtggtactgaggcctcttctcgcgcgccacgtataccattgttggtagcacatttctatcatcatcaattgcatttcggtttttcccatctatcagaatctaccaaagaagcaatatttagaacctcaaattatcaaaactgaagtgttatgaacttctttactttaatttgtatagtgaaaaactttgtgctgttttctgggacagtgaagcctacctgaacaattggctggtgatttttcaaagtaaaatctgagttccattcatcaaatcctttatgctttagcttcatttcttcaggaatttttcctgacatggtagctgtatcaattctctctttcattttttcatacaggttttgccaaaaaaaaaatcggttgccatgccaaatattgagcactatgaagttatgaataggacatatatagtttctagttatatgtgagaagcttgactttaatgtggggccctacctgttgattataaaaatctcgaagaattatgcttataaaaatgcacat

SEQ ID NO: 8587 - DNA, 15206 bp, Oryza sativa
actaggacatatatagttctagtcatatgtgagagctgatttaattgtggcctacctgttgattataaaaatctcgaagaattatgcttataaaaatgcacataccttgatcagtgcccattcttttgggatgcacagattgtgatgcacttttgactctgagaagtaagcagctggtgaccttggctcaatgttatatcttttgcagaatggtagccatttctttgcaaatatggaggcctcccataaagcatagaaagtaagaattgaacctccatcatcggaaaggtacacacttattttttctgatgggtaattgtatgccataactgataggatggtagagatgacaaggcttggtggctctgattgtggatccgcagtgcatacaaagatatccacaccaggtagattttgttcatatctgcttcaaaggatatggtaaatgtgttaaattgtgggaaatatatgttttctcaatgatggatataaaaccaacctctacgtcaaaaatgttttggccataatatttttacaataaagaaacatttttaagttgtgaaaagaaaaaaacaaactagtgaacatagctaagtaaaaataagtttaatgcaaatagataattgatgaaatagccctactataatagatggcagagggtttgtagtacacgaagcactgggtgatctagtacacgggaagggcctagaagtgcatacaccacaccacacggcacttggctctaccttcacttccttgggcaaagcggtgctttgtttcgtgaccaaattaagtatttgtgattgattgtgaaagatatatggataaagatatatccatccatgtatcccgatattgaaaaggattaattgattccataacaccttagattcaaagaaatgcgtttagccccattcctgcgccaggctaaggctacttttttgttgaagttcggaactttttctttttgaccttctaactcatacttgatcatactggcatggctccactattttgttttcgatcggagcatcaagcagtacaactcatttctacttaactaagcatgtgctaaaggaggagagagtttgctttaccgaagtccccttttttataagggtcctttgattcataggatcggcaaaggattttcgcagcattcaaattcctatgaattttttcctctctgtcactttgatttgtagggaaagaaaggaaactttacatagaattgcattactatgtttcgcatttcataggaaaaaacagtaagagagtatgagctctttgtaaactttcatttgtttttcctatggcactatcaaatagttcctatcttctttcctgtgttttttatattcttgtggaattggagaatcataccatttcaattcatatatttttcctatcctgcgaatcaatggagttctaataagagaaaacccccaatccgacattctattggtttatgtatgcagttcgatatttaacagaaataatcataatgatggcttgatgatctgattgagctagctgtgagaacacagagggtctgtttggttgctaccctgagcaccaagcctgagaaatttgtatgcctgagaggcattcgagatgctcatgaagcttgcctggccaggccgcctgatgctttccttgtttggtttgccactcctgcctgagaggaaaaactgatgttgggcttgagattattactgctaatactgatgttagagccaatacggttggtcttgagaaattgagatgattagtgtagatgctaattgcagacacaaatcatagaagacaactgaaatccatggggaaaaaatggggaaaaaggggaaagagaaataagaaagaaatcctcaaatccaagcatgcaccaaattaaatattccatgatttctcccagccatgtaaagcgattcaatcaatgatatttctctcagacacacgcagagcacttactatcaacgaatcaaatgctagcagccatggtggcatcttctcgaggctgcagatctagcaaggcggccggactgcttcgtgcgtgaaatcctttgagacgacagcatcgagggcttagcccagcggcagggggcgagatgctttacgtagcggtgggtttagcatgttggtgatgactcacacgccggcgtcggaggcaaaaatggtggcggtgggggtcttcgcgcgacgccgccgcccgttttttcttagcgatactgcgcctggagctcaggcgaccgattttggtcgcctggttcaggctaatgacattacgtgtttgctcaggccaggcaagaggaaaacagactcagggtggcaaccaaataggaggtaatcgaactcaggctagatccaggccagactagttttgctcagggtagcaaccaaacagccccagagtccctggatgagatcgtttcacacatcgagtataggttttatgtccgtgtcaaagtaaaatttgaatttgaaatacggaggatgtatttaaagtatcctggccagttttccatgtaccgactaccttacctgcttggtaagggtcgtttataatagggccatgtccaatacaactaaaaataaaaactaaccattttatcccatcacgtaagataaaaggatgggtgtttataatatctgtgcttgattaagcatcgatccatacttagcaggtgcttatgtgttctaaatcttgtcaatatgactcgccagtttgtcatcaattttcagaaccttaccagcaataatatattaatatattaagtattacttcctccgtcccacaatacttatctttttagattgtttaatacaaattaagatttgagaagtaaaaactatattgcccgttctttaaatggaagtaagagtgtggtgagggtagaatgtgtaaaaatttaaattgaaggtgactgatgtgataagtagtactcttaagtaatagtaagtattgtgggataaaatttaaatttataaaataactaaactatttggggacagagaaagtagtatgtagatataactttagatgataataataataataataataataataataataataataataataataataataatacatgcaaaattaaactaattttttgaattcaaacctctcggcgagcctgtccctgaaggtgcggcggcggaaggggcgccaccggacggactgcgcgatgacccagtagacggcgaaccagagctccgccgccgccatccccagccacgccgccctcccttcgccggcggccggcacgcgcgtcgccctgtagtagagcaccagcagtatcccggcggccaccgtcgccgcctgcaccctgtacaccgccctgccgcccaactcctccgtcgtgaacagcggccgccgccgctccgccgccgtcgccgccgccgtcgtctccatcgccggccgatcgatcagctctacgctctctctaattgctttgttgcttaagtgcaggagagagcagtaagcagtgagcagtgagcgcttgatttagttatatatatagctcttgatcatcgttaggctcctcatacaaatcaaaatttagctttagttatgtctgtttcataggcacttcgttgagctaagtggcggctaacatcgagatcacttgatatttttcgttattatattattataagtgagaggctgtgagagctcgcgccactctgctgccgaccaattctgagctccttccaaaagaatttattgctaacatgaattactgtatactccctccgtcagctggtatcgatgctatccaaataaatttgtagtactgtactaaattatactccctctgtcctataatgtgacatattctagtacgattaatctggacagatgaatgtttaaattcgtagtaatagaatgtgtcatatccggtactaggttggttttttataggacggaagaagtatgtaatgttgttactctctccgttttatattattagtcgttttatttttttctaatcaaaattgtttaagttggatcaaattaatagaaaaaaatatagcaatattttcaatattaaacaaatacattattaaaatatatttaattttatatttgatgaatctaatttggtgttataggtgttgctaaaattttatataaacttgattacaaattgaaataatttaactagacaaagttaaatcgaactatactataaaccaaaagtgagtatattttaagaatgaggaaatagttcaaaatgccaattcactcacataatcagattaattccgcaactgttactatcattcagctcatgcacgtctcttttctttgtcttgtgtgtaacgaccaggagtaagcgacgaatgaagtgcaactgttgaagaagatggagagtgagaagtggaaaacaagtactcgtgaactcgtccacgcaatcatcaggtagcaagtcaccatgggattcctacctcacacgtgagcgctaggaactgaagcggcacgcgtttcaccgtatttatagcgctttagcgcttagttttggataaaaaaaagctatatacatttcttctttaagataaaaaccgccatgcgtatatttcttttttttaaagttgattgcaactttcaactcagatttatcaaggatttgaaaatttttcaactaatatttgaaaactttcaaggtttgaaactctaattgaaaaattttcaagtcaatatttgaaccctttaaacttaaatttaaaaatttttgaactaagaagatgttgaaactttcaagtctgatttgaaaactttcaattcgaatttgaaaactttcaaaccaagatttgaaaactttcaagtcaggatttgaaaactttcaaatcgaatttaaaaactttcatctccaaattcaaaacattcaactcaaatttgaaaattttcatctcaaaattttaaaacttttaattcaaaatcttaaaaacttttaactcaaattctaaaaaaaaaatctaggaaaaaatcggcagaaaaaacgagaaaaaaacgcgtggagaggcgcagacgcgccagccacgcggcgtgcgcgccagcaaggtaactggtgcatcttcgccaattagcttttccgaagtcaccaagacacaattgggacctggaattattggcttctctagttctctttccaacttccaagtagtggcagatcagttttatacgagaaattcagagatgctttctcagcattcttgtagtacaaattcttgtgaaatttatgtttttctccttcttctgaatatctgtgctagccatctgtaggtagatgattatcagcgtgcaagaaatatgtcaggtagagtttatcccaacaaaaattgaaagaaaaggcagtgcaatttatttccataatcattttacaaggcatcgcttcccattttaggacctcaaactattggtaacaggaatgccaacattacaaagccaattgaagctagtgtgactggtaatggtattctccccttatcctttctcacaaacattgcctcataaattgggatattagtgatcactatcagtccacatagaatgacctggggtaaaaacacattccacacacctgccattattttgcttagccctgcaactaggcagacgaagttcagtaatgcgacagttgcgatgatcacaaattcaggagatgatgacccaaactcaaggatttcttgctcatacctctttgcttcatcgccatcacttacctttgctgtaatttcaaatgacatctttgacaatcctaacaattttcggatggtgtcaatgaagccatatagatatgaggtaattcttttcaccatccacatcctttgtccattccaccatcctttcaatgtatccccagataataatgcctcataaagactgtagagggtcttcacacaaaatacatatatgaagggtgtagcccatggactcataatctaaatgtcatgtaagtgtagtgttagtttcaataataaaaataagttttaatgacaaaaatgaaatcaaagtatggcttatcatttaatttaacggtaccttttgaaataagggaatggctttgacaaaacctagtgctggaatgataacatattagattgtaggcagtgaattggctgcccataatccatatatgcagtagcccatctgtaactgcaagctgatttttccatgtccaaacaggaaggtgttgtgctttgaaagaaaaattgtgaaattgccctcactccatctcttgtgttgcagtattgtctgggcaagtgttgctggagctacacccacaaatgctgccctttgaggttccatgtagactgactcccatcctcggcaatgtattgccaatccagtgatgacatcctctactgggcaaccatatttcactccaatctcattgccccattgtgtcctaagttcataagtgcaggttgctaaagattttgccttctcttcaatctcatctatgttctcatgtcctctttcctttattcctctgccccagtcttccttgtaatctttgctgaatttcttaccacaaaggatctctcttctatggaagcatcctgtgccaatatagagacatccaccagcactgtccaaaccacgcatctccacctttacagaaatttgttttgttagtgtagaaatatgatagcatatttcttttttttgcaagcatgggaatgtatttaagtacagtttgatttgatatatggaacttacatgattgataacattgagagagttcccatatatattatttttggtcatattgttgtagttctgaggatactggacaaatccaattttgtggctcatttcttcatcaaggaagaagcacaacgcatctctgattgaatcactattgttggaatacatgtcacagtccacattcaagataacagggctgtcacttatcagtgctgatacccttatctgcatttaacgaaaaaattaacatatttaaaatacttccaggaataaggaatatatatattgaacattaaaatactagagaaaattttgtgaccaatttgtgcaatgaatgatgcacaataaattgtatgtggtgatttaatggtgcgcaattgatacatgaaaaaattcttgaccaattattgactacatccacatagcatctgatacatgagaaaataacatttgatgaccttttggttagtggttacttgtagaacctactggatacttcatttttttaattcaaaaatgaaaacatggtgcatcttgttgcagtgtttttgcatttataagaagatatataagggcaacctaaaatgaaagtagggggagtattgttaggcttgttttaacataaaaataaataaataacgttagtgaacacaccaaagcgttcaatgccccggctttgaagttatggtgatactgagggctcttctcgcgcgccatgtataccagtgttggtagcacatttccgtcgtcatcaactgcattttggcttttcccatctatcagaacctaggaaagaagcaacatttagaacctctcaaatatatataaaaaagtactatttaaaatcataatcgtgaaaggcttacctgaacaattggctggtgattttttgaggtcatttccgagttccattcatcaaatcctttatgctttagtttaatttcttcaggaatttttcctgacatgacagccgaatcaattctctctctcatttcttcatacaggttctgaaaaaaaaaaagtcatgccagtcatatgagagttttgatttctcctattttaccgaaacctaggggaaccgtatatatatttcattatgtgagagctgattttaattatgtccaacttgttgaattacaaatgccttaaagaagaatgttaaaaatgcacacaccttgataaatgaccattcttttggggagcacagattgtgatgcccttctgattccgagaagtaagcagctggggaccttggctcaatgttatatcttctgcagaatggtagccatttctttgcaaacatggatgcctcccatagagcgtagaaagtaagaattgaaccaccatcatcagaaagatacacacttattttttctgatgggtaattgtatgccatgactgataggatggtagagatgacaaggcttggtggctctgcgtgtgggtctgcagtgcatacaaaaacatccacaccaggtagattttctttgtatctgctccaaaatacatggtaaatgtgttaaattgtgggaaatatatgttttctcgatgatggatataacttcatcctctacatcgatgtgtattcggccataatatttttacaataaaacaacattaagttgcaaaatgaaaaaaaaaactaatgaatgtcctcgtgatggtgtgatgatttaattgggttaactgttgagaacactcagagccataacctggatgagatttttttaacaaatcgagtatatatagttttgcatgtttctatcgaaataaaatttgaaattaaaatatggatttaaagtagtgacgcccctgaagaaacatgatgagttagacaagttgggcccaaaatgcgagttgtacccagggtttgcaattttgaaaccctgtttttttgccggtggaggccgaaaaaactgaaatcaccaaaatttcagaattttgggtattttttgaatttttaacatattttgactgaatttgaataaattttgaaaaaatttacaaatacttgacaaaaaattgaaaatttcagagagatttgtgcttgccggtgggggccgaaattaccgaaatttcgaaccaaaattccaagcactggttgtccctgttctgatcacctactcagtatgtggatcgtttaggatcatgcccgatgcaactatgcaaatgcttaaaggagaggagtgcttataaaaaaaaactaaccattttattctaccagctgtaactaagataggaaatgttcctttcaaataaataaaaaaagatagaaggtgtcctaatctgaaaaagcatatgtgcttagcaggtgcatatgtttaaatgggccttaagcacttaagagaaggtgcttgggttggaggaacgactctttacgcggttgtgcttgattatgtggacattccaaatgctacatccgtttttaaataatgatcctcctcaccgccgctagaggtgagtgccggaaatccggttgtcctagaggaagacagcggctggagattgcaacggcgatggcagcaacagcttctctctacctaaggctgtgtttagttcacgccaaaattaaaactttaattgaaattgaaacgatgcgatggaaaagttagaagtttatgtgagtaggaaagtttggtgtgatggaaaaagttgtaagtttgaagaaaaaattaggatctaaacacggtgtaaaagcctataaggtatggcgtgttaggaggcggtgtcaggaggcacagcaagacaagaaggatggcaacgtggaggtgttgggtggaagggaggacatccttgagaaggtgaaatagtgtatccaaaaatgttataaaaacggagttgtcatcttcctcttccaacagtgtatttccccaccacttaaaacccaccctgcctaaaaactaccacatctaaacaccagatagataaaactaatccctgtataatcatttgtcgtatttcttcccatcacgttccaaagcaccacatagtactatgatatttaaaaataaaagaaatatgtccatattttattaacacctccaatttgaagattcttttataaatccgattggagatgttctaagaataaattgtaataaaatatatctgacatggcgtgtttttattaaaatattataatgaagtatgtctggcatggcgtgtgtgttttttttaaagaagaatcaatcacttgcttaatgcttggccagtcgctaccagctttcaaaaccatacaaaagacacgtaagttatgttgatacaacctccgttttaatattaagggcgtccgtaaatctttttacccattacgtttttattcaaaaaattttacaaatataaaaaagatcaaagtcatactaaaaaacatttacgataaatcaagtcagaataaaataaaaacgaatgatcaacatatctaagaaaacaatgttgttatatattaaaaaaacaaagagagtatatttgatgccacttcagataataaataaacatgcaaaaaataaaaaataacagtaagttaaattcaaaccaacctctcggcgagcctgttcttgaaggtgcggcggcggacggggcaccaccggacggactgcgtgatgacccagtagacggcgaaccagagctccgccgcccgcatccccagccacgccgcccgcccttcgccggcggccggcacgcgcgtcgccctgtagtaaagcaccagcagtatcccggcggccaccgtcgccgcctgcagcctgtacaccgccctgccgcccaccttatccgtcgcgaacagccgccgcctctccgtcgtcgtcgtctccatcgccggcggctaactagctactctctctgtgtagtgagctcgatcttcgctagcataggatccgtagtaatatatgcatatatagctcgatcgatcactagctgacaaaatggactaaccaattctgatgcacagatatgtgcatatataacgtcatactatataaattgttttttactagaatatattttatatagcatatatctttagaagccaggttgatgagatttggttgtggtgctgtgtcagccactggagcacgtggtcagggagtgttttatccaggaccaaatgtatgggagacgattattgagtgtctttggattgatggtcctttacactttgtttctatataatttttggatactagccaagagtttgtgcgttgcaacggaaaataaattgtatttctagcttattaagttaattaagtacatatttagtctaagtgaagaattaggtgaattgtatgttgtctttccttattgcgtagtactcctgcacatgggaatttaaggaaggaaaggaatgcggaggacagctgataaaaaaatagtagaaaaggaaaaaaaaagaccctcctctccactttcccttcccctcggtttcttcggcaggccagcccctctaccagctgccaccgtgctgcccctcctctcctccttccctagccggcacgcagcgagctcgggtcgaggtgaggaagaaaccgatcgacgcggcagcgaagaacctagggaatggcaaggaagaagccaaggcgacccccgttgctcggtggtgttttggcgacaacagtagtggacagcggttccctcaggcggcgccgaggatgccgagcctctccacaatgggcattcccctctcatgaagagcagaggacgctgatgaggaaggggagagggcaccttggagggagaagaagggcgagggattgaggttgacgggcaccccgccgccagattcagctagcatgtacctcccggcgacactagccctcgatcaggtggcgctggccctatatcgagcgacgacagctctcgatccactgcttgaagacggaggaggacgacgatgacacggctgccattggattcaacatggcatgggacgatgagtcggtgaccgtggcagttgcctctcccgtcttctccggacaacgaaggactcggtggcgtggattggatcccaacaaaatccaattgttcctggtacgtttggatggattgccctcgtgtagacctccttggagttggtggcttggaccttggtcccacatgtcagatggtggtggcgttgggaaggcagaatggatcgacaccaccaccgagaacatttaaagaagtatagatgcttgttttctgagccctatggatctgagggcctcatcgtttgttctatggcttataagccgctgccaaagtttaaattttgaaactttatttggagtcgactttgatgttttttttaatgtagtttgtttttcagtattggcttttaagtcactaaagacacatatgaaaagttttatccataattattttttatcactaataaaccattacagcttatataatcaagccatatacaaccgatgaggaccttatttatatagaggccgaaaatgatttgaagatggttgtatgaccctaatgtaattatcttgatttcattaaaaaattacttatcaattatatataactttatattaaaattataatgagagtgttgctacttataatcgtctgattatttcttactattatgaatgtttttttaacaagtctaatgcaacatgaggatgcacgagcggtgtggtgatagagtagtcatgggtatacaacttcacccactagtattaatttaatggtgcctactaatacagtatattacacgtatgtcagggcgtcttcataggattttaatgacgttaaggatgtctttagtattatctttttagcgtatgttaagacatgtattcgctgtttgtgtgcgtatgcatcttctgatcgagaaattaatcagtctaatatatgatgtaagtctcgtaaataaactctaataccccttcaaatgcgtactagtatagtcaagctctagacaacacgtttttataggaaactctaggcaacaagttgaagttgatgtgacaacattatatttaacgccttaacagcagtttttcatgacaagaactgttgctagggtgttaaatataactgggttagtaaggttcaacgtcttacgtctctcttcgattctatattaattgacgtttttgacaaggttgagatcaaatttttataactttgaccatcaataactttaaaaatatttagtttaaagaaactaaaacaacatatatagatttttcttttaaagcactataataaaaataaacatgcatttatttattgtatatattataatagaaaagtaaggtcaaaagatatattttgtagaccgtgtcattgtccaaaacgtcaattaaaatggaaccggagggagtacatctgaatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatacatgattacatacctaactaattatatgtatggatgctatatacctacaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatatatatatatatatatatatatatatatatatatatatatatatatatatatatatatatgtttgggtagaatggttttaatatgcagtgttatttgctaattaatggtagtaggccagtcaccatcgtcggcatgcagagacgatacgaatatgccatatatatggctgcaaggacagttgtgtagcatgcagagacgatacgaatatgccatatatatgactccaatttaatttcaaattccgtagattaaaaaaaatatcgtatgcactagcacacatccgaatatattttttttggtggtacaaaaagaacaggaagatattctgttatatatcaccgtgtccacatctacatacgaatttcacgtacgtgtacacgcatcgatattgattccatgaccaagagactccatttctcaaacatacggattttatttttcccgttttgtttagcagttgttgtctcgctgtctcgcgtggatcatatatgtatattatatatttatatatatagatcgtgtggggtaagcgcacgaattaatcatagtgatgcatacgtgacatgacaatatcccttaatttgattgactacattttgccttcaacattccctcaactagataatactccgtgctttcttacgggatatatgttagatattagagaaatgatgaaataatttgaattaaaatattatgaaaatgatttgagaatgatgatttaacatgtgtatgtttagttttagaatgaaataaatcgtagacataattactatatgcttgcatgtgtgtttaatgggttgatgtggtatgcttgcatacaggtttttaggagtggtaataaatactatgcttgcatgttgagttttagatgtttagtggatattagctttataaaaagaaaagatttgttcgatgttgccttcagttcccttgtgattctatagtgttaactcctccttttttttatttttttttactgcatcctctttttttaaaaaattactccccatttcacaataaactattatagtatatatgatgtgacactatctaatactataaatcagattaaatatatagtgctaggtagtgtcacatcatgtattagattgatttattttgggataaagagaatagacacataggtgtcaatttaatttttactatgttgtatgcaattgtgtgcataaacctatatattaaactcgttatgggatatatatcttgcgacttcacgaacatagtttttttttaaatataagtacgataaatctttagctatgtgccaactactactacttctacttcttccgtcccaaaatctatattgtcaaaacaaaacgagattggatggaatatatcctaaaacaacaaatctagactgagatatatccagattcgttgtattaggatatgtcatattcagtttatatatatatatatatatatatattaggacggaaaaaacaaattcagagaatgaatttagatatagattttgggaatcctccattgattttttattggacaaaataaagtctaaggattcaggagtggacaagactgcataatctggttggtaaggaatatccggtcgccaagcgcagccaaaaatagtaattcagatggacatataagtagagtactagtaattcagatggacagatcctactgctcgcgtacagaccttgccagctgcttgattggctact

SEQ ID NO: 8588 - DNA, 275 bp, Oryza sativa
tgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctg

SEQ ID NO: 8589 - DNA, 1072 bp, Oryza sativa
ttgttcatcatcgtgcaaaattagtgttcagtgcgcacaaaggttcagagcaatcagaaatccaacacgatggcagaagtttttactcacaaaattcacaatgcatgtgactgagttagcaatatacctcaggaagagaccattgacgacctcggcgccggccccctcggcgcgggagcggaggtaggcgtcgagcacctcgcggcggaccatgccgatgtactcgtgcggcgcgagcgtgccgccgatgtcgacggcgacgttggacggcgaaatcatcttcatcttcctcaccttcctgtcgacgaggtccagcggcaggtcgaactccgacaccatgcacagcgggatggccccgccgcagggcttgcagttgtccagcttccgttcgatgagcaccgtctccacgccgcccttggccagcgcctccgccgccgcgccgcccgcgggtccgcctccgaccaccgccacccgcagccgccgcccgctcgggagcttcgggctcgacgccgccgcgcgcgtcaccagcctcgccatcctcctgccgcggctcatgcccccacgaaccgacgacggcatgacgaaggtggcgcgcgccgcggcggcggaggacgacagcgaggtcatcgtttctgtggcttctcctcctcggattcggaaaagatctctctcgtttgagctcgacctggcggtggaggagtgagcgcgagagtgagacgcgagcagagggtgggagtagtgaagtgttaggtttggggggcgagtagtggataggatgaggggagattgcgggggacacgagccgttggatcgagcgattggacggcgcggattggatacggatgaggtttttgtccgctttctccttcgccgtttgatccgcgcgagtggctgacgctttgccaggtcggaattgaatcttttggatcgttgtgtactgtatgtgatggacgatactttgccacgtcacgtcgtactgtttgttgatcaacgtttttgtaccgtgacgcttgtgtagttgtaatagtacacagtgctacgcgtgctgacaagcttgaagaagtgcttgctt

SEQ ID NO: 8590 - DNA, 16988 bp, Oryza sativa
gagtgcttctcaaacgacatggatgagacagtgcgtctcgtccggttgaagtatgtgcaatgtatcagtctttagaattgaatcaaggtggcacccggccaacagcttttcaaacggccacccgggccaacaactttcaaacggccacccgggcctagctgatcccatcagctgcagatttttcaaacatcgaacccctttccacaacagcaatttcacaaggcagtagtcaaacaacactacgcaaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgtaagccgacacaggtttaccatatgccgacgagaggggtcccagaccaacaacaggttaggtcccagaccatactatgccaggaagcccaggggtcctccccgacaccaccccggcgaatccacatgtctctcggcatcaaggctcccttgataagctagttactcagccaggggtgtcccattccacccatgtggtcgtacttgtcttatgttcggatgaaattccaaggaaacggtccttaggtgcaagagcgggaaaccgtacacccggtacgttccccgattcgcggttttggaaattcatttagttcgcaagcaccgactcaggtgtcgggttttccaagccttttgtaaaacccaagttttacccaagaagtttttcagattttaagtttgaaggcgaccgtcgatactcgcacagggtgcacgaatatcgaggcacaactagatggttacaaggggacatgatataacaattaacaaaggaaggatcaaatgcaacaaattaggtaggtccgccaatctgccttgcagacgggacaaacagattaagtgcgatcctatcaatgcgtaatatttttcaagtaacataattaaattcaaatataggctcaagatgctcaaaggtggcttgccttgctcgagatctggagcttgatcctcgaaatcctcgcactgcgagtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgaatttctaagattattggatttttgggtctaaagtaaaaggatttaattaaatcctttttgaaaaagaaaagaaaagaaaagaaaagagggagggaaattagacttccctcgggcggctagggcgcggcccgagagaaaaggggcggctcggccgagctaaatgggccggccggcccaaggcggcccaaggcacgcgcgcgcgggaggggaggagagagagagccggtggaccgggcccacctcgcgtggtcccgagtgggacccgcttgtcagcggctcggctcaccgtgcggagggagcacgcggcgcggcgctaggatgggggagagacgcggtgcacgcgcgcggttcgcggaggacgcggatgcggcgggcccatgcgcagcctcacggctcgcggtggaacgcacgcacgggaggggctgaccggggtcggcccgacccgatctcggccgagctggcgccgacgtggcgcctacgtggttgccacgcgggctggcgggaggtagacgacgacgccggccggaacggatggcggacgacagcgacgagcggcggagcgaaccacggcgatacaggcgaaagcgagcgcaccgggtggttgctcaggacgaggggagacgagccaatggctcggattcgccggaggatgcccgacggcggcgaattgcggcggcggcaaccggcggcgggagaagggggaaacggcgacgaggtcacgaggggtcgattcccggcggcgagagcatctacgcggctacgggaatccgatgctagcgttggattgggcggagctgcgccgagcgaggccggcgacgagcggcgcttccgagctcgggcggcgacggcggcgagcacatggcgagcggcggcaacggtcggggcggcgccggctagctacggggaggctactcgtgctactacccgagtctaaggggaggaaatggagcgaggagggagaacggggagatgcactaccgtgcgggcgggcgcagtgacgagaggccgacagcgcgggagtaatctctccggcctcgggccggggaagaggaaggagagggcgcgctcggagtccccttccgcgtccttgctcgtgccggctcctccgacacgcgcaacgacgaacggcaacagcgaacagagcacgggaggcggcggcaatggcgtggaggcaaatgggagaggaaaggaaagggggaagcttgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaaggggcttgtccccttgcctcttcgggaaaaggaggagggagcgggggcgacgcggcagagggaggaggagctctgcctccgtcccttggcagcttgcgcgcggagtggcgggggccgggcgatgacgacggcgatgacggcggggcggtttggagcggagcggcgacacgggcgacaggcgcaggcaggtgctgacgacggcggcgaccaggcggtcggccaccacggcacgcgcgcgcggttgcaacgggaggcgcggcggggcagcggggccgggcggcgcggacggctcaggcgcggcagggcagcggccacacgggcgtgcgcacgcgagggaggagggctcgactcggcgcggctcacgcgcacgcgcgcgcggcgcgcgggcagagcggagaagagggagagagagagagagagagagagacccggggagggagggggagatgggccgagaagattcggcccatcgaaccgggggaggcaaattagacttttgcggaggaattgatttgggaaggatttggattcgggattgaactcggcgatagatcggggatttgagatctgagatggcatggacactagacaacaagcaaagaaacaaatttcgcaaatagagtttttaagagatagttttcccgctaggcgccacgacggaacgggcgctacaattggtgacggtgcggggtgggccgatcgagctgatggccacgtggtgcagagtagggaggaggtctcagtatacaagagccggagaaggaagaagaaagggagaaagaaggaggaagagaaagagatagacgggaatggataaggaaaggattgagcgagatagaggggaatggataagggaaggattgagctcccgaagtttggttttagccattgcatattagggaggcaccgggcttcgttttgtcatatagtgtcctcccttaaactcgtcattcctccggtgtttgaatttgatatcatatgtcaagcttcttcttcctcctcgagctccttcttcttttctccctagctagcaagacctcgccagtcttcagttggaagtctcatcatgtgggagtgagaaaaagggaagaggaagaggacaacactacattcatttgtctgtgttgctttctctccttcctcctagtaccaacaggccgatatctaatggcaccaacgagtatcaatgagtatcgaccagtggaaccgatagggtatcaactggtacagacggttaccaattgatactaatgagatgctgatggtacctatagggtatgagatctagtaccaaaacgagcatcaattggtacccatgggtatctagatctaatacctatttgatatcatatcgtccggacggaatcccgtggtatagcggtccaaattgtgatatgggtgcattgacattagcaatttttattacaaaatgaatgtggttggttgtcgctctataaaaccaacttttttttagaaatgcacgaaaatattcatttgctactttgatagggtaacaaactaaaagattttatagattatgcttgaaacaaatattatccgttgctcattaatcttgggtcttagtaactcttgaaactctcgaaccttcgtctattaagtgattgctatgggcgtatgcggtatgaacactcagaacattaaagattttactttctttcaaaggcatctactggagaccccaagcttcaagagctatatcatcaaaggttttggtttttctactcctcggtttttggagatacgcttcttaagggtaagtggatacctacaccctacgcaagcatactcatgtttgcttccacatagtaggaatatatgataccgatccgaccttcaacaaatatgaaaaccactatctcactgatgcgcatacatatgtgccatgactaacccaaggatcaaatccaagggtttatatgaggcgcaataggtaatagcatgggattgaacctagccacatggccataccttagttctataatctataatgtttagagctttcttcgatgattgacaatatgcaaatgagtggcaattgaaagaaggcaagagcaaatggtgaaaagtgctatgtgccacatgatagaaaagttaggtcgtaaatttttcatgtgttaagtgccctatgttgactcgatctcttggaagaagtgaagattatatgtcatgcatatgtggccaaccccatgtggattcatgcatgtgtttgtgtgtgttttgtgcatgtgtggtggagatgagctcggcaaatttgaggccatggagaaattacaaatattgatctcaacataagggtgtttttcagctggtgaaaggccatgaatgttagtctctttaaaagcatgggacaattttttttttagagaatggtattttttatctggtctctatacccaaccgaatatatgaagccttttaaattgagaacttagcccctcaaacaactcaatctaaaatttgctcatatggagatttgaactcaggacttggtgtactacttatgtcactgtaaccactaggctacatgcccattcgcaaagcatgagacaataagaacgttataacctaatatagtaagtaagccgatttgtgccacctagtaaggatagagcccatagaaatgtatactccacatagcatgttcctttgattgtgctagtgttaattgttgaatgacttgggcctctctgattgtcttaagttagcaaaacttattatgatatttttctagaacatggccgcctcatactagcaaattagttattttcttggatttcttgtatgaacatgcattcctctcaaattgaaatttattgttttattgtattttttggagcattttggagatgcatgtgccattttcattggtaggtcgaaacagagatatgcacaaaccagacatgaaatatttgaggcattcatgttttatatttcttcatcattatgatttgctccgagatacatacaaagtacctattgtttatcactgttggttggtttcaatacaccccttgcattgcaattgtatgtgccatggagttggtctaaacattcataattgagtgttatgttcaagaaatctcgggccacatcttttcgcttatacttatacttatcaatcaaaatttaaattttcaaccttaaatttgaagttgattttgggtttttttcatcgaagtttatttttcagcctttgcttttagatctctaaaaacacgtatataaaagttttattcacaaattatttttcatttgaaaatataccgtttgagtccgctcgatttgaacacagtatgtttgcctcagcgacatcaaacgatatatagggtttgttcggatcagctagacagtggctgtacagccgcagtgctgcagttgttttagtacaaatttacttggtagatcctgttggtgtggctgcagcgcagccactgctagctcttccgaacacagccataataaaagattttgttggtttttggtaagtaaacaagttgactggctgggtggatttacaatccaactccggctgaaatgattcatatccatatagaaattaagacgaaaatttaggccgagtataatgcacaactaattgtgtactttgcacaacggtaccgtaggaaaattctttgaagaggtaaactattgaattgaagtatgaaaattattgtttggagacgtgaattattggactgaagttgattagcgaaccgattgcatatgcactccgcacactgcattttccactagccacatcgccaccacatcatcaagtccaaagactggacagggccacgagcccacgacgtgtttcaggccggtccttctggcaccttctcccctctgcctgacacgtgggccccacaccatcacccaccaaattgaggccccacaggtcagtcaaaccaaaacccaatcttgttctcccatgcccctttccatggcccaccccagtacccacaaccaatcggagacggccattccaaacggtggggcccacttgtcagaaaatagaaaaaaatacaggaaaatatcctgaaaattttggtgcacaagagcggcgagccgtttgccttccctccaatctcttttctctcgtcgtcgtctcgtcttcccacctctcggattcccgagctccacacgacacgacccacctcggccactctccgccgtcggtggccagtggcctccaccccctccgtcccccggggaccacaccggcgtaacatcagccacacctccggcagatctttcccccgccgcttaattcacctcgtgcgcgcgcggcgccgctcgttgcctagctagctagctcggccgcaatctagtagtagtagtaggaggaggaggagcggcggcggcggcggatcctatgtcgggggcaatcgcttcctcgccggcggctactctcttcctcgctggctcctcctcctcttcgccgcggcgcaggcggagcagggtgagcggggtttggtggcacttgtatggtggcacggggctgcggttgcattgggagcggcggggtttggttcgggacggagccgtcgtgtgctcggcgtcggccgccggtggtgaggatggcgtcgcgaaggcgaagacgaagtcagcggggagctcgaaggcggtcgctgtgcagggcagcacggccaaggttgatacttttcctccattttttttagaaccaagcttgagactgttggcccacgtgtttcagactttcagatcgtgtcattttgatattttaactacttttcgtgatttgattatagtatgcgtgccagaacgtgcaattagttagtgcaaatagcgcagttacatgtagagccatgttgctagaactacagttgcttgatctagcgagctaggagctaattatttaccatttgttattcggaaatgttacctcgctgcactttttgacatgaatttccctatccaacttgtttagtatattccactacccctgtgtgacatttcatttttcaagttgataatgcttaaatgcttataactttgctgattctggttgagtgatggtgtatatgcattcaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtatgcatatctaaactggaaattgggcctgaccccatcatttcccctttttgagcatgaccaatcaggcttttacttttaagcttaggcaatgttccttctaataactgctatcatgtgaaggtggtcttggagatgttgtgggtgctttgcctaaggctctggcaagaagaggacatcgtgttatggtacgtactccttcacatttgtctttgtttgattgtctcggaagagattaacaatctgtagtactagtatatgtgcaatccacaacgtaagagactaagaggtggtattttgattgttatatctgaaactcttaagtctcattcttttgatttgcgtgcatcatggaaaacaatcctcaaattgttaccctgttgtctctgtcagctattaaatgttgtttcacatatttaggagagaagtgtggaaatctatcttgtattcttgttagataacaatttttgagctgtatgatttagcatgcttgagatggatgacaattcttaagatagcatcttaaattgaaatgtagtaggatatgcaccgattgagttcagtggcttagttttaagtgatccaaatataagtggctatttcaattttaggttgtgataccaagatacggagaatatgcagaagccaaggatctaggtgtccgcaaacgttacagggtagctggacaggtaagaaaacattgaaacagttattgtgcaatgtgaaatgaaaagtttaaaggttcatgatagaatctttttttttctgtgtgtgtggttttcaggattcagaagtgagttattttcatgcttttatcgatggtgttgattttgtgtttctagaggcccctccctttcgacaccggcacaatgatatttatggaggagaaagatttgtaagtcccaatttttctatagcttaattgacttacaaataagttccttttaaatcttctgtaaatattttttgcacaattttatcatttgatggcaggatgttttgaagcgtatgattttgttctgcaaagctgctgttgaggtaacttcccattttattgctactagtctataaatgtactccttacagttctgttagattcgcagctcactccaccacgagtgggccacccaggtctcaccaccatcaatttccagtgggactaaacacaataatttcttactacagtccacaattagaatttcgtacaccagctggtcagtcgatgcatatccaagtttcttgcagcaagctgtttatgcacctttcactacttcgtagcaaacagttaatactaaaattttgatgtttgacaattagaatttagtacaccatctagtcagtcgatatatatctgagtgtcttgcagcaagctgtttgtgtgccattgactactttgtagaaaacacaagaacaattaatgataagattttcatgtttgttttagtttatgaggtgaatgagcctgatgttatgttctcgaataagtacaattcattcatctgatgaaacatttgcaggttccttggtttgctccatgtggtggttccatctacggtgatggcaatttagtcttcattgcaaatgattggcatactgcacttttacccgtatatttgaaggcatattaccgagataatggcttgatgcagtatactcgctctgttcttgtgatacacaacattgctcatcaggtttttcacctagtcttattctgcaatttcattcttcgaatattatctgaaccactaatgtacttgttttcaagtgatctgctcaatggcatttgtattttgcaagtgtttctccttttctttaataagggccatacaattttaaacctggtattcagataaagtacaaaattcagttcagagttgtgtactggaatacagcagagtgcacctgctattttaccctatatgtagaaaatataggaaatttgtgtttatttatgacaccagttttgttcttacgaagttgaattagttattgattttgcctcttgaaagataattgactatactactgtcatagtgacaccaatttagttctaatgaaagttaaattggcttctatttattttatgattgcgtttcgcaatgtaattcaatcttgttttcccgcttgtcatccgtgggcatttaccttgatgctaatctcttatagatgtttcatgattttcttctttcagggtcgtggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaacggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcgggctgaaccagctgtacgccatggcgtacggcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaggcattgtcctggtaaatggtggagacgagatggccgggtcgcgggagttatatttgtatatgttgccagctttctgagtttttcaagccagtgcggctcttcagtgcaggttccaagcaagttcagtgccggatgttaaccatgttctgaatcttgtcttttctttcatataagcagtgaagcacagggcttctactgacactaccatgtcatgctgctatttggaactgtgttaggggataggaacaccattaaacaacccgggattcgcgcgctcgtgttaatgtcaatgactaaatgactgtgttccaataattgccatcccaagatactgcacgtacaaggaagaaacacagccggagacatctcagtcagacggccattgcggctgctagctcagtagtaccaacagtagtactctatccgttttacgatataagactttttaatattatctatattcatatatagatatcaataaatctagatatataactaaatatatatatatgtttatggtaatgcttaggttgtgaaaaggagtaagtagttttttttttcgcctgagcctgaccacaattaagcggcctaccaaacacgttaacatctcgcatatattgctcctactatcacacaggctgtcatacgcatgtagtagatcctagcctgggtacctagctagtactggctcgcatggcaccaacacaagtcagccaaccgcgtgggatgcggatatggctaaaaacacaaattgaccacaggtcaacaaagcatccaaaggctcacatggcagccataaaccaaaggcaatacttacccagctataaccatatgcaattatctccgataaaacaatgttacgcagcagctagcagctttgcataaatatcagctaaattcagcgaagagaacgtgccaatcgtaaacagcgccgtcttaccctagatctggaatatgcccatgtccatgtacatccaaagcccgattcaaccagtaacagtgcgcccattgccgtcatggccattcatgtcttaaccaccactgcaccaccacttgctctgctgcctcctcaatcaagtgtctgaaactgcacaagggccaggaagcagcagcagcaatgcaaggtagtagtacatcaatattgcattttgttccttctgatcctaccagcactagtgttcttgacttcttgtctccgactccaagaggcacctcacccgtgcacgatcgccgattgcatgcaggtgatcttgcgttgcgcgccggcggtgataggctcttggtcgccgacacggtggccgccgtggtggagagcttggtgcaggcatggcggcaggtgaggatggagctgctggtgccgctgcttagaggcgcggtggtggcgtgcatggtcatgtcggtgatcgtgctcgcggagaaggtgttcctcggggtggtcagcgcggtggtgaagttgctccgccggcggccggcgaggctgtacaggtgcgatcccgtcgtcgtggaggacgacgatgaggctggccgggcgtccttccccatggttcttgtccagatccccatgtacaacgagaaggaggtaacatggctttcaatcagttctgaactctgccatttccgggaacactgcagtgctctgtcgtttttttcagaagagcaaagtgataatccccgtttttgtcgccgcattcagcatcgtgttcagatttacatgcattaaacatttaaaattttgagcagaaatgcatgattgattagttagcatagaacaggcaattcttggctgtaggattcgttcacgggggtaaccttagctccacctgacaaaaacagtgaacaatgcaggtataccaactatcaattggggcggcatgcaggctcacatggccggcagatcggttaatagtacaggtcctggacgactccaccgacgccatcgtcaaggtgggaccatcgaatcctgaaagttgcccaaccaaaacgaagtaaattttggaagtaatcaactgacaaagtaatctgtctgtgtgttcttgggtcaggagctggtgaggaaggagtgcgagaggtgggggaagaaggggatcaacgtcaagtacgagacgcgcaaggacagggccgggtacaaggccggcaacctcagggaagggatgcggcgtggctacgtgcaggggtgcgagttcgtggccatgctcgacgccgacttccagccgccgccggacttcctcctcaagacggtgccgttcctcgtccacaacccacgcctcgcgctcgtgcagacgcgatgggagttcggtgagtcacctccgctttgtttgtttgttttcggggcaattgggcaggaaagaaagtagcctacgctgctacagcactgaccatggtacggtgtcgttattcgtttgcgccactcgtcgtagtactacgaagataatgctgctgccggttgtcgtcttccatccacagttgattcgaggagcagttgaagacttactgtactgtgctactaataaacctcgtgtctactgctctagtacagtttctgggtagtgatagaagtactccctctgcctaagaatattgtaatttctaagtggatggaacgtatcctagtcagagactcagggctccccaaatcgttttttagtggttaccagttacaaccaccctatgatttggcgattaccgcgatacccatgcggttatcacataccgtggtttcaaaaactgacaaggttaccgcacgtgataatcacgaaaaaccttgaccataatactatacaaactctctatctagattcataatatacgatatgtcccatccatttaaaatttgctatattttaggatggagatgtatgaatcttagccgagctaaacaagatgggcccagtgctagtgtccacatatggcggcctagtcggtattttagagacagacggcccatccacccaggcgatctcaacatctttgtcatgccaacttttcctctctttttttttgcagtggaccccatgtgtcatcctctcattatttttgccgcacattaccaatgttttagctaggtggtgttgcaatgtttgataatcaaccaatgaactaaacatggccgaagctcatatcaattattctaaatttttgaagtatgagagtgcttgtcatatgctgagagaaattctgtttaagctgccttgcagtgaatgctaacgactgcttgctgacgagaatgcaagagatgtcaatggactaccatttcaaggttgagcaagaggccggctcctcgctctgcaacttctttggctacaatggtatgatccttgctcgcctctgccactgcaattgctccttgctttccttctcctctacaagtttttcagaggttttgagaattttatatgctcatgaacgcatccaggaactgctggagtgtggagaaggcaagtgattgatgaatccggtggttgggaggaccgaactacggcagaagatatggatctggcactgagagcaggactgctgggctgggaatttgtctatgttggtagcattaaggtatttttacctcacttcagcagttcagttctaccatgatgacatggcaatccatgaacaaaaacattagcagattaattggataacttgagagtttgcttccaattccaggttaagagtgagctgccgagtactttgaaagcctatcggtcccaacaacatcgctggtcatgtggacctgcactcttgttcaagaaaatgttctgggaaattctggctgccaaggttagtattattttctcaagttgcacagcaccctggaaactgatgcatcgaaactgtatttgactcggagaattattgcagcattctttcttctagtgctagaattacctgaaagcccttatattcttccattgttttccaacgcagaaagtctcgttctggaaaaagttatacatgacatatgacttcttcatcgcacggaggatcatatcgacgttcttcacctttttctttttcagcgtactgcttcctatgaaagttttctttccagaggtgcagattcctttgtgggagctgatcctcatacctacagctatcattctactccattcagttgggactccaaggttagatcagtgctgtttacccttttttgtgtgtgtgtcaccagctactatgatcaaaaggatggtacatctcatgaactccatgtgcttcaggtcaatccatctgatcatactgtggttcttatttgagaatgttatggcattgcaccggttgaaagccaccctgatcggattttttgaggctggaagggcaaacgaatggattgtcacgcaaaagttgggaaacatccagaagctcaaatccattgtcagagttaccaagaattgccgtttcaaagacaggtaaattcttatatgaatataagaatcactttgaacttgatctgtgccatgagttatgcgctaatttctccatctgccggtgcttcttaggttccactgccttgagctattcattggtggatttcttcttacgtctgcatgctatgactacttgtacagagatgatattttttacatctttcttctgtcccaatcgatcatatattttgcaattggatttgaattcatgggcgtcagtgtctccagttagatcaaggcagggcaattgcaagatctgctccagaagcaggatccatgttaaagcagtcaatggggaactcttgtgccttgcatgtgacaggaaagctcaacgctgcggcaattgagggcttcaacaaattgcgataagcatatgggagataagaacacattgagcaagaagaaaatcatctagtattgtcaacgtatttaataggcaagtgctatctttagtgaagagtagcttcgcatcttatgtaacttagcatgttaatagtgacaattatcatttcagagctacagatattgtagcacgacatttaacacctatgaacttcaatggaatacatttacgataacaaaactggaggaaactatacgctctaaacccgatttcaagaagggggaaatctactgccaatgtactaatacagtgtgcttggaatcctacagtacttcgcaattctgatttgtttgtgttcataaaaatgcgctgaaaatatttgcagcagaccaaggctgtgtttagattggcccaaagtttggaatttggttgaaattgaaggcgatgtgactgaaaagttgtgtgtatgaaaggtttaatgtgatggaaagttggaagtttggaaaaaaaaactttggaactaaacacacttcaagaactcactaaagtagggtcaaaagacattgaaataacatctaaattggtcttttcgattgatgtgttgctgataatcagttagagaagggttccaagatgaataaaaactaatagaactgggcgaaacggaaactcaccttgtgggttgagcattgcaacacta

SEQ ID NO: 8591 - DNA, 51651 bp, Oryza sativa
atatatatcggattggaataagttaagttaggtcccttaatttgtcaacgaattcgattttggtctttcaaccggaaaaccagatacaacaggtcccttaattgtcaaaaccggtgcaaaataagtcccaaggcggtttggatggtggttttcgctgacgtggcgcatacgtggctaatttgactcgttcttcgtctcacatggcattaacgtgatgcttacgtggcaatttagttttgaaaatgataaaaacatcgggcccacatgtaagttacacaaaaaacaataattaaaaaaggcggggccaacgtggcccccacctgtcaatctcactcccctcttcttcctcctcactcccaatctcccctctgtccgtctctctcctctctcctctctcctctctcttctctctcgggcgcgacgaccgacgggcggcggagcagagcggaccgcgggaggcggccgaagaaacccacggccgggagcgcgaccacgtcgacgcgccccgtccgcgcgtcgcatgacaccctgggccaggcgcaggcgcggtcggcatcctccgaccacggcgccaataggccccccgggtcggacacccccgacttgaagaccaccagcgcaagtacgtcgtcgttcacggcgtccgctgcggcgaggatggcgacggctggacgacatccgttcggcacgagaccggcgtcggcttcagcctgcatcacctcgagcagcttcgtaaaatgctctatgagtagaagtagcatttagcatcactacatcactattagatatgcttgctgccttttcatgtgcttgacctttgaggtttgagccacacgaacatgttatattcgatccagccaacatccagtcgatcccactggagcggagacagactacggacttgacccggcgaagctgctccaggtgatgcaggctgacgccgacgctagtcttgtgcccaccaacgtctgcgccatggtggactcctccacctcccgctgcgacgcggccgatgggtcgggctcccggcggaaggggttggcctcgagggagaaaacgaggcagtcggcgcggatgggcggactccggctgcgtcggcgggagcagcaacgacgtcggcggcggcagcgggcgctcagaagccatgggggactggagaggggagagagagttgaggagagggagatggggagagaggaggaagaaaggggggctgagaatgactggtggggccccaccattttttattaatttatgtgtaaaactgacatgtgggtcccacgaagttttttttttttggtcgaattgccacgtaagcgccacgtcaatgccatatcagatgaagaccaagtcaaattagccacgtaggcgatacgtcagccaaaaccgccgtcaaaaccgccgagggacctcatctgcactggttttgacagttgagggacccatcatattttctggttgaggaacgaaaatcggattcgttgacaagttaagggaccttaaatgaacttatttctatcggattaaaacctggatgcaaacaggcccgtctccttatggcccaatagggacccaaccttccgctatcctcggtgaacccgaggcacagagcacggtgcgatgcgagtatcgtgttcggacttccgacggaaccgacaagccacaaggcaacggcaacacgcgaccgtcggatcagttgatacggccacgaaacgtcgccgcagcgctcgagatcgagtccgacgagacgacgacgactcctccctctcggctcccgtgccggacgaggacgcgctggctcgatccatggaaaacgtgcgcttcggaatttcctctggtcttttggcgtactcttcgtcgccctttactgatgctccgtactcccttcctcttaaataaaacccattcctaacatcccaatataaaattagtatagtgtgagaataactaaaatacccttaattattaaaaaaaatagtaagggtgatagatagataaaagatattaaagggataaaacttttcgtttgagattaggtagaatgatagaagttggttttttatgggataaaatttaaactctagaaattaagttttttttaagatggagggagaatgccgtagcccatcgcactgtactccctctgttgagtatagtactgctctcttcttaactacacattcttaagaaaaaatattgatccaattgggcagaatcaagagtgtctatagatcacacctgtataattgctcactgacagtatcaggttaacgtcgcgcgtacattttaccctccaaaagaattcagatcaacaccaccacccacggaaaaacaaaggtaaaaaggtacaagtagtattagtaaaggcacaaaggcataccccaactaaccaccatctcacagtccacggcgacgcagtacacccagcaagtgggaggcagagacatcgcaaagatttcaatgcacagtagctgtagcatcatgtgcaccacgccatccgtatctcctccatgcggctgcaggctcgcatactgggttcagtgagacgagccaccgacactcgcacgttgcttgccaccaccaccatccctttcgtgtgagccgagtaaccgggacgtgtggcctttgtgaccgccatgtctcctctccgctactactagtagtacgaccaagcaaggggaagggaaaaaaaagagcccatcaatggcgcgcctgaccggcgtcttcctgcctcttttgtgaatcgattcaagacgccgcatgcaaaagcaaaacaatcgcagcatctttttcccatgccttgtatatgttgtcggttatctcctcagcgaaacctcctgcagatgccaaaagatttacctgtctgcaggacagtgttatctgttgtgcccggtatgtgtccaacatgctgagggggtgttttggaactaggtaacttttagtctctctcacaaaagcataagatagtgtttggaaagtagtgactaagctttaatctctctcacaaaaacataagtccctatagaagagactaaaatttttgtgagagggactaaactctagtccctccttacctaccctagagatttatgtttttagtttagccctctctcccaaacacccctagtttgttcgctgttgcctgaggttggctgatcgatgaccttgcaggattagcaaaagttttgatcggcctggtttgtgcatggcacgttaaattcaaatgctctactagtagtactcctgtactactcaaaacagagtctcttatctttgtcgctaacagcctcgttaatcttacacttgagtgctactgctcgacaacatcaaagaatccaatgggtagctcgctggcaatgacggtctctggtcaaaaattgggtcagagattggaatgacggttctagaaatccgcatcgagcggaaccagattccttgtttcctgaccattgctccgagtgttccactttctggagcccaactacttgagctctgcaaccttgcaggcacgagttttaccggtaagttgatgactggctggagtgtttgattgcttgacggtccgtgcaggaatctctatggctgtgtttgcaaccccagttcccaacccttctccctcgttttttcggacgcacgcttttcaaactactaaacggtgtgttttttgtaaaaattttctatacgaaagttgcttaaaaaaatcaaattgatctatttttgaaaaaaaaattagctaatatttaattaatcacgcgctaatagaccgttccgtattccgtgcgtgggtgataggttctcaacacccaccaccgaacacacccatagggatctgtatgccttctgtatgtaggagtagttctagtatgtgtatcaaacagtaggtgctctccgtatacatagtagtactacgctactttatacagttcatatcctgatttcctggagactggactggattagtacacggtttgagccggatacaaccaatgactaaaatggagcagcctacatacgcgcggatacaattgtgtatcaaacagtaggtgctctccatataatacgtagtagtactatgctactttagggcatgtacagtggtttttattagcggtctctctttattactccctccatctattttttaatagttacatttcatcttaacacacagaccaaggataagtaattctacttatcattcatttaagcatgctactattcattcctcgtaaacaagcgattcattaatatttacatttctcaaagcccatgtagccaatcatgtgtggaagaatggagagtcacgtattaaattcgagaaaatcattaagatgataggttgttggattgaaatatgcctatcaaaaataaaattttcagatttggaaatatgattatcaaaagtagatggagggagtatcatgcaagcatatttggtgacgtggaagagagaggaagaaggaaagagaaagatggttgctacgcatgacaacggtgtagagtcgactcttagcatttattaggaaatttttttattgcattgagtctaataaaggaaagatgactagtaagaaaatattttggtacattaatgattagagactgtaacttaaatattgtaacgtgatagcctctaattaacgtagagactttaccgttctctacttttgtacttgccctacagttcatatcctgatttcctggagactggactggagtagtacacggtttggagtcggatacaaccaaaccgtggatacatacgcgcggatacaattgtttttgccaatcccaaaatccaattgtttacagattggtattgacatttcacatacacgccggcgactgcacatggctttaacggcaatgtgttggtgatcggactcgtgaagtcgtgagtcgtctccccgttgctgccgtcgctccacacgaacaactcctacattcggtgagcccatgacacgcagactgaccggcgatgctgcctattgtcgccgactcgccgtgagccggtgaacactgtacatagccttgacgttgctcgctgccgacggtgcgttgggtcaccgcacttctttctctcgctcggttgaaaacttccgccaacgccgggttgttcatgtccccggcctgcggcgcctgtgcgcgtcgagcagctttggacaccgacgcgtctctcgtagaactcttgctcggcggtctaaccgagcgaacacaggaacgtaatccggtcattcgttttcccttcacgcgcgccacgccgctgtctagtctgtgtgcaacgaccacgcagcgccgtaccgcgcactacgatcggcacaagagattgatgcgcacagcgaaaacgagcagtacggtgcaatgggcctcgcacgagcagatgtacactaggctcgacacactcatttgcacggttgttgacgcagcaagcaaatcatgtacggcggtttcttggatttgtttcagattgtttcagattgtgatacggtggattgaattcaaatgcattaatactcccgcataagagaagcacgagtaaaaagaaattgttcataagcagcacacagggcataccccagatgcctaaactgtttggcacccccaaaatgaggtccggtactggggtccggtacagacaacaaccaggcaaaaccattactagcagaaggccattcccattaggcccaattttgctattttggcgggtgatacaaggcggcctctgtcaatcaagccacagccttaccaccacttccaatccctagccaaaagataccacaaaagctcaactaatggtacttgtaacaaactaccactagcagtgacaccagcacaaagcccatgttgatactaggccaaactacccactaaatactttcccaagaaccaaggcgagactgagtaccaatcataaaacaatggcacttcccagcacggtccagttgggagtactactgcaactaccacgacgatgctcgagtaaaattgagcggaatcagttgaactgggccccgctgaaggtctggccgaaggaccagccacgggggacggcgttgttggagacgacggagcggccgtcgccggtggtgacgcggaaggagagcgcctgaccgtcgaggagcgcggcgctctgccagttctggccccagttgcgcgacagggcctgccacgccgccgagcgctccgacttcacggccaccgcgtgcacgtcgccggcgccgcccacgttggtcaccagcaccaggttgaagtaggagtgcccgttgatggtgaaccggatcccgcccttcttctggcaagccaccctgcactcgagagcacgcacgccatggtcagtaagttccggtagatccaagaaagcgaaacgcgaaggcaagaaattgccggcgttggctactcaccggcggtaggagacggggacaatgccggccttgaagagagcgatgcgctggaagacgggctgggacatgtcgaagtgcgcgcgcggagggttgcaccagccgccgtcgtcggacgggagcgcgttgttcggcgggcagaagttggtggccgtgacgacgaccgagccgggcaggcacgagtggctcccgccgccgccggcgtcgcagcgcacctcgaagcacgcgccgcagctgaggccgttgttgaacagcgccgtgctcagcgccgccgtgttcgtcccgtacccctggctgtagaggttcccgtacccgcacgcccctcctgcacgcgaccaaaaacgcacacgcaaaacagtgagcacaacacgcagatgtaacaacatttcagcacagtgcacagcgagaaaaaaacgtacccatggtgcccgacgcgtcacccccgccgtagaacgtggcgtgcgccgacgaccacccgccgccgccgagcggcgcgtgctgctgcggcccctgtccctggccgtgtccgccgacatgcggcgcgcgccatcgcccgtgcccgtgccccagcccgtggtgccccagccaaagcccacgggacaacgccggcgggagcagcgcggccacgaggacaacagcgaggacgtctcggcgggacgacattgttgtgacggggatggagtcgtcgcacgcgacggggtgcgctgcgacgagagcgggcggaggcgtggagtgtggagtgcagcgaggttgttgggggcggggataaatagaggggtgcgtggtgggaacggtgaaacgaaaggaacgggtttgaaacggcgcggcgcagtagggtggggtggagtggagtgcggcgtaggccgcggcgtacgcgggtggggctcacagcgtgggtgcaaaagctcgcagctgctccggcacgtagggacacgagatttcgggggcgttgggaggcgtggcgggagtgtgaaaaaaaagggatggcgtggtggggtaataaagacggggaagctgccgccgcggcggtgcctttggaagtcgaaaccgagcgcggcgagcgggagcactgcttttgctttcttttttttcgccgccgtcccgtactactaccaaccaaaatcgctgccctccgcccctcccagcttcaaaacctaacgcggtgatacattccgcaaatgttgtcacggcaaagcttccatctttactctaaccctcaggagtacataccctaacccttacgtttggccatacaagtcttcttcacatacctgcactattctaacggagttgtcagctccaggagctgagctacacatccctccatattttaaggcaagggtttataaatggcatctttgactgaaccacgggacaacagtccacacagcagtctgacgggttttactgcacaacattattccctccgttaaaaaaaaatactcaactttcaaaaaaaatttgaaacttttaactttttcatcacatcaaaacttttctacacacataaaatttcaacttttccgtcacatcgttccaattttaaccaaacttctaattttcgcgtgaactaaacacacccttacgaggttgagtttattttttagacggagagagtactcattcacctttattttcaaatactccctccatccacaaaagttacacatattttatatttaagtttttctaaataagttgttcctattttagtctttatgcattgaagacttaaattaaatgaagagataaattaaacatttgattagaaccaaggagtcatctaaatacttattggttggattttgtatcatccaagacgatttaatttcttcttaatctttgtgataaaactaagtaacttttgtggatggaggaagtattacgtaaaaatataatgtgaccatgagtaaaaattaaaatcagttcattctttttacagcgtaagaccctatttagatgagactaaaattttcaagtctctatcacataagatatttggacactaattataaatattaaacatagacaattaataaaacacatccataatcttatactaattcacgagacgaatctattgagcctaattaatctataattagcctatatgatgttacggtaaatattctctaattatggattaattaggcttaaaaattttgtctcgcaaattagtttttatttatataattagttttataactagtttatatttaatactttaaattagtatctaaatgtatagactaaaattaagtatctgaatcaaaacaacacctaataatattcgcagtaactgtgtggcaggcttatttaatgcttccggtagaaagtatccatatttaatcattaatgtactccactctacttccacctctaccggttcacgaagacatgaagtccaattcattcatgggccaattggctaatgggccaaatgggtgtgcttgctgctcacccaacacgaaaaacggagcagatcattaacacgtgattaattaaatattaactattttttttaaaaatagatcaatatgatttttttaaaataacttttatatataaacttttttaaaaaacgtacattttagcagtttaaaaagcgtgcgcgtggaatatgacggtgagaggttgggaacccttgggtttgaacaaacccaaggcctggtttagttcccatctttttttttcaaacttccaacttttatatcatatcaaaaatttttctacacacaaacttccaacttttccgtcacatcatttcaatttcaatcaaacttacaattgtaacatgaactaaacacaccccaaatataaaggcgtacagccatagcggcatagtagtgataactgtgagtagagtagcataatatgtaaatactctatccgtcccataaaaaaccaatctaatactaggtgtgtttagttcacgttaaaattaaaagtttggttgaaattagaacgatgtgatgaaaaagttgaaagtttatgtgtgtaagaacagttttaatgtgatgaaaaaattgaaagtttgaaaaaaaaaattgtaactatacaagggcgtagtcaaaatacgtgggtagtatttccatgagagcattccgtttcaggtgccttcaatgctgaagggaagttctggctgaaccactgtgaatccagcaaacaagtcatgtgctctttcactcgtcagagcggaagaatccaaaaaaggccgagagaccgtgggctgctccgctgcttgcttgcccacaattgtgtaaccactctgtagatcggttggttccgtcttaaatttctccctcccccgataaaaaaaaaatcacaagtagaggaaagtaggaaggcaatattcatttcgtaagatggtggagcctattatgtagttgtaactgtttgctcaataagtggtactcgctgcggttttattttaattgacgctttgaacaatgacacgctctataaaatatatatttaaccttatttttctattataatatatacaataaataaatgcatgtttacttttattatagtgttttgaaagacaaatctatatatgtttttctagtttctttaaattaaatatttttaaagttattgatggttaaagttataaaagtttaatcttaaccttgtccaaaacgtcaattaatatagaaccagagggagtatatgtctacatactatgtaaatgtaaatatattaattatagagtaaattgcacccacggtagattaacttgttaggtgggtgcaatttggtgtaagaacttgagaaatgagcggtcgagtgcaacaacttggctggtatgtgcaatttaatataagaacttataagatcatataaatgcaacaacttacaaggtatatatgattttgatacaataaattaagaggttatgcggcaacttaatagtatttttttatatagattcaatttttaagtacttattttgacagtatactaacgtgtatttgtataagcatatttatatttttatcctaataactaataactgaaagtcaattaaacaggatatagaaattattatattccggttgatatttgagaaggtcaagaaaaaaagtcttaaaaggtaattggatgtaaattgtatgtgcagtataattcttaaagattaagttcaatattataaggtaatatccgtaggattactatgtaatggcatattgacaacgtggaaaaaattcacctagcatatacttagcaaagttgatgcataaaaatactaaattatcaagttcttgtactagaacgcacacacttatcaagttgttatatttggacgtttaattcttaagttcttgcactatatcgcacaaacttgccaagttgttgtactacgggcgcaatttactcttaattataaaacaggagagcttgtctacatattttcacccaaaaaaaatcaatcagatttgcaacaatgtgataataaatgtccttcgtagtttatatgtagtcatttatctataagccatttttacaaaaacaaaaacaaccaccaaccacctacaccaccagagtttaccaaatcgtgcggttataacgtatgataacattttcggttttactaaaccacagggtggtgataatcccaccctaaatagttcggtaaaccctgaccaccacacggagcctatctccaccagaccaccttacagacgatgcaacaccactgggtgctcactcattcccttcattcctaacaatacattaggtgcaaccctctgtgtggtctttcgtgccctctcgctagcatgctattcacataacattatttatttttcatgtccaatctcgttcgattccagtgtttttcatatgttccacttaaactcacattttctgttttcatatattttttcattccttgttcaggtcagaattatgtgattttcttattattccttttgtttcattctgcgattcaaaggggcatgagtagttatgtctcaatcatacacgagctgccaaagcaataagctttggtttttttttctctagaactatagagtagaaaaatttccacatttttccttttcctcgttcctatgaatcaatggtacgagcattgatttattttttaaagaaaacctctaaaaaattggcatagagttacatcctctatcgtcacggaagaaaaaaactgaccaattttattaaggaaaaacttgccctgcagtcatgcaactgtgaagttaattggtgagtaatcgccgaaaacctccacggcgagaacacacttcgaggcggcaagccaccgcaactgatgacccaagaaaattgagacacatcacgagtcattgttgccatgttttaaagtcaaagaccaagcaacaccgactttcctacgttgatccacaccctccacggtcaacaaccgaaaaaaaaaatcagcaaccacccaaagcgctactccccttcgtctaaaaaaaaaaacaaaccctggtttccgtgtccaacgtttgaccctccgtcttatttaaaaaaattatgaaaaaaattaaaaagacaagtcacgtataaaatattaatcatgttttatcatctaacaacaataaaaatacgaattataaaaaaaaatcatataagacggacaattaaagttggacacggaaacccagggtttgtctttttttggggcggagggagtaccttctaaggccgaatttagttctaaactttttcttcaaacttttaatttttccatcacatcaatatttttctacacacataaacttctaacttttccgtcatatcgttctaatttcaaccaaacatccaattttagcgtgaaagttagaagtttatgtgtgtaggaaagttttgatgtgatggaaaagttggaaatttgaagaattattttggaactaaacacgtcctaaatgaaacttctagagaggacatttgtcaactcttgctccgaacaccaggactaggttttcacccgaataaaaagggagaagacgacgttcatatgcaccaacatctatcgtcgacaccaatcaaaactaggacaagattttcacccaatgtacattctcacttcctgtcatccatgccctttacaaagtgtccctttgccgtggctagaatacgaggaattgaaattatcgttgtcaagctcaccacaggtaccatctttggttgcatactatagttgttctaataagcggcaactacgctatcatccgtaggatcccgattcctacggcatttccttcctttcgaaaagactataagaccattcacagtgcgtctatgtggcattcaacccccgactagtcacctaggagattcccctccacgtaggcaactagcgtggtcctagaaataatgattaccgctatgaggaatgagtagcattgtcagagaaagcatgagagtaagtagaaaaaaaacacaaacacacgtaagagagatagagagagagagaggaatgacgtagtgaagtgtcgcagacgacgatgccatcaccgccgagctccatgttccatcaccgttgggcaacatgtttatcgccgcaagctccatatccaccgtcgccccctcgatctacaccgctgaagaataaggaggcttcctcgtattggatagcttgcataggcgacaaggaacggcgacaactggagttggaagctagtggagggaggaaggcaccgacagtaggagggagggataatgtggcgtcgacaccggtggatggaggaggggagaaatggtgccatcatcgccgctagctggatgcaatggcaagaagtgaaaagatcaggtgaggatagggcgtgattttatattatttatagattttagggtgttgagtgtaaaattttataccactatatgtatatatagtagaaaacagaaggggttgaaatgcaaaaatatctataggggtttaaggctacgttcgttaggactggttttaaattgcatcactgtcactgatattggtagcagaagtaacaaaggctgtgtttagattcaaacttctaactttttccatcacatcaacctattatacacacacaacttttcagttacattgtaccaattttaaccaaaacttattaactttggaagtaactaaaaacagccaaaattgccatgtcactggcccgcgtcttctgataacgtgtcaggccctgacgctgcaagctgcaacagcaacaaaggacggaaggagcacatgctgaccgcgacaacgtgcatgccagcatctgcgcaaaagatcatttgtccaacgcacacaggttccgacggcgaaaacactggaccaggagtccagaagaattcaacatgcccaccaaacccagattacggggatcactacccagttgttttgccaacggaaatgcgtcggccgtgccccgaactgataaaaaaccactaaaccaacgacgaataatttgaaggtctacttcacatcaatctctacctcttcatgcccatgccttgtttggaacgggaatagtactacagattttacaaattttcgcaaggggaagcagtaaagggtgccgcagaaacgggatgacgggccctttggcagaaacgggagggggacccgtgactggcccccagcaccggcacaggcgtagtgaatgcacggcgtactacgagccaaaccatcgttgctcacacttggcgcgtatcctcggggcgggcacatgcgaggcgcagcgccagcgcgctgctgcaaagggacgcggcccggcggccgcgccatgtgtcgcgcgggcgaagcaggggaacgtgcaagtgtcctgtgccgtgcgtgacacggggtcccctcgccgcgtgccccacggtggtcacctacacttgccacgtgccccacggtggagtaactaacctaactgaactggaatgaatgctgtgggctggtggtgaacacgtcgcacatgcacgcaggactactactacttttgcaccccaagttctagagcaatggtttggtgtgttcggttcacgccaaaattagaagtttgattgaaattagatgatatgacggaaaagttaaaagtttatgtgtgtagaaaaatcttgatgtgatggaaaagtttgaagtttgaagaaaatgttaggaactaaaccatgcccaaggttaatagtttcggcgactgttggcggcaaccgagtgccacgtcctctaatagacaactaatctacaatgcatacaacaacaacacttctttattttttttaatcgagctagtgcctactccgaaggaacttgcccagtattttacgtccccatttatttttccattggttgttgtgagagcaaatgggcccatggtaagtgaaatgtagaggctcgcgcaaaaagccggcgactaaatagttgctcacttttctctctccaagttttctttcttggccacgtatacaaaaatcctatatgtaagcaggctattagcccattgttgtacctgctcttatggttcacaatcgacaatttgaagagttccaagctgcaagaaatcagcagacaggacacgggcccagcccaacagcaacgaaatgttaacagaaaaggcccatttaatatcttcgaggcatccagccatttctgaagaccagcccatctaacgtgtggcatggaatattcagccttggaaacctagcgtgatactgtagctcatattgctgacaaataacaatttacacaattagatggaacaacgaaaggagaggaaatatcatttacatgctactccataaacatgggggctgaggataaatgcagtagacaagcgagtcgtgttcaggtccaagctcgagaacccagcatccctgatgatttcgcctgtttctctggtgaggtggcacccgtcagagacaaactgctgcagaggattaagggcaccttgcacgaatcggaggaaggatccatctattgcacggggcaaaaggagaaggagagtcaataatgcacaacaacagaaaatctctaaacagaaatggtcttaagccatttgtgtgtaaaatgtgaaagagaatagcaggtggtaccaggcgcagcaacatgctcaatgaatatgtagagaccaccaggcttcaggactcgttttatttctgtacaattaaaggctctgagttgtttagctagaaaatgattattataatttaatatagatgaagtttgttgtctatgcaaggcaaaaatgattatgccaaaattcaagagatgcaaaaatattgtggaaatatacagacaagaacagatgtcatacttcagttatgtaaaaggggatgaagagtttcacttctttttcagataatggaaatagtttacatttacggtgaagagtttaacacaaaacggtaaacttcagtttaaacctttcttagcattggatggctcgagttctaggtaacgccaatttcttataattgggaaaacacaagacgaagagtatgaagtgtaaaagtatccgacacatcatattaccttgttcaataatgtgcatatttcaagcccagtgacagtgagtgcatttatttttttggatagaaaatcagtgacaatttcaggtagctaagaaacaatagtaaaattaaaatattcttgataataattttatggaatattttaaacatcttgcctcatggacatatctaaagattccatatgttgcaaagctttgcagaaattataaagagcatttgtactcagataagaaatactgttgttagaaaagaaacaactcttacctctcaatgccatttcaacgtcacttacagaacacattaccagagtgccaacaacagcatccattgaattgtcctcagctggcaaagcttcaccaacctaaatacaattacgcatcaaagatagttcacagaactaaaaagagaaatagtgcgctaccagaaggcaccatacccctcttctgaaggtgaagttcgaaggtggaagtccagcagacactgcagctgctctggcatactcctccatgtgtttattaggatccaccccaactatgttaacgccatcggcatttgcatagtacttgagattagggcctgttccaacaccaagttcaagaatgttcttcccagcagtcatcaattgggaaaagagctttgatttatactgtgcaatctgcaaaactcattattgtgataagatcagcatgatcacggcagatgatcaaaatcacatcacaatccctgagaaaaaaaacagtgataactttttttaacagggaagctaaaattactgatgaagatttaagatcatgtctgctactcgcagacactctaggtgcttacttgtgaattctgatatagtgatatctatggaaaaaaattcagatactaagacaaattaccgagttctgaaaatcaaacgttagagcttatacagattaacagatatgtgatcgaaatggtcaacatgtcatgtatggaaaaaaattaactctgatgtcgaattgggcaaactgagttgagtgagcactgagcaccaatacagttgttcgtatagacaaaaatctactagcaaaccacaagtttcagaatggcagagtagtggaactgaaagtctgaaactaggggaaaagcaaaaatacctcagcctcgtaaggtttcatgaacttgtccatggccgtggcatagaacttctcgtaccactccggcctggcagggtgcacccgctcaagcatcacctgcacaacaaccaaaaacccaagtacgggcagctcagaagatggccatgaagccaccaaacatggagggcctcatcagggccagggccggcaagaagcttacttcggggtcgacgggcgaggcggcgggcgacgggagggcgagcagggggaggagagcggtggccgaggtggagccgatgaggtggcgccggccacagcggcagaggggagggagagcagcggtggtgcacacgcggctggttttgacggtgagggatggccggctcccgaggccggtcgccggcgtgagcgcggcggcgccctgctgctgcatgccgtcgacgagcggcggaggacgggggcctcgtctttgtggtggcctctcgcttcggttggaaattgcactttcggaagcgaggaatacgtcagctgctgtcgaaggcgtattttcgggtttacttgggattggcggaatcaaagcccatatatatgtaggagaaggataggcccatcaacggatcaacgtgtgtgggctttcttcgtgtgtaagcaaattttgaccagaaaaatcgccgcgcccacttcttccgatctgagtaatggagaacacggaatagtttgcttctctgtctgcctctcctggagctgggcaccctgaacaatagaacacagagtttgattattctattctctctatgtctctgcatctctatgtgcaaactgcaaacacaattttgttaggggcaaaaggccaaaaaaacacgcggattgctattcgggccgtgtttagttgttttgggaaaaaaaattgatgtatacggactcacatttgaactattaaacgtagactaaaacaaaacaaattacatattccgcctgtaaacagcgagacgaatctattaagcctaattaatccatcattagcaaatgcaaattaggctcaaaagattcgtctcgcaatttacatgcaaattgtgcaattggtttttattctgtccatatttaatgctctatgcatgtgtctaaacatttgacgtgacgaaaaagttgaaagtttgaatagaactaaaacacagccttggacgatttttctgtagtttttcttcggccggattgataaacgtacgttgaccaaagcaggtgtgccaactggaagaaggtggttttctcctgcatgtttgacgttttgtcgacggagattcacctacctggcaatttctcaggtgccatcaaggttcagtatctgcagcattttgctccgacggaccaggtcatgctgtgcaagtttggttcgtgtgatcatgttggttatctgcttaactaggattatacaaatcttttgcacgtgctgttatagcattacattgagtaaattaaactacaaatatttttgtcaaaactattactcactttacttcaattagacatttcataaggccgccataacaataggtactatctaataacaaatctgcagcttttaccctctaggtgtgtttgacaagtggactacccaattaccaatttgcaacaatgcaagtattacatatgcgcctggcaggtagaagttgacaaactttgcatttctttgacaaaaatcattagcaaatgatgcatttttatgagattacattgaaaattgtagcaaagtgacagttcctacgtattagttcggtttctaaattttgctctattatatatcccttgttttatttactgtagcggtactttctccaagtaggggtaaactaactcgcgcaagagtaggcaaataatgagtttctaagagcatctccaagagaatggccaaataaccctccaagttcaattatagtaagtttgagagaagaaaaaaaaacactcgaacaacctctctatcctgctggccaagccatcacgagtggataaggagagggaggggcggagtggtcgtcattatccactccactcgcctcccctcctctctctctctccctctctctctctcactagggtgtcgtggcctgcatagatctgccccaaggcagtgtgaggcaccgaggccaccgcgcgcgaggtgttactatgggtggtgcccatggaggagacggagtggtgccggcggttgggtggatccgatagtgaccaaggttcgtctgcgtagataggcggattcagctgcgaacatagcgtcggcagctccccgcaggcggtaatgatggagaaagaggcttgcccctcctctccatccggtgatagcagcggtggtggtggagaaggccaacgtagaggcgaggtagtggccaagaaggaggctctgttaggttcttttagtgtttttggatgtttttagtgttgggtttgttcatgtattcttggatgttcttgaatgccgattgatatttatggaatctgatcggggcgaaggggaactgctcaatgcatcggattgatcgaaccgacttttttattttttgctttcctgaaacttcaaatgtgtcggttcttaaatcgaggtgttgcacgctggataccgattgcgaaatctggcacttataaccggtttcgaaccgacacctaccccttttatgtagtagtgtcctccttaaacacatgttcgactgaaactaccgaacaaacacatgtcgtgtgtgaacttaaagagatggtttaggattctactctggatctgcagaagtgaagaaaaaaaatattcggatgacgggaagagcacatcagcgatgagcctgctctcccagcctttgcccggctgtccggctggaccgccggagcttggccccatctgcagtctgcctcctccgctactgcagctgcttcactgtcgtctgcttgtaccgtttcatcaaacctgacaggaaaagaagctggagacgcaaaaggcgccgtaggtttagacaggagctgcacaactaggtacgtactatacatgattcgatcataggctgcctgccagctgaccgagacgtgatacgtgtcggaattgcaagagaagagtaccgtctctctctccctttcatttgggtgggcttcgtcttcacaatgccatttggcggctgttagtactgtgaaaaaatagtgatagagtgatactagtagtagctgttctatacgcgcgtacagtatcatatcatcgggcagattcttggccagtgcaagtacggttcagcatttacgttggtactccgtcttttacggcagagtagtacagtgtcactgtactggtattctggtactggtactaacacatgggatcttcacaaatcacaatcattgtccctgtacatttattcattatattccccatgcatatggtgtcaaggttcacaaattgtgctcctaagctagctctcaagtggtacacataatatactagctagcaaaccgcattaacataagtgcctaacagtagcattgtactacgaaatactactccctaccaggctaccaaagcatgggcgatggatcgtaacgttgtgaagaatctccggcacatcatttcaccgaaatccgggctgcatccacggcggggcacacacgactaaacgagccagccagctacgacgtgcgcgcgatgcaagcgcacggcgcggccgcggcggttcacatgcgcgacccgagcgagcctcaaaagcggcctacccatgcgcccatgcaaagctagacgccatagcccataggcaaatggagcagcggtgtgtgtgtgcagagatctcactctcctacgtacagtaggtgtactagacctgtcagcgtgccgcggcgtcaaatccatgcaggccagggggccgtgcggtgcgtgtcgcgctgcggcgatcgaacgtactgtacgctaaacctgcgatccatcgaatcgtcgatcactcgttcacataattaaaggcacatcttttctcctttattatagacacccaccaacctcaccccctgcacacacagtcgatcgtcacacacaacaactcagggcttgtttagatcccttgcaagttttttcaccctgttatattgaatatttggacacatgtataaattattaaatatagaaaaaaaatgttatacaaattgcttgtaaattgtgagatgaatcttttaagcctaattactccataatttgacaatgttgggctgcagtaaacatttgctaataaagaattaattaggcttaataaattcgtctcgcagtttacaggcggaatctgtaatttgttttgttattagaccatatttaatactttaaatgtgtatccgtatatctgataaaacattgtaaaaattttcacccctaaatctaaacactgccacagattcaaagtgacgaggaacatacggtgatcgatgcgcggttggactgatctgccccgtgccctgtactaacggcatataaatacagtctccatcgattcgaagctcgcgttgcattcagcgagcatttgagcttcttcagacattgcccggtgaatgagagagagcttgtcttcctactaggtcgactcttcccgtacgtgctggacttctactgctgctggtggtctgcagcaatggagctagtacggcatccaccgatgattcctaggccgcagtggtacgtacgctcatctcaggtcttgcatgtggagacgaggtgtattgctggttgtgtagccaaggatgacttgccggcctggtttgtgttcatcagcaatccagcatatgctgtattgccgtgtgtgatcgatcgatgcatggaccggcaagttattttctttggctacattacaacctcgtcttctcatgctagacctcaagatgatacacatgcatgagtgcaggatcagatgcagcgataggatatgatgtcggtgctgatcgagggcactacttgttcggtgatctctctcttaatttctcgtacactagctagctaagctagttcttccatagttccatgtctggttcaatgcaattgcactttcattctttgaggggagggggttgtcgatcgagaaggactgatcgattgcagatttctaacttgtgtcctatgcttcacgtacgtcgccgatcttcgtatcacaaatgtttagattgctgcattgtccatttcgtgtctagcacatagtattagttcagttttgaaccgattattaagtaacttttgcatagtgtacacaactaaaaaaaggggtacaataatatgcatgaactaactacataaactacactgaactaggacgatagaaatacaagactaattactactccactcggtcccatctgctgtcatatatatgtattttttcttttgagtaattttacagttcttgacaaggtatcatgagataccactttttctattataaatttgatacctcttattacctatgtattatgagatatcaaattttacactaattttttgttatcttatagtacctcctaaaaaactgtaaaattcctatttttcttttcagggatataggctttcatattggacaaatatctagtgaaacattttagttaataaatactgaataaacatcatagtattgaaactttaatggcacctatttgtatccacaggaaatcataagttcaaagtataaaaggagtatgttgataacaaattaatctgataactttaaaacattgagtacaaacgttttgcatcaattaacaagtgaaaaatgtggaaacaagtgatagcaagttaatgtattgaatggtgtacgttcagttaatacactgaagtaactgactataaggcacgtttagtgacttattagggccagcatgtttgaatctctaatttgatttatctttttcagcggcatgtaaaaatgagataagcaataatgcacataaataattcagtatcaattattataaactttaaaataagtttatctgatttttcaaagaaatttttttatatattttttaaaaaatatcatttaacagcttaaaaaacgtcctaattgaaaacaaagaagttgttctctgaagttaaaggaatgaacacggccagaaccatgacaaggacgtcgtaaatgcatactcctactaaataatgaagtactcctactacatcttttctttcagagtccaaataatgaagtactcctactacatgtttatgcatctgccgatctgcgttcatctgtgttatcacaaagacaccaaccagtacacagtaggcgatcataccagtatcctgtgtgggatcagcagctagtcctactccttgcagctttgcgcagcgaccagtgtactagcacagtacatcgcctgatcgtttcagtctcgatcacgccgctgctgctggccggtctgttcgcgccgtacgcatgcccatctgctgctcctgcagccctactccggctcgccgcgacctcacccgcacatgtcgggagcgagccgatcacgatcgcttgcatcagccatggcccagccgattcaagcctgtcgagagacctgtgtcgaaataactattgttagtctctgatgactgatgagctgatcgacggaatactacgaagttctgcaccctatacaagtagtatatacatgtgctacctactgtggtagtgtggtctgtactgtacgttgagtgcagactgattgctgctggttcgcggcctgtagtggagcagctcaagtatgatcagcggttcttcttcctcgatcgaatggccgtggccgacgatggcgtccaattcccagcgcgcgaccaccagcgcaagcaggccgaactaacggagttttttgggccagtccatcaccgagcggcccggtaaaggtagcccataatcgctaccattctgtactggacccaaataaagttggcccgacaccgtgagagccgacagaacgaaagcatattggatcgccacaatttggttgcgatctgacaaaacttccgtctccacagggcacgtatatccaccatggtgtaggtctatatcagtcgatttacacaatttatatattttggaagcaatatccaccatggtgaacggtacaggttctttgattaacatggagtagtacattccttcttttagcctacactacaaatgcaatataatgcattcatgcagacggagcacctatttgctttccttttgagtctgatgccaacatttacaggcgctatcaggcaactgtgtatcttgctattacacagccgctctgtacggtattacagaatgcagccgcatcgcgccatgatcatgcagtcatccatccatgcgcaatctctcattcatccatcagtttgtaagctgctcctccttggctgcttcctcgagttctctgagccctccgaccctctgctcgatctcctcgagtagctcctccctcaggagctcctctcttgcagacgcctccaggtcctcttgctgcagaatcaaccatgggagagtggagatcgatcagcaaaatgactggttatcttagtagcttcgcacaactagagtttgtctaattgtctgaatgttctttcttcgtgataaaggaaaaaaaaaaagccgtaatgaaagacatacccggtcatagtaccagtgcacggtgccgtcacccccttgtcccctgtacgcctcactgtcgtagaaaggatcctgtaaattcacacaagaccgtgtcagtaacacatatcgaagatgtaatttcgttccaagttgtagtggcatatgttctgcgtgcttgccttcatggacgcaaagaagcagatgccccagactgtgaagaaggcgtagaaggtatctacgagacagacagagaaatttttttgtgaaaagtttcagtttcagacgtaacaacaaactgcaggaaaggtgaaacgacgacgacgactcacagacgctcttgagggcggcgtcgctgagatgccagatcgacttgtgcacgacgtagtccctctgcaggtcgacgtgctccaccatcgtcaccatcagcgtcaccacgtccaacggggacgcgttcgccttcactgaacccctcccggccgatttctgcaaacgctaagaccgcattactttgcctcaccaatcaccacggatttcttctttctcggtgaaaaaattaaaatgcactgggacctttcaccttgcaacggctggagttggacctcgggtcatggaatccaccgagctgcaaatttaacaacaacatttgaacaagtaggtgaaattcgcaaggaattcaggaaagcagtttttgcatgaacgcgaaggggagaatggacggtgcggtaccgttgcacggcagcggccatggagctgggctctgttcgcggagtgaagagcagagaagtggggggacgacttgagcagcggcaacgccattgctggtaggctgctgcttcagtagcgggttggcgatgagcttgttgttgtcagtgtagcgggctcacgtttggctcaggggtgaaacctgtaacctgtaatctgtatggaaaattttagtggataaggtcagacttttgggtggccaaccattgtctgatcttgggcagacgaaaagcacaagaattttgggcttggttgaagcgggcttgagcgttgctaggccttgcccggtcaaggtcatgtttgggccggatgggattaggttgacccgtgggctcgtggcccgttacgtgcatccgtccgccatttcttggagggcgctacggcttggcgtccggcatctcaccaaaaatcggacgcccatgcaggcatgtgagaacgaaccctgtcactgtaacgtatgtgtctaactgcttcttttcattcttttctcctctctttagatattttttatcctaaattacttatccaatttacgatccgatcacaccgttctattcgttgcaattaaatctttacaatgagatatcacatgattatattatgtcaaaagaaaaacatgtatttcaaaacgttaaaacaaaatgtttcgtacgtgatagtgatatgtttcaatatgtgtcatcggtgtgtttcacaaaattcatgaaactaactgctactactctctctcctctctctccacctcatccatgcacacatgtatgtattttagcaagcttcaaaataatttttctcttaaattacttatccaatttatgatccgatcacaccattatatttgttctaattaaatctttacaataaaatatcacatgattttattttgataaaagaaaaatatatgtttcaattcgttaatacttgttgtttcatatgtgccagcgacatgtttcaacgtgtattttcaccatgtttcataaaatacttaaatgtttcggttgttgattttttttgtttcaccatatataacataatgtttcacttgctggtcaacgctcacccccgcactgccgcgcgcatacgcatgcatgtaggccgcccatgctgcattgttcacgtgccacgttgcttgcctcccctgtatgtgttgcttgcgctgctgcttgcatacgctccctccctctcccttctattattacatgtgcctaattttttcctcaaattttaaatatttttttctccaaaattatatattctgatctaaatttcaatgataccattagattcatcatcattaaatctttataacaagatctcacatggttatattttgataaaaatatacatgtgtctcaaaaaataacttgtctcaccattgatagaaaactgtttcatcacatgtacacaaatattacaactcacctcgtgaattgtttcaaatttagagaaatacaacaatttactaactgaaacaatcacaaccactacacaaaacgttaaataccaatgagtgaaacataaaaaaaatcatatgaaaaataaaatatttttgcacaaatacttaattatgttgaaatatttttaaatcggacgctacaaatcgtacgttcaatattttttcaaatatcggagcctaccaatcgtacgttcaatatttttttaaagacgctgctcctcgtttgtatgcagggacacgttgaaggagcgaggttgtcgcatgcatgcatgcatgcaggagtagacctggttgccaagatgacgtgaggcatcattactctgtctctcttaatcaaactttaaacataattttattctaaaatatatatccaatctataatttataacaagatctcacatgaatatattttgataaaaatatatgtgttctagaaaaaaaacaaacttatgttgaactatttaaaaataattctttcatcacttgtggagatgtttcaacccacttcacaaactacaggcatagcactaagctcggcagcccatttttgcaagctgataagtgataaacacaaggacgcaagctccaagtgatactttcacacattggaaaaaggtccaattagcagtacggagtactgaacatagaacaagtctagctgatgctgtttatgtcgatggagcaagcgacagttggtaccaaccaaacaccatgcaccggccggtgagcgcggggcacgcatcatgccatgtattactcacgtcacaatcacctaaccccacacgcgctagtttcatgggtgcctcggccctgtcccttcctgtatactatctccgtcctataaaatacaaatttaaaaccgtatatattatattctaatatgatatatatatatatatatatatatatatatatatcagattcgtaatactagaatattacactttggcacacagccacacaagcttgcaacaccaacacgccaacacgaacacgtcgtatatcctgcttcatcaagaacagcgagtctgcatccttcaccttcgcttgaactaattaagcgtcaccaatggaaggaaaagccgcagtgacgacgtcgaccgagcacggcgacggcgaggcttcgagaacggcggcccgcaccgtggtgagcggcagcagccgcggcggagcggcgagcagagcgctgtccgtggccgacctcatcctccgcgtcgtggcggtcgtcgccatcgtcgacagcgccatcgccatgggcaccaccaaccagacgctcccgttcttcacgcagttcctccggttcaaggcgcagtacagtgacctcccgaccttaacgtgcgaccattcttgccttctagctacaatcgtcaatctgcattacttccgtttgcaagctcgtttattccttcctgttgtcaccaggttgttcgtggtggcgaattcggctgttactgcgtacctggtgctgtccatcccgctgtccgtcgtgcacatcatcaggagcagggcaagttacagtaggctggtgttgatcttccttgactcggtataaatcgatcgatcaaaacgtaaaatattactgaattttggctaatctgggggggctctcgtgatcgtgcaaaaggtaatgctggcgctggtggcggcggtcgcgtcggcgtcggcggcgatcgtgtacctggcgcacaagggcaacgtgagggccaactggttcgccgtctgccagcagttcgactcgttctgcgagcgcatctcaggccccctgatcggctccttcgccgccatggccgtgctcctcctccttgtgctcctctccgccgccgcgctggcccgccgctgagtaataagaaaatcaaggttgaattgtgcatcgcgcggctgaccgggagagacggtaacatcaatacatgtggctgttgctggttgttactgtagttgttaccgtgtcgcctgtgtatcaggagattcagagtccgtgagccgttgtcgagtacgtacgtgccggcagagaccggtgccttgctttgaaaattcagtactccaacatcgagtgcagtgacctgtactggtttacaaattttcaattttaaactcatctgcacaatgagaaagcagaaggtattattgatgtgcggatcaattttggacatacaactttcagagtatgcagacgcatactgttacaatgttttccgaatcataaatacatatacatgtgatgtctacataatataaatcgggcgtccgatttttttttatatatatatataaattgtgcgttgtttcaccaagtagatcgaaattatttcactaagtagataaaaaatgttcattttttaatattttaaaaagctgaaacacaaccaaatcatctcgtgaaacattttactacaacgtatgaaacaacggtttccaaaaaaaccggacgctatttcaccttatataaaaacaatgtttcagcaaataacgaaaggatgtttcaattaactgcaacatttcattcatacgtagtgaaacatcacaagtacacttactgaaacattattggcggaacaaaaaatgaaacgaatttcattaatagagcgtttctgtaatatgtgggtgatttgttgtaatgacgcgtgtggtggggtgtgtggtggggacgacgcaggaagcggtgagcgcccgatttttcttccgctgatcgagcgctcgatcggtgccatttccgatataaatcgatatgaaaacatgatatttgatgagtgagagccctcagggccgatttatatatgggccatcccatggtgggccggttagttctgttcctgggccatccacgaaggtcatgacttgggcctaaggcctaaaggagttcctccgtacgtgaacacattttactacggtaacaggttacaggctaacagccaatcaagttttggattaaacggttaaactcgactaaattacccgcgctattactgtaccgtgcgtcgattcgcttacctcctaatacacactgacggatgggccttggatgcaaaccggacccacatgtcactgactgataagtcgatcccacccacatccgcgctgatgttctagaacctttcgtaaacctcctctttctcatataaatcgggcccaaacgaaaactcccattcctccgactccaatccaatccaacgcttccttcctcgcaaagcctctgcgaatctcgcgcacgcagaaaccgctcccaaaccctagacgcaatggtggtcaccatcgatctccgggaggtcaccatcgatctccgggaggaggacgaggcggcggcggcggcggcgatgaaggccatcgctgggaggagcgacgaggaggtcctcgcggcggtgctcgcgcgcaagggtggccctgtcccgttcctccaggcggcgatcgacgccgcggcggcggcggcgacgaaggccatcgctgggaggagcgacgaggaggtcctcgcagcggtgctcgcgcgcaagggtggccctgtcccgttcctccaggcggcgatcgacgtcgcgcagcggcgatccgacctgttcctcgacccctccgcaccgggggtggtggcggagatggcggtggaagcccaggccaaggcggaggcggaggagaggcggaagagggcgaagggggagccgaggaaggcggaggagatgctgaaggaggaggagccgatgaaggcggaggagatgctgaaggaggaggagccgatgaaggcggaggagatgctgaaggaggagccgaggacgccgatgagagaggcggggagggacaaggtggagagggcagcggtagtggagcgcgtaagaggtgggtgatctcgcaccgtgaccttctaattgttcatcgtgttcgaatgcgaaatgtttgcgtgcttcggtgacctgtatgctcttattcgattatagattgtcatttcgcctgttgatctctacctcttatgcggaattgggggcagatattgagtttgaatcagcaaatgtgctttcccatcttgtgccaagctagggccacttgtctagacttcgatcagttttcgatctgtagtagatctatagtggagctataatcctcagatttcgaggttgcagatatggcggagtataaaattgccatgtagtagttttttattttcaggtccgatctcatgttgcacattggtggctgaagggagtaaaattttgatcaagtgcttactaattagtctggataaatcttaacattaaaatgggtggtggttctaggcatttatggcacatacagattatataaatccttcaagatttgcaagtagtttggtcttgttttcaacttatcaaaatttccaaatcgccatgatatgtttggttgatttaccgtgatcgatttcagatttatctcaccgcatcagtattcgtagagcactaaatgtgtagaaacaagaaggtccaaagtttggcagtagtatagtggttgcaatcagtttatatgcatctcgctatattttttttgaaaaattctctgtggattttcatattgttgctttaagacaatagattctgtactaagctgtcctcacgggtctaataaactgaatttccatcataatcgatctaattattgaggtttcataatttttactgtacatttgaatttcaaggtgaatcatgccttgcattttccaccttttgatatatcatttgctgataagtgtgattatacatgttatacctagtagtacacttttagattctgtatttcctgttcagtttgggtctgctgcttttgctaacttattggttgtgatttggaatttgtttctatctttaatacaaagatctgcagcctttctactgttctacatgtgtttcaaaaaggaatggttgtgcagtttataaagttgaaaggctactatgtgaagttgttattgtactggttctctattaatgggaacagcaacatttcaagccttcacatataactgttggatcatttgatcaatatcatcactcatcactagcagtattttttactgtgtttggttctcttacgttttctgtaattcgagtatcaacaaccgttgcaattttgtactgtagagagctcgctaccttattcctccaacaaaatatatgcgacatcctaatctttcgacttatagacaggaagtgctactgcattattacgaaactaaatgaatttattgtttctttaatcgctttgattgccaatttggagttcagtgcactgaaaggatatcctccttttgtattgcatgttagaccctaagcctaatgctggaaatggtctggacttggagaaatattcctggactcaggaaaggccagaggttaccataaccattccagttccccaaggaacaaaatcaagtcttgtcacttatgagattatgaagaaccatctgaaggttggactgaagggttgctcttttataattgatgtaagtggatatacagaatgttttatatagtctgctgctagattaaatacacaacaagaatatctctcatttgcaatagaagtatagaactgctggtataatgttctacttgtgtttcttttcagggggagctttttgagccagttaaagttaatgactgcttgtggaccattggtacatacatagtttgatgatacttgttacatttctcatcgatagcaatacctacatgactcttgttactgacttgacatgcattattttgtgataattccttcagaggatgggaatacactgtctatacttttgacaaaggaaaaccagaaggaatgcgtggacatcagtgataaaaggtgaccctgaacttgacccccgggacatgaaagtacctgaactccgtgattgtgatgttgaggccaaagagactattgtgaggatagtaagtcatggattgcccaaggcaatgaatttctgccccttcatgcacaatcgattcagttaccactgatcaagtttactaatttgtcttcacatttctgattgattcatcagagagctatggatcatgcaacaagtgatgatatccagcaagaggaacttctgaagaatgcccaggcgagtttcaggctttctgctacctttcctccctttttctttaacctctcattttctgaatcctgtagttctgtttgtactttgccaccgtttgtttgttggtgcttcaatgtatctgatgcagctatttcttgcagtactcgcatatggattcctaaggcaaaaattgaggatgttgaacccaagaagtgtacatacatcatcctttgacagagaatagaagttcagacacagaacagaaggtcacatcatcttttttgtaccgggttaggaagctcaaatactgaagacttctctgctagtacgatttagctctatggtaactagtaatcctcgaatcatagcctggtagtcacacaatgttagtctataaacatgaagctgcacctattcagaaaccttcctcttaaacaccttatcctgtatctactcagcagtaacatggtcgagattttgtgctctaagctctggtggttgtgcaaatggatatcggcatctacaaagcaaatgcagttcctctctctttggtttttgctcttgtttctggggaatcttttatcctgtattctgcagtacgttgtagtactatagtagtagtaggctacgagtagttcttatttgtactgaatgcggccggaattggtatgctggcctgcgagccctgagggcagcctatctgggcggattgttggtggcgggtgacagggggactaacatcagcagcgccaaggtgggcaaagattctgagccgcgactacgaccatccagcagttggcggctgctgctcgcctactctctgatgagatgcgacgctgtactaggatgctgccgcctccatcaacatcaggaacccaatcaactttctcgtacgcgcactgccccggtttctctttctcctccccatagccaaacagtggcgagcgaaacggacgcgcacaggcggaggaggcacagccgcagcactacgtaggaacagtgatgcagctgatgatatcatgatacagctattctgcaagggacatcggcagcatggccgggcgattgaacgttgccatggactgatgaaccgccgtaagttgatctgttgatgcctttgcatagttgcttggatgggaatgaggaatgggcacaacagggaggcatggcgaccacgacaacgggtcctgcctaatctttggaagccctatcagattatcaatgcggccatcactacacgatcttggagttgctgggcttcccacatgcacgggctataattaatcgatattctaaaaaaaaccatcacatttgtatacaccgtacactgtacaacagcaagtaaaaacggctgactatgtagccatttcctagtatggccttagcatattctccaggtccagggccttgaagagctccgcgacagagaaacctttattccattttacattgaaactcagcgtaagaaacagtgtcaaatcctctgattacagcctctgtttacgctggtaaaagatacgcctatctagtagtacagtaaattacaaagctactgtgtataattaactctgtggtgggtgctatcaagagcaaacatttgcacaactagtctcttctaataagatggagagcctgcagaatgcagggttttttttaccttctgttgttacacacattgcctacatacagggcaagacccatggccaacgagccatttgtccacgcaaggctggtggaaagtgtgggagcaattcggcaatctcctcgccgtttcaccggttacaatatcctgcaaagcggtaattaagcagtgacattgagtgtgtgtagggagtgagcaagttgcaaagcaaatcctaaccacattgcatttagtagcaggcataatttggtatgcaagttgccacaaaaggggaacataaaaacggaggtcgttgcatctccctgctctacatatcacaccataacaatcatgtcatatctactatccagctatatatatgtacttgaatgtttcatttatcaatctaaaaaatgggccgcatttcctggttcaacaaggtcgggaaaagctttggtttctggttggaaatcattgatcaagtaatagaccgtattcaatggtcaggacgagttaggtttaaaacgttctatgaagaaggtcaaaagaatttcatgaataatttgaagatgtcttcccatttacccccttggcaattatgtttagaacagttactactatatgtgatcagccatcactaacaaccagatggagacttgtagtggtatgctatcaccaattttcaaatcactggtgatcttgattttcttaacaaactttgccaaaaaggagaaagctcaaatatgctaactaaacattcactatattgtctgcaatcatgaaatggatgttgttttgcttttattatcgttgttgaacctaaaccatgtgcaaaattgtgcaaggcagccaggcaggtttgtcgacaacataaagctaattttgataaatgtacctgcaggcagatagtgcaagagaggtcttcaccaaacgagttccgtgtttggtcagtgaccacatagtgtggtaatttattcagtgactcccgtgaaagccctttggatgaacaatctccaaaaatatcatacagatcatcatgaccaaaatctgaaatgctgacctgttgacaaagaacataaaaaaaatcagtaaaagaaaatgcttcaataaataacgatgtgttccaataaacggtgattctgcgaaccgaacatcgtttccaaagtacccgggcctactagccaataaatttgtaccgttgtctcaactaaataaagtggtttaaaactaccaattttgcaaatagaataatgaaatgatggccagcagatcaggtttttcacataaaaaaacattttataaaatgagaaccatggcaaacaaaattgcatcagcagaacatgtaactgacctgccaacgatgcgttgcatatcctgaaggtacaatttgctcttgcacaaaccgcgcttggaggagctgctctatgaaatctgcctgaacaccaaatcgttatgaatttttcttagaggcgtatcttacaaacacagacgagagatacatttcaaaatcatggtgtcaagccgtcgaggagtaaagtaaacggcacagcatattggaagaagttacatcaggctaatgagcatatatctttcagagaaataaattcgtcaaatacttcaggtcacatcatctgaagtcaaacgcattaatataacttcttggacaaacaaatatgcaagtatggaagaagcttactgaccatggaggatgtgccatgagagcccagccggtccgagcaccaataagcacgagaagcctcgaggacctcaatggagagcacagctccggcgaacgcccccaatccagctccccggagcacgccgctgtctgaagcccttccggccagcgcgccggtcaccgctccggtcaaggccccagcttttacaaagcaccacatcaaacaacggacataaaaaaaaatcggaacacgtacgcgacgcgaggccagcaaagaacgagctctcacgggcaatgctcgctgtcgctggcgtcaaagaatcacatgaacagctcgagcaaggggggaaagaaggggcgggtgttttggtgagtaccgagagcgaagaggccggtgagagcgccggagatgacgccggcgagaagcctggggaggtacaccgccacgccgctctcctccagcgcgtcctccgcggccgcgacctccatcgaaggcaggcgcccccccgggaagcgcgcgccgcgcggtttcttggtatgccgcgtgcgtcgcgcgggttggcgtggggaggcggtgatgagagagagagagagagagagagagagagagagagagagagagagagagaggaggccgaggcgagaggagaggagagggagaggctctccgggagcagaggaaggtgaagacgtgaagtgaagctctctccaagctttgcttttcttttcgctgttgtttcgcaggcgactcgtgatgatgagacgatttatttgctttgctctttccctttttcttttttccttttctttgtagacaagagaattatttgcatttctttagttttctcatacggttgtagctttcaaggttggctcggggcccttttttttgttttgttttattctttcagaaattttcgcgcatgctccaaataaaaggcacaggattatgccacatagttgtcgcttaaatttacgtgcaataaccttttttttttgtgagaaaatatcctctcttgcgatagttgcgagaagagtctagaaagaagaatttcaataaatattttggttgcaactaagaagccagcgagtatatataattatgcgtatctctactctgcagttcggagtgcaataacaaaatgctagggccggccgaatacatttcattgttggatattaacacatttaaacagaactttagttgctagtttttattgtaacatatttataaaaccaatacgggcataatgccatcacaaagtacttctttaagacatactattcacaaattattttcatgcgtccaacttaaatattgaaaaatatataggtcatggtgtaaagatagttactagctcctattaggttttcaaattgtaggtcaatggtaaatttatgttttaatattttataaagagaaatttgttgtatttaatatatttttaatgtaaaacttgatattttctctcacagtttgtctaaaggacttaccgtcactcttgattaatcaatgcctaagagatggtttttggccatcaaacacaagaagatatttgttaagcatgtcctcatccaaatagcttgtgagttggaggtactccaaggtccttgtcgaaagctattttccttaaaagaaaaattgactgatgctttttttaagggtacaagggaaacgtacacagcaccattactataatatcgaagtattgattaaaatatgtttggtttctagcctatcaaaatacggcactgaaaatatgtctatattatcaaattttgataaaattagaagcaccaacaatatgatctcataataaaatctagggccactagagaaaataccttgcactcagcgaataaagcctgtgcgggtcgccgcacagtggcagtgctaactggccacttcgatctcagcttgactgaaactccccccgaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctccttaggctacattaggcagtgctccctccgtcctataatataagagattttaggtggatgtgatctaattgggagaaatactcgctccttcttcacgcacacgcttcccaaactgctaaaccgcgtatttcttataaacacattttatagaaaagtttgctttaaaaattatattaactctcaattaatcatgtcataatggatcatctcattttgagtattttctcaatcttctctttttctcttctctcaaacacatatgcgtagcagtgttcagtggacccacatataaataaaaaagactcgacaatggtgtacatttgttctaataaaagactctaagtgatgacatcatacatatgtaagcacgataccttagataccaaacctggtataagtaataccggacacatacccattgataccaaactgtagtagcaagctaccacatctagtattgggtattagatgtgatacctgtatatgccaaagtctgatacctagttaccatgtttgatgtcacacacgcacaaactattgcattgaaacggtattactgttttgtagtatttttatataaaaagcactacctttggttttaaatatctgttatgctatgtttaggagttcaagtttccaactcttctccctcgtttttcacacatactctttccaagttaaacgacatgttttttttaaaaaaaattctacatgaaagttgcttttaaaaatcatattaatccatttattagaaaagatatagctaatacttaattaatcatgcattaataaattgctttgttttacgtacgccatattaattcccaactcaaactaccgaacacaaccttactcttgaagcgcacaattttaactttcaccattgcaaaatttaaatgtttaaataatgatgtttgaaagtttcgtggttacatttaagatgcaatatacttagtatggcatatttcttttatatatatatatatattatatttatatatataaatatatatataagaaatcatagtttaaaaataaaaagtatataatgataagtatttgaaaacgggagtaattgaagttacgcgtagcgaatttggcaaagttagaaaataaagaaaaatccatggagcctatgcatcagcgctaacattttctttatctagcatctacctcttctattgtgtagaatcggtgttgatgttaagagtttctcaaatgtatccatgaaactagagattatgcatcattttttcagattcgtagtattaaaatgtctcaactttaattctaattctagattactatattttaatattgtagtaacaactcactatgtaaattagagaagcaaaaacatatatattctattagttagtatatcattatctaaaaatatatattagttagtatatggtattcattgctgttattttacttcaaagtgatatttgacgaataagagtacacattaatctggctgcggctatcacctatcagtaagtcttcaaagagtgctatcctgtaatcaatgtcggatgtaaggctgaatccaacgtgtgctgcacatacttcgctccatccatgcgggcgcattgagttttcttgaaagatacactgccccctattcacttcccaggacggagacggtacgccggtccagcccaatcttcttcttcaagcacgccacgcccagcatgctcgaaagctcgatcgatccagccaactaatcggggccatccggcgatgaccactcggcctaccggcacgcgcgcgtacgcgtgccgcagcgcttcgccggacagagagcggccccggccggcgaaacgagctagcggctggttccctgacgccacggcgacgtttatatcaacccaaacacgtagtcggcatgtgataacatccttccacttcaacaactttctatcgaagttgaaactttataagcatgtacatattcctctctcttaagtaaatttggtccggctatcatagatcggcccggctaaagaaaacacatcgtccgaccacgcctgtgacaacatcctttcacttcgacaacttcttatcgaagttgaaactttataaacatgtacatatccctctcttaagtaaatttggtccggctatctcagaccggtccggctaaaaaaaaaaacacgtcgtccggccaaggatcatgcacgccggcatcagcgtcgtttttcgaaccaacgtgacctgcagtaggctggtacttggtagaatgtcactagctcgatcagcgacaagtctgtcgaaccatgcttcttcacgcccaataatgctcgctggctttacgtatcgtcacagactcacagtgagagttaaaagcaaaccgtttctgacgcaacatcctcttcgcctcgcactattgcagaaatgcagagcacgccagtggcatgcacggttgcttggctcttcttcttatttccattttttttgctcagacgtcatggtgcacgtgagagaaggcgagcatgggcagcctcaaatgcgatctggttagtgctaggtgtgagtgagttgtggtgacgtggtgcgatatcattaggaggatcaaaccacctgtcaattcggctactagctgttttcctgttcatgtatctgtgagcttgttgctaccagcaaccaggttgatcagatcgattgaacactaattttggggagaatattaatgatgcttacctgccgcatcaaagattgtcatatacccattcgtcctttaatataagaaattttaacattttacttacattgtttgaccactcgtcttattaaaaaaaattgtgcaaatataaaaaacgaaaaatttacacacatttgaagtattaaagtagtctaataataaaacaaattacataatccacctgtaaactacgagacgaatttattaaggctaattaatccgtcattagcaaatgtttactgtaggctgtagcaccacattgtcaaatcatgatacaattaggcttaaaagattcgcctcgcaagttacacgtaatctgtgtaattagttatttttttcgtttatattaatactctatgcatgtgtccaagcattcgatgtgatatggtgtaaaattttaccaggggatctaaatagaccctaagcatattggatgaacattgcatagtttttagagaaaaggcatcatttcctcaaagagcattgaatagttgcacatacaaaggcataaaagaagtcgaatacattttattcaaaaggatcacaagcataccattggaagctgatcagtaatcagatagcagcaaattaagaacacagcaaggcaaaagttcgattattttcattcgccaaaaacaataataacttgctcatttagcagagatatatatagcatggtgtgcgagccagtaatagcgtcctcacagcctgcttaactgactcgtgctcgtccgatcaatcgtcgtaatcgtggcggcggcggttgttcttctcgtagcgctgcttcctctcgccgtcggagtcgtcgtcgtcgtcgtcgcgcttcttgtaacgcggcttcctctcgccgtcgtcgtcgtcgtcgtgcttcttgtatcgcggcttcctctcgtcgccggagccatcgtcgtcgtcacctccctaaatgaagaacagaggcaaagttaaggaggcctggaaggccggagtacacaagaacccatataaggcccgtgaagctaacgggccgggcccgtggaatgagctcacatgcttcttgcggccgccgccggaggtgtgccgccgctgctgctcgtcgtccccgtacgccggcttgggcttcctgtacccgccgccgtgcgtcgcctcgtcgtcgtccggcctcctgccgtggccagccgagaggtgggtctcctcggcaggtggcctccggccttgctgggggcggtcgtacgaggaggaggaggaggaggcggtggagatggggtggcatatctcgtcggagggcgggagggcgcggccgaaggtgagggcgatgtcgtagccgccgccgtacggggtggggtcgtactcgtcgaagtcggcaacctcgtcggcgggatggccgcttccccagaacacgctcgccatatcggtggctggctggctggctcgattcgatcgatcacggtgtacgttggcgggaaggcacggagggcgggaagagatagataggcgcggcaatgggccgcggcgcgcttggttcggggagttttcgtggctgggaactggtcaggtcgcgcgaccggcggccgggcatccattgcgttgcgttttcggtaacgagggccgcagtagacggtaacatggagccgaacaaaccgcgcgattgagtgtttttttttaactggaatttgagtgcttttagatgaacttgaaatagaaatttcacagcaaacttttttttgaacaaggagagccaaggtccccgcctatctatctattatatattattaaaggaatagaaaaaggaggctccacgttcgctctcatgacctagaaattctcacaataatcagagaaaaagaaaaagcaaactccatacaaaaatacaatttaggaacagctaaaattctcacattaatgggagaaaaagaaaaaacagagtccatatagaaataaaatttagaaatagctgaaattcagaattaaaaaataatgaatattagaagaggagactagagtccatatagaaacacaatttagaattaattgaaattcggaattaaaaaataaggaatattagaagaggggactagagtccatatagaaatacaattaagaaataactaaaatttggaattaaaaataaggaatattagaagtagagtataaagtccatatagaaatacaattaggaaataatagaaattcagaattataaataaggaatattagaagtagagcatagagtccatatagaaatacaattaagcaaaaaaaatagaaattcagaattaaaaaataaggaatatgggaagtggagtatagagcccatataggaatttaaaattaactaaaattcggaataaaaaggagcctccacgtccactctcatgacttagaaattctcacattaatcggagaaaaagaaaaagcagactccatatagaaatacaatttagaaatagctaaaattcgaaattaaaaataagaaatattagaagaggagactagagtccatataaaaatacaattagaaaataactgaaattcgaaattaaaaataaggaatatcagaagtagagtatagagtccatatagaaatacaattaggaaataatagaaattcggaattaaaaataagaaatattagaagtagagtataaagtccatataaaattcaattaagaaaaaaaaaattgaaattcagaattaaaaaataaggaatattataagtagaatatagagtccatgtaggaatttaaaactaactaaaattcggaataaacataataaaattaaaagtagagtttacagtccgtataaaaatacaatttacaaataactacatttcgaaattaagaaaaatatgggaagaagagtttaaagtcaatataggagtacaatttagaagtaattgaaatttgaagttaaaaattaaagaatattgaaatatgagtttatatagaaatacaatttagaaatagctgaaattcggaattaaaaataaggagtattagaagatgagactagagtccacatagaaatacaatttagaaatagttgaaattcgaaattaaaaaataagaaatattagaagaggagactagagtccatatagacatacaattaggaaataactgaaatttgaaattaaaaataaggaatattagagtagagtacagagtccatatagaaatacaattaggaaataatagaaattcggaattaaaaataaggaatattagaagtagagtatagagtccatatagaaatacaattaagaaaaaaatagaaattcggaattaaaaaataaggaatatcataagtaaagtatagagtccatataggaatttaaaactaactaaaattcgaaataaacataataaaatgaaaagtagtgtttagagtccatataaaaatacattttacaaataattaaaattcgaaattaagaaaaacatgggaagaagagttgaaagtcaatataggaataaaatttagaagcaactgtaatttgaaattaaaaattaaagaatattgaaagatgagtttaaagtccacatagaaatacaattagaaataataaaaattcagaattaaaaaaatattaaaagacgagtctagagtccatataggaatatatataatttacaaataaccaaaatttgatattaaaaataattaataactaacacgtatataaaatacaatatgaatattacacattagtagtttcgtaaagttattgcaaaatttaaaattatgttgtcattgtaatatattttataatataatgagaaaacatatattttattatatgagagaaaatataatgatactagccgtgcaatctgcgcgggccaccatgatagttaatttattaaagaaatagaaaaaggagcctccatgttcgctctcacagcctagaaatttccacattaatcagagaaaaagaaaaacatagtccatatagaaatacaatttagaaatagttgaaattcggaattaaaaaaataaggaatattgaaaaagaagactagagtccatatagaaatataattgagaaacaatagaaaatcggaattaaaaataaggaatattacaagtagagtatagagtacatatagaaatagaattaagaaataatagaaatttggaattaaaagtaagaaatattagaagtagagtatagagtccatttagaaatgcaattaagaaataatagaaattcggaattaaaaataaggaatattagaagtagagtatatagtccatatagaaatacaattaagaagtaatagacattcagaattaaaaataagaaatattagaagtagagtatagagtccatataagaatttaaaactaattaaaattcggaataataataaaattaaaattagattttagagttcgtataaaaatacaatttacaaataactaaaattcaaaattaaaaaaaacatgggaagaggagtttaaagtcaatataagaatacaatttagaagtaacttaaattcgaaattaaaaattaatgaatattgaaagatgagtttagagtccacatagaaatacaattagaaataataaaaattcagaattaaaaataaataatattggaagaagatcctaaagtccatataggaatataatttataaataaaaaaatttaaaaataattaataactaacacgtatataaaaaacaatatgaatattatacattagtagttttgtaaaggtagtaaaaaatttaaaataatgttgtcattttaatatatttgaataatacattgagaaaacatatatattattatatgacagaaaatataatgatgctagccgcgcaatctgcgcgggccaccacgctagtttccattaacaaaaatgagatttacagtataaaagtatcatactccctccctcccaaatatctagtcgtacaaatgattttaggatggatgagtaaaagattatgctatttcaggctgtcccaaatatctagtcgtacaaattattttgggatgaatggagtagaaaattatgctatttcaggttgtaaggctagggggacaacaattttaagcaacaaaggatagctacaacctcatcaccccacgtcatttaaccatactccctttgtcccataaaaaccaatttagtaccggatgctagtattatgaatctggacatacatactctctccgtccacccaacctaggaggggttatagcgtctatttgtccagattcgttgtactaggttgggtttttttttaacggagaaagtatgtttatatttgtaaatctataatatgacacatctgatattagattaatttttatgacacggagagagtacaactgaaaaggttttattcaaaaagactcagggatcagcatctctccctagggcacaaaaatcaacacattcaatccccctcagcagccttcattaaccttgcaggcttcttggcatgaccttcttctgcaagatggctcattgggaaataattgagatatagtgaacaacctgaaaaataacttccatgggatctttaggtaacttgttctcaaaacatgatttgtttcttaagccctgtttagttcacgaaaagaaaattttttagtgtcacatcggacgtttgaccggatgtcgaaaggtgtttttggacacgaatgaaaaaactaatttcataactcgtctggaaaccgcgagacgaatttattaagcataattaatccgttattagtacatgtgggttaatgtagtacttatggttaatcatgaactaattaggctcaaaagatttgtctcgtgatttccacgcaaactgtgcgattagtttttttttatctatatttaatactacatacatgtgtctaaagattcgatgtgatgtttttggaaaaaaaattgggaattaaacaaggccttagcttccaaatctcccaaagaaatgctgcatcccctactgccacaagttttttggtcctcttattaaaccccttcaaccagtccccattccatttgttatcccacaagcaaatgcacaactgagaacactccaaacacacctggccaaatagcaatgtaaaaacagatggtcttgtaggataacaattgatataataagatttgctcaatctttaaaactttctgaaaatgctggccatcagcacagcagggaagggagcactgagcacgattgaacaaccgttttctcctttttcattttcttgatggacagcaaatcatttttttttctttttcttgccatattacacaaataccaccatttggtggagaacacgagataaaggaaaagagagatggtatgaaaaaagcatgtgtaacttccgcccgccatgtgatttcctgagactggtgtttttggggaagaactgtgctaaacatttgattcgcgtttgcacagtttcttgccgctgttcaattttcctccatcgtggacgggtttggcagcgctggtcttcacagatggatacccagcacactaacatcatcacgctttccaatctcgaacacacaattggtgttactatacaaaaaacaaaaaaaaatgctatacttaggccttcgggcagctggtaacatcctcttttttcttactcgtcggtttgttgtactctctgccttggcgcttgagcggtcatgtttttcagcagtggtttcaatgaggccatgatatctgcaaatgatggccgcaattttgggtccctacaccaaatacaggaagcaacactgagaaaatggttgtgtattccgaaaatggaatgcaggttttagtgcgtccggaagaatgcagatgagcgacaaagtgagttaggcacactaacgtctgccagcattttgctattatttctgcaatggcgggatcagtgttatctggaatatcaaggcgacgattctgaaacccaacagctccgacgacttgcatggcgttcatgccttcccaaggttgcagtaatgtacaaagttcccacagtatgaccccatagctaaaaacatcgcatctgccaatatgcacagccatttaagcaatcacaaactcatttaaggtacgaatacatctgagagcttagtttttagaatttagaacttacttctcgtctgatggttcattacgaagtacttcaggtgccatccactccgcctgcacaccaacataaatattcagtgccaacaatgttaacagtcaatagcatagcacaaagatgatacccatacatagcataaatctcattccatagttcacaagaagtcctgacacccttaaatcatgtcacaaactactctaaacaatccagctagctatgaaatcttgcacagataaacccgaggacggtggactggagaattgcttataaagcttataagcttttagaggtctatatattgtttgtcagcatagtctttaatgcttagtactccctctatctacttttgataatcatatttcatcttgacacacagaccaagtataagtaattctacttatcatccatttaaatatgctagtaccagtcattcctcgtaaacaagcgattcattaatatttacatttctcgatgcccatgtagccaatcatgtgtgaagaatggagagtcacgcattaaattcgagaaaattattaagatgatagtttgttggattgaaatatgcctattaaaaataaatttttcagatttggaaatatgactatcaaaagtagatggagggagtatctaattagatagcatagtatttagtgcaatcaaggatcttattgtatgaaaccaagccaaactacacattgccttaacataaattgaccatagaaaatcaggcgaaaccagaagaacaaaaaaaaagtgtgattcaggcacaaactttatgtcacaaaaggctttcagtgaacactgcgtatccactacatggtaatatggcctttcagctggtcatttgtggggtggtcttattgaaaagatgatttgagtatcaatcatataaaatcctcaaagaacaaatgggcttatgggcataacacaaaaaatttccacagagagtaggaacattgctgtaaagtccaaaatatattttgagcccctttgattcatcactatcatcatcgatcttccttccagactaggataattggagttattccttcattccaatctttttttatatacatggatcacaatggattatacttcaaaatatttcaatcccttgttatatgcacatagcataatgaagagggaaaatactatgcacaagagtaatatatcatctggtataaaactctcccaatatgagagctgaaaaagcagacaacccaggctcttgccgcttgacatttctgaagagatgcacacaattgcaaagcataaagtatgttattttcataacaatgcacaaataattaagtgttgtagaacttaaaacacttcaaacaaatttaatcatgcagacggaagtacttcttaatctccctaaaattgcacaacatcgcaacaattaccattttaaatgtgcacaggattggtgctcaaataaagttataataaaatttctgaaatcgttcgagcttactgttccagctgttgatcttgatgacaagaaggtcttgttcttcattttagataaaccaaagtcgcaaacctagttgcaaaaacgtaagtggtttgcaacagaaattgaaggaaaatgaatttcattgctatcgtgcaacttgtgtattaccttcacaacccaattcttgtcaaccagtaggtttggagacttcagatctcgatggactatcaccggtgtgcagttatgtagataattcataccacgtgcctagggaccattcaaggaatcttagtaaacaatatttggcttctccacacttatcagttatcagcaactgtgttaacaataagttgagatttagagtcacaaatcatgcataccacatcaagtgccattcttaagcgctttctttcatccaactggttgttgggacgatgaattaaccgaaataagctacctctgcaagaccaatagaaaaaaaaaggggcaagaatgattaataatatagagttcctaaaaaaagtgagcaactatccccacaattaatgcactgttctttaaggggttgcaggtgaatgttccaaaatatgtctgatactatgacacaggtcaactgagtcagctcgaattacaaaacaggaagtttatctttttaacgcatcaaattctgaacaaaacattaactagtatatgatcctaagttcctatttcctacatgaaataaacataaatgtgatgtaaaaatttacaccaataacaacaagacataccttggaagaaattcggtgacaatagaaagattgggtacacgagtaatagcacccatgaagagaacaacattcggatgccgcaacctcttgattattcgcacctaaacatgaaaagtaatacattactataaggctcatatggtgtgtgcatgaggttaatatgcaaacatgctgcaagtgcaaacatgcacaataaaacacatgagcatgcacacaaacatatgaacacaggcaagaagccaaaacatctgtacttcagactatttggtcatttgaactaaattatggagtatatggtatacctcagttctaaattcttccagagcatcacttgaaatatcttgttgcagaaacttcttacagcaacttcctataaacaaagcgattttgatacactgttaaacataagatttgctagaactttcaagaagatggtgcataacaaaagatgggtcttcaaactaatgataacagctgaatacaaaaattagacatattaaaacacttttttcacaaaatattgaagtctgttgcgaagaaatcatacgtagctttccaggtgaaaacattttgatacaagactgggcaacagaaaactaatcaaatggctatagtggtttctcaatgtattatctttaaagctgaaccttttcattataaaatataatcaagttttttagaaaaaaaagtagggagttattctattcggtacaatagttgacagtggcatgaacattatgtatgttatctcagtgaacaataattcacatctttcatcctcgagagatcaaacagttaacaaatgtgccgattgcattcagataataacatggaacttgttgacaaattaaaatgtaagagagcatatttttactgaaacacttactgttccatgccactctcctctataaacttctccaaatgatcctggagcacagaaggttggatcaatttaagagaaagaaaaccacaataagattttacagacagtcaacggaacagtagcatgactaagaaaacaactgtttgaataaattgaaagaaatttaccaagaccaatgcgttccccaatagtaatttcttcccattggatttcaaactccgcaacatcatccagagtgatttcagattttgcactctctgttccgcttgacttatctgaggttctttcagcatcctggcgaacttcagctgaatctttttcttgatccaaagtattatcttgaccatgatcaatttcaaaattctgtttatcccaaaactcatctgcacttttctcgattgattcattcccttcggagggacttggtaaactatgcag

SEQ ID NO: 8592 - DNA, 3304 bp, Oryza sativa
aggctccaagtgttcatattgcttgctaacagcagcagttgtggcaacaactgcagctgcagtgactgttgcagcagctgcaacaggcacgtcaaagttcacatcattgtttgatttagcagcagcaacaaccattgaagacgcaaccactgcagcagttgcaacagcagcagccgtaacaggcaattgctttgtaagctgcgatgaagcttcctggggaggtgcagaaggttcatactgagaaataaaagatgtgttatcttggatgtcaggggggtggtcaatgcccaaaccctcaactggcttaagtgagtctagaggtgcccggtgaggaacttttgatgggagttcatgtccaggatgatgaggcaataatggaccatgaccacgatcagcatattccctcgacccaagttcattcatcctctttttcatttcatccttgctttgaaaaagggtggtgtcatacacgatgaggtcctttggctcttccatggaatcttctgaaaacaagtcaggtggtgctacaactccattttcaagtaaaacctcatggatcttctgagctagttgtggattctctttggcagcattaatcatgtactccgaaatatcctttactttcatcctccggacagctggagtactgcctacttctggggaagaaggtgaaggtgaagttgacgaagaattaattgttacacttgatctttctttgttctttgcggcagcaatgtcgtctgtacttcttgattcatttgtaataggcctattttcactagtgaatgtgctaacagataaaatcccgaatgaatctgatagtgtattttgttgattgtttttacttgtctggctcgttgtagctccatcactatcagaaggaccaacgttgatccatgtagatcttctgtcaagtaactcacactcaaaagaaactacatgcagaattcgataaactatttgaagatcccaactgcctgatgtcattatctttgttaaaatgatgattatttgagaaggaactttcttcaaattctgtagacaaaacagcaccatctgaaggaataagtgtaccaggatctgcgacaagatcaacaatgaactccctgcaaaatgcagcacggtttagatggttatgaagtgaaatgtgttcttattacatctttcaatcctcagtgcaccaacacttaaaagtgaatgcatgaagatagaaagtccaatactatcaggacagaacacacttgtgctatctcatgtttatttgtccaacacaatcctgttcatgttgtaaaggatgcaataccttccatcatcaaatttcacaatattcaaagccccatcgtccgatccagtgtactgccttcctttcaggagtcgacaggggataccaatgttatcggccaaaacctacatgtaaccattaagaaaagtaattgctatcatagatagatttgtgtgtaatgtgtcttataatggtaattgggtcacccttctattgtattagggcaaagagaaaatgtatagaacttatacactgaatttgaagtagagaaaaatatagaaagcattataacagatggcattcaatgttcagtgtccatgttgggcaaattctcgttgtcaataaagttcaggactagagcaacaaagatagcttggagattagccacactaatcttaaatacttaatatgtcttattaagtaactaaccttaaatagcagtgcacgatgacgtgccagaccaatttttaattggccaagaggaacaactacacttccaatactggttctcaggtatctcatcattttctggtatttcaccaacatgccctcagaatcaaaaaaagttccacccatgtgtctggctactaggccagcaagtttctgaaccaaatcatttccaacaaattctgaaggtttagattcacggagttcaaggctcatgattagagccgtctggtcaagtttcataagctcaggatcttcacctctgtgtaccaatacagcttcccagttgaccctatgtgatagtgactgcgctcgcaaatctttaagagagggcatggttattgaagccgggccattcccagtcacatagagatcataaaacccatctgatattctgtcatcatagccaagggcgttgaaattctgtgaggcataaacaattctatcatatgagagacaccagaaaatggaccatgttaagaaaaaaggaatgtacagaactttggagtgtgttgagtagaaacatgaggaatgcttcatctatttaaaaatgttgattaaatgtgcgattcataccaatgtatggtctcttttacgtatggctacaattcattactgaacaggcctcttttacatatggccacaatgcattgctgaatagcaacaaataacatttagttttttttcctcaaaaacacaatagagctgtgtttctttgtattatcaaataacaattacttcaaaaaagtaaggcccaatcttataaaggatatactagaatcatactccagaacccacacaagcagtgaaaattatactgggggtgatgttagtcacaagataagaaagtttaacttatctgacagacagacactaggtttcagcaattaggcagtcagactgcagaagatcattgtatgtaatgtaatgtaccacagaaagtacaactaagctcgtgctaccaaccccaaaaatcacccaatcgatgcaattgcactagctatgaactccagcactgaatcactgcccagccagtcaaagatgtaaagtcaaccggtttcacagcatggagtctattccactatcagaattgcaccatggaaacagctaattagcgatggaaatgaatcagagtggctaacccagtatcgggccgcgagggcctctgcagtagagctctgaggcgggcagaagcccaggctgatctgcttggcaacttcaatctccatctcttcaggattgtcccgcgcgctcatctcaagcacaagctgcagctggaactcctcaaggtcgtcgtcctccttctccctgacccgcttcctctcctccgcctccgacgactcccttatcactcgctcctccacctcgtcctcctcctgcgaccgcctcatctccctcacggcctcttcctcctgcgaccgcctcctctcccactcctcctcctgcgatctcctcctctcagccgccacggattgcctcctctcctccgcccccgaccctaccgacgacgagaacggcgacccctccgcctccgacggcgtcgacggcgtagggggctgaggccgacctgggacg

SEQ ID NO: 8593 - DNA, 17147 bp, Oryza sativa
cggcggtgaccagatcatggcgcttctcctcttggtggacggccgcatagggggatgacggcatgaggcgacctcctagacggcgcgctctccctcatccctctcctcgagtggttctgcctcgtcgtggggccacgcggtttcgaagtcgccgccgcggcctgcttctcccgcccgccgccattcccctcatcctcccactgctacgagccgccgccgccctcgcctgcccaccctcccgctgccacccacagccgccgcccgcgggctgccgcctctgccgctcggccgccgccgatgtctcgatgccgggcgccgggtggtgcgggtggtggtggtgcgagaggaacggcgacggcgtgacatggactccagcccgccgcttcagctccagcccacggtcgccgccgctccagctcccgcccgctcgctccccacggatggccgtaggggagagggagaaagaaagaaagaagggagggaaagaagaagaagaaagaaaaaagactgccatgtggggccacatgtcagtgggcccgacaattgtgtgcgtgaatgaaaaacgggccccactggtagcttttaatttgaaatgacacctaagcgccacgtcagcacacagactaggtcaataccggcacgtcagcgaaaccgccctccgaaaccaccgagggagtcaaattgcaccggttttcatactttgggggtcaagatatccggttttgtggtttagggtcacggattagatttcaatcacttttgagggtcaccaagtgaacttattcccaaagattaatggccttctctttttttagacaggctcttgaacgggacaggttgaaatggcccaagtatttgcttgccgctatctgatactctagcaattaggagggttcaggaatcaggacatagtttcctggtctctagcaagtcgtaaacagcagcttatccactgatttttgcactcctgataacgtgtctgtaatttcataccgcaatgaccttatctgattaccttatactatacaaaaccgcatatgtcctccatgacaggcagcctctctcggagcaacattgtcaacttcgtcagggaagaagattttgcttatgtgaaaaatcagggaactaatcaatgggaaattgtcaaaagatgtttatattattgctgtctagataagatattccctgctactctcttcgtcccattttaaatgcaaccatgatttttcgcgcataactttgatcgttcgtcttatttaaaaaacaatttaaaaaaaattaaaaacataagtcacgagtaaaacactattcgtgttttatcatctcataacaacaaaaatattaattataaaaaaattaaataagacgggcgatcaaagttggacacggaaattcatggctgcttttaaaatgggacggagagagtatatattagtaccagtgcaagcacttcaggttgcagcttagctaatcatacagcgcaccagccaaccacaaggagtactaagatatttgagaccatcagtccatcaccatatatttatttatctgttactacctgtacggctaaacgtgctatatatacaaacagtatggtggcccgcgtagattgtgcggctagcatcattatattttctctcaattaatagcatatatgttttctcattatattattaaaatatattacaatgacaacataattttaaattttgcaataactttacgaaaatattaatgtgtaatatttatattgtattttatatacgtgttagttattaattattttattaattatcaaattttagttatttgcaaattatatatattcctatatggacactagacttgtgttttaatatttgttttttttattctgaatttttattatttctaattatatttctatgtggactctaaactcatctttcaatattctttaatttttaatttcaaatttcagttacttctaaattgtattcctatattgactttaaactcttcttcccatgtttttcttaattttgaattttagttatttgtaaattgtatttttatacagactctaaactctacttttaattttattatgtttattacgaattttagttagtattaaattcatatatggactctatactctacttctaatattccttatttttttaattccgaatttctatttttttttcttaattgtatttctatatggactctatactctaattataatattctctatttttaattccgaatttcgattatttcctaattgtatttctatatgaactttgtactctagttctaatattccttatttttaattccaaaattcagttatttcctaattgtatttctatatggactctagtctactcttctaatattccttatttttttagttccgaatttcaactatttctaaattgtatttttatatggattctagtctcctattctaatattccttattttttaattccgaatttcaactatttctaaattttatttttatatggactctagtctcctcttctaatatttcttatttttttaattccgaatttcaacaatttctaaattgtatttctatatggactctagtctgctcttctaatattccttattttgcaattccgaatttctactatttctaaattgtatttctatatggactctgccttttccttttctccgattaatgtgagaatttctaggtcatgagagtgaacgtggaggctcctttttattccgatttttagttagttttaaattcctatatggactctgtacactacttctaatatttcttattttttaattttgaatttctattttttttcttaattgtatttctatatgaactatatactctacttctaaaattctttatttttaattccgaatttctattctttactaattgtattcctatataaactctagtctcctcttctaatattccttattttttaattccgaatttcagctatttctaaattgtatttctatatggactgtgtcttttctttttctttgattaatgtgagaatttctaggccatgagagcgaacgtgaagtctcttttttctattcctttaataatataatagatatgcgactgccttccattgctggacagccatcccgcgagttgaggaagaccaccctccaattctcaaatctcaaaaacctcggtctactcgatccactgatctactctatctaaccgaggaatgtttggcacaaattctgccgccattgtctcccacgtaacacttatgcaacgctcacgccatcctctccacacaaaaacacaatcctactatacatcccaacaacgtgtcgcacagtcgaccctagcgctaccagctcaagatcgaacatcatttttttatgatctgcataaactgtttgatcggcagagcatatatatgcatgcactagctagcacagtagtagcacacatcgtgctggacctccctctaagcatcgaagaaaaagcaacgtgccaccagccggccgtagatcgagccggagacgatcgagctggaaagcagcaccgatgatacgagaaggacggccgcgagatcgatcctcgatatgaagatcagcgtctggtcctgtaagaggaaaaaagatgcttcgttttacagactagggaccgtacggccggcgtcgtcgtcgttctcctcgatcaatcatctgcaattctccgccgctttacttccggttctcccgatcgatcgaactagaataatatgcctctctttttctcttttttttctgctcttccccactgctagccatgatcaggaccagcccatcaaaagcaccttataaccacgccgttctaattaattcggccccaaatatctgcaaaacgtggggggggacgacgatcaagaggaacagtacacgcgacggcgacgatgacgacgaagacggcagggacaaccctgcatgtaatgcatggccatgattgactttagaagcaagcaactgcacattggcatatggctgtgggcaacaaacaactggggctaccggaatcggggctcctccaggttcagagaacttctcccaaacagtgcaaggactaatggtcctccctcccttcctctttagaagcagtttagcgacggactgaacgaggtttgaccggtctaacccatcgataaattagccccgggagccatcatgcatgcacgcgtgcacacgggttaatacgattaaatgcagatgtatagtagtcctatcaccaagcacatgcgattgccttggggaaccacagacactgctttaattgattaagcagatcaagcaaggacgatcgtgtgcaatgcgaggagctgggtgcggccgaagcatgttgggttgttttttttcccttcccgacggatacatatatacatgttgtgttgttcgtttcctcttcctataaggacgcatacatatgttgcgtttttttttactgttgtcgatgtcgatacacggatgggctagcatctgcatcgaattccaccgggttcttctaccacgcagcaaaaaagcagctgatgggctcgtgcgacgcggtttccaccgggttggcttggcccagcagggagcatggcttctcgcctgggcctcggtctcggctacggatggtggaccagcgcttcgatccccaatcccaccccatcccaccaagcgccccacgtttttcctcctccatctcggcgtccgtcccgcggcgcgcggggcgtcgtggcggcgtgggcgacttggggcgaggatggccaagcccccgcgcttgctacccaccaccatcaccaacgttgcggtcgtcgcgacacgaggccgacccaccctacgctacgtcgctacacgggtagaagcaaaccgacagaaggaatgaacgacgcatcagccatccatgagcccatcacctactagctgagctttgtctccatcgatcgagccgtacgtaccaccctcctcagtacagtacagtacagtattattcccatcgagaacacgcgaagtggatcatcgcctacctatcggcgaaagcgagcgagcgagccacgccgatgctcatgcccatgccggcagccgcgcgcccagcgcggtagtgttcgttcacttcgtcgtcgtctctccagcgtgcgccgcggagtttggtgccacgaaaggatggggctcgcgcgcgcggttgactccaaatctatcatagagctagctaggctagcacagtagtagcacggtttcgatctcttgcttgcaccgcgatccgtctactgggatcttctacagggcagcgacgcggacgccactggacagaatgtacgcggctacagtgcacgttccatcgccacggcatctatccgcttgctgaacacgacggatcccagctactcgatcagggaccaacggccaacgggtgcggtttttgttttttttttctctgaagaaaaatgggtactagctttagtttgcgggtttcagtaggaacaatctttcgttccgggaaacaggcttcgatgggagctaatcttgggggagttttcacctgctccaggagcaaaatcccccgtttcatggatctagtagcaatgtgctacaaaccctactagcctacgattcgtaaacaaatacccgttggcttatgacaagctagagcatcacaaagctaacaataaagctaagtggtgggcagcagaacatttggaatctgggcgtacaaatgatatttgatcatctcctaaacaatatacaggccatgcatggccctttttctcttgagaaaacgcctcttctttctcgccattttttaactcgtttatcgtcgtagtggctctcatgttgggggcaccatatgcaagtgctcgtactcgtgcactttacagcgtctcgctggcccgtgcagtacatgctgtgctgggtaagtagggttttttcagccgataatggtacttggaattaattatgtgcacgtcgcgtaagcaggtccggtgggcccagggcatggaacctgttcaaagtttattcccacacagcaagagacaggataaaaggcttgcaattgcaagttttttaaggacagtatcaacaaaaatctgacatccggagcagcttttgtgggtattttaggagcacgctttagcattgttcatcgtccttttgctcttttgttaccgttaacaacaaagaggagccatgtggaggtaaaatgtgaaaggcaaaaacgcacaccacaactcttttttaaccgacaaattctgccattgaaaaaaagtttggaaccattaaacccatattacagctgaaccatccgacggtgaagcatgcacgcacgtgttggacagagtcagctttgagtgcttggatcaaagaagtgatcatcaaaaggttaacagaaaccgaaaaaaaatttctactccggttagaacagggtgatcctacaccgtccgtaaccgagatccaacggctgaaaataaatcttatgcttcgaaggagaaatcaaaaggttgcgacacaatggagctctttcttgtggcattcgttgtgctagactgccagtgcagcagacgatgatggcggggtgtggcatgcgcgggaacggaggcagcaggcgagcgtggccagggactttatcttcagctcgccctttttttagtcgccactaccaatcttcatgttccctgcctctttttacgatctactcctgctgttaaatatggccctgcgcactgttcaaagcacggcttcccgtgcagaaatggagaagtttgtggcaatttgtcgcacttggacttgtgtttttccctccaatggtaagctgggtgatctatctggtagccaggcaaaagaaaatgggaatagtatttgcgagcgttgaattaggtggagactagctagcatgtctgtgtttgcatttgcacgattagattatttgatctataacttagtatattgataaaaattactaaaatggagtactacttgatagaatgtttgtattggagtaaactttagcaaaagaaagatcagaattgaacattacgcaattcaatgatggaacaatcacaagcaacgccccctaactctgaattctaagcttttactaccgatgctacaatgtttaaatcgtggagtagtaatatcttttattttttccgtgatggctacaggattgaatttactctctggaaaatacacatgaaattccctcacttccaagttccaacttgtcctcagcaagctaccgcttgagctttcattgacttctatagctgcaagttattgccagtggaggagttgaaagatatggtggcgattggtccggatccgactaccgagttgccgtttcaggaatattcacatctacggtgcaggctagcactagcagattcctttctggatctgattttcgggacatttgtggtagttttgatggctcctttttcagattccgttaccgataacactcgagatttggcagaaacaaaaggcaaggacagggagctggcacgtcactgaccgccgtcccctatacggactgacgagcttctgtacgtacctcgaatccaataaaaacgggaattgattttgttcaccgagactttcagaggcgtaattcgattcaaagcgcccaatttacactccacgaagtcttaaagtctagcgccggaagcaatgtctctcatcactaaaaacaactgatcttaccagacaattcatatgcaaactccccccccccaccccctgagttagtcaaaaaaaaaaacaactgatctgaaattctgaatagtttgagccacagcgacaggaatgcatgacacagtcttgtaatttttgttcgtatttcctaacatggcgtggactattagtacgtcggtatggaccatgcatagtgtacgcaaataccgtatagtacttttcaatagtagtacaccacgcgaatcagccggcaaaagccctgtccgacccgggcgggggcgtatctatgtacgagccccatgaacaacagctcgatccatccacgcgcgcgtgacggctcggcggctgtcaccaacccggtcgccgggcggtctcgctcgatctgggttgggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgttaaagggcatgtacggggagttctccggcagcctcatggtgcagatcgtcgtgctgcagtgattctttgttacacgctcatgctcttcatgttcgagtaccgcggcgcccggatgctgatcaccgagcagttcccggacaccgccgccaacatcgcctccatcgtcgtcgacccggacgtcgtgtcgctggacggcaggagggacgccatcgagacggagacggaggtgaaggaggacggcaggatacacgtcaccgtgcgccgctccaacgcgtctcgctcggacatctactcccgccgctccatgggcttctccagcaccacgccgcggccgagcaacctcaccaacgccgagatctactcgctgcagtcgtcgcggaacccgacgccgaggggttcaagcttcaaccacaccgacttctactccatggtgggccgcagctccaacttcggcgcggccgacgcgttcggcgtccgcaccggcgccacgccgcgcccgtccaactacgaggacgacgcgtccaagcccaagtacccgctcccggcgtcgaatgcggcgcccatggcgggccactacccggcgccgaacccggccgtgtcgtcggcgcccaagggcgccaagaaggcggccacgaacgggcaggccaagggcgaggacctccacatgttcgtctggagctccagcgcgtcgcccgtgtccgacgtcttcggcggcggcgcgccagactacaacgacgccgcggcagtcaagtccccccgcaaaagtagcaatcttttatcttcaccgtgtactatttgcctgatttggggagcatttcttgggctaatttgtactgactcgtatatttcttttacgtcagtggatggagcgaaggacagggaggactacgtggagcgggacgatttcagcttcgggaacaggggcgtcatggacagggacgcggaggcaggggacgagaaggcggcggcggcggcgggcgccgaccccagcaaggccatggcggcgccgacggcgatgccgccgacgagcgtgatgacccgcctcatcctgatcatggtgtggcgcaagctcatccgcaacccgaacacctactccagcctcatcggcctcatctggtccctcgtctgcttcaggtgcgtacaccccgggcttctcgcaaacccaaacccatctgctcgtacgtgctgtggtggtgcggtgtggtggtctggttctgacaaggcgttcgtctcgttttggcgttgcaggtggaacttcgagatgccggccatcgtcctgaaatccatctcgatcctgtcggacgcggggctcggcatggccatgttcagtctcggtcggtattctcttgtttccatgctaacctcacctcacccccggcagtgtcacgagctgttcccctgagtttgcgatctcgccatgcatgcaggtctgttcatggcgctgcagccgcacatcatcgcgtgcgggaacaaggtggcgacgtacgccatggcggtgcggttcctggccgggccggccgtgatggcggcggcgtccttcgccgtcggactccgtggcacgctcctgcacgtcgccattgtccaggtaaaccggaacggaaaagaacagccatacgcacacactgtcacacgcacagtcacacaccgaaaataaaggtctccgtgtgggtgggcatgcaacctaccgcgcgcagccagccagcgtcgttcttttctcccagcccctcgtgctcgttcgcgtctgctttctctcctgccttttgctctccacggccgcggcactttctacgtttggccagcacgaaagccttttgctttggctaacctttttctctctgttgttcttttgtttggtccaaaccgaacgaacgaacaggcagctctgccccagggcattgtccccttcgtcttcgccaaggagtacagcgtgcaccctagcattctcagcacagcgtaagtactagattctctctcagtttgcactctgtcctgaatcgacgggccactgacattttttgcctttgctcctgctcgcagtgtcatctttggcatgctcatcgccttgcctatcaccctcgtctactacatcttgcttgggctgtaatcgagttgcatgcatgtaaattcctgctcctgacaaccagccatgttaagaagaggggagaagaagacagagctggtacactgtttgcaaagtcaggactctttgatttttcttttcttttctgtatttcttgaagtagaatttgggaggagggggattggaagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtggagttttggttggctgcgctgcgctgacccttgtaaaaccggaccccgattctgacaagagatcgaccttgttttgttcgtgtcgtggtattgctgactactactttggaatgattaatctcctactactaattactccagtctttttgctgtaaattcactcttctttttacctatacgtcaaattggaactttgtgcacaactaaatggagagcacactgctgtctaatctactgctccaaaaatcgtttagcacagcgaccagaagagccgctttcgctttcgcctggccgagtcgaagccacagaaacgcatgggtgacgaggcctcactccctatcagcggttgctgatttgataagacatgtcggccgttagagctgtgtgccgccaattagtactagtacctgatgaggtcgcttacgtggagatggcaccaataagctagtgactctagctgtaatcatggagacggacgaatgcacagtaccgtagattcatggagatcagctgagctagttctaaccaagcatgaaactagatgatttcgcatgaaatggttcataatcagattaaggttcattctatacacatattagaggcaacaaatggacataaacggaattgttgacttgtatatgtagttcttcaagtagaaaatgtgtctgtccgcgctgtactattaactgactgattggattagttcattcgttctgaacatctgatggagaaaatattgcgaaggggttggtggccctacgtttggtgcagggcattatgcgctaatgtgggatttgatgtggaccggtggagcatatccagcgacaagcagggccctctaggttgctgtcgcatttaagtgccttgttggggtccctgtgctccccctgctcattttccgccactgttctgaatctgccgcctaacctcttggttgaatggttgttagacctgttcagttcgttccacggctagtgccttcatctcccctcttctccgggaaaaaagaaaaggcttgcatttacgtacggaaaaggattatctaatttaactattgtgcagttgagccactgatatatggaccttactaaagtggaacccacgtatcagtgactcaactatatgtgtagttaagtcataggatctgctttccacgtatctcattgtgttgcatccaccatgctcatacatagcaggactacttgaagcgaaatgcgagtttcagttcaggtgtagtttctccttaggctgtgttcgttaataggggttgggaacccatctcctccgcacgaaaaagggagcgatccattagcgtgtgattaattaagtattagctatttttttaaaaaaaatggattaatttgattttttaagcaactttcgtatagaaactttttgcaaaaaaatgcatcgtttagcagtttgaaaaagcgtgcatgcagaaaacgagggagaggggttgggaagaggctgaaacgaacgcagcctttgtctttctaaaggcatcttcatttttatacccaaatccttcacataggaagagccgtggtaatatgaaaaacatgcataggtttattgttgtaaaagagacattgacaatgacatgggggtcaatgtgaaagaatatcatataagttccaaacttgctaacagcaccgacacgatatttgtcaaactacatcccagagcattgattatggacggtccttaaaaaatagcatcatccttcgcaagcgaaccaatggcttcttgacttggacctgccagggactgcgggatggacgacagacctgattgatcaacttgtcggggtttggagcgccgttcaggctatacacctggtagagcacgaggaggacaatataacatggaagcttactaaccacgacgagtacacagcagcatcggcatataacgcgcaacttcttggaaccaccgctaccaacttcaacaggctaatctggaaaagcctgggcaccgcgtaagtgtaagaccttcgcctggctaatcatccaaaacagagtctggacctctgacaagctggcgacaagaggttggccaaacggttccatctgccccttatgtcgtcggatccagaaaatagctatgcacctcctcgcagaatgtagatacacaaaaagagtctgggcggcactagcgtagtgggcgacgtgcgagcaaataaatcctagcctatggcggcaaacttcaacggtgctagattggtgggaggctaccgcaaaaatacaagagacacctaagaaggcactctgcattttgatgttgttggtcgcctgggagatatggaacgaaaggaatcgcagaaccttccaacagaaggagctttcagctacctcccttttagccaagatcaaggaagaggccaaaacttgggccttagcaggagcgagaagtcttaataggtggctttcttttagttagctcggaccaaaggtcttagctcctttctttttttcctttcgctttgtaaagttctccttctctattcaataaaattggcgctcgttgattcgttaaaaaaaagaaggtatcgacaattcttgttaagttatgtcagggctaatcgttcgctcgcctatgttacaatgatcgtactgttataatatgtagtgcctctctatttaagagatagactaggataagaaatccaactctactgctattctaaatacctacactctccgtcccataaaaatccaacctaagaggggatgtaaccacttctaatacaacgaatctagacttgtcacaccgcctcctggattggtttttttttttggcgagggagtattacaattcaagtcatactttgtaaccaattttgtactatatttgatataaacactattcaaaacaaataatatcacgtataattttatattgatatagtaagagaaaaattacaaaactatagtggaggctataataaaaaaaactagcacctctatcaaaccacgtgaccgccaatgtataaaaaaagaaactagcatctgacctgtcgtcgcttagtgtgaccggatgccaagatgttaaaggcgcattacttaccggagattttagagctgggattccagatgaatttaccaagtctaatcagcatttttcttccctttcttttgaccaggtgagtctgatagagtgatagtgagcttgcgaatatggtatgccaatcctattcctacgaaaaatatgaggactcggcatttgttcctcgtggtttaataagagattagaaaagttcacggttcaatgaaccggatcaatgcctaatgctcgcatcgaaaggagaagggagagtggccaaatcactttgactatccttttaagacttttccgagacctgtgaaacgacagtagttgccattgatgcattgtttcgcgaaaaatggttttggtttgtggcttcacagttgcacgaaaaagtcggaagtgaccacaggctggccagctcgcggcatgcatgaagcatgatgcatgccgcgaataatcaccggccatctgcatcattcaagctgggctttctgtaatcaaacatgtgacccactttatcacgaaggaatcaccgctacatggtttctcataccagaggggatgcgtttaggtccaccaattacaggcgattgattagcactctacatgaggtaaccagcgtaacatttgtcattccaaagaggccataaattgttgtcaattcaattatttcggcccaagcacagttccagagctctcagaaaaagtggggaaaacaccacgttctacaaagatcaccggagctttccctggacatggacacgcacgatcgtctcatggctaccgatcgatagtccatctgatgaaactatctttcgcagcccagatgccaccagcaaaagtctggacttggacagttggaccggtcaagtcgtcaacagcaacggcgtactccctcccacctgcatctgcgtcggatatgcactggacagcacggccggctcagagattccagacacgagagacgagagctgaagagcgagtcctctgaagtctcagcttgtggtggtggtacgattcaaagggcagcggcgaccggccggcacgcatgcaaaagccatggatcgtccgccagagcgctcatgatggtgtgtgtgctcggaaggaggaacaaaagacgatcgagacgggtggtagcctagcctagcccaccacccccatcatggcgtcgcctcctcgaccatcgatggcaaaagagaaaaagggttcgatcggcacgaaagaagggaagcaaaggcatctctaggcacagccccggtcgacagacgagcgcaccagccgccgtacgatgcgtctcgctacacgcacgtacggcatctcgcgcgctgcgcaggcaggactcgctcctgtcaccggcagcatcagcgtgctccggcaaacgggggacgcaccggcgaggccgcgagggggaattggcacggcgcttctgccctctcggctttcctttcggcgggaggcatcgcgcgcgcaaagccgccgcgacgtgggggcgggccatgcgctggcacacgcgcgggcgaggggggccacgtacgagagtctacctggctggcgtcacgccacgccacgccacgccacgccacggtacacgcgaaaggtaggcgccgtgcaggacgagacgccgtgcgcgtacagctgacgcgcagtcatctgcgatctgcatgcatgcacgctccctctctcctcctccctcgtcttgttctccggtcgatccatcgaagaggctaaaaggctttaattgagccggtccgacccacgcatccgtccgagtccggcagccatctgatctgatctgacggtacggtgtgcgttgaacgatcgacgatggcgtctgacgcgcgcgcctgacatgtacgcggacgcgcatacatacacgtagtgccacgcaacgccacgccacgccatgccgcgccatgatgccatgcccgtttcctcgtgtcagcttccgccggaccggcagatttaactgtggcgtagcagtgaccgaaccggcgcccctgcgtgtggcagcttctgatcaccgtatcacggggcccggccccgcgaacgatcgatcctggaatcaccggccacacgcccgtgttccgtccaaccaaacgtaacctcgtcaccatgcgagaggtgccgtgccgacctgtgacatgtaaaatcagcatcagctagctggaacctgatcgcctaaacaatctggacgttttcgcttgtcccgggtcaggcttgcatcatggccacactatccggtccttgtacggcgtgatctatcgccggggcctctcatcatcccatgccgccaaaccacgtctccgtcacaggcgttgtggccttgtacgatgagatcgaccggggcgtgaatgctccgtgacacaggggccttcccgtgtaatgccaatggggctcactgctgcgccgaattgacggtgccggatgtggcgccaaggcggccactgcgccggtttggagtttgacgcgaacgggtggcctccagcagtagtagtctctggagcaggatggatcggtgagacgacgggagggcgacacgtgggcctgcaggggcgacggaggcttcagccttcagggaccggacaaagcaccacctccattttgagctacagttttgtgagcgactccagcgatttcatggcgtctcgcacttggcacgttgccctcggtgagacaccgaaagcaacagcgaaagagaacacacgtagaaaaaccacgggccatacgatttctgacctgagccgaaaggctttaaaaacggaaaaccaaaaatgtcagcagcgtttacgtcgtgtatactgcttgtagcagggcagaggtttcacctccgtttgcaggttgcagcgtgcagcggtcggtccccacgccggcttcgcttgccgcctcttgcacccctggcacttac

SEQ ID NO: 8594 - DNA, 7806 bp, Oryza sativa
agcgttcaagctcgatgatcaaaccagctgcctgaacaagacgctactagcagattttctgaagaaactcaaggccctgaacaaaccatccacgcctgaacacatgtaaaggttagctagcgaaagcacgcgtcagggcgcagcatcaggcaagcgaccagcttttgcaagttgcgatgcgaagaatgaattattctgtgcgtgtgcagatgcaagaagacaaacccatgcgggaacagttggagcctgtagtgagacagaaagaggagcatagtgccatggtgggtttcagtgttctccacaacggaggcacatccactaatttgtagtattctatatgatgcctgaggtgaatatatgctgatgataatacagctcaggtagtaggcccggtgctgcaaacgtatgatgcgtatgtattgagcaagaggcaggggcacatacaaatactgcaccagatagcaatggcgagagaaatcagagagcgtaaattatgcttcctgtctctcacaagtgcgaagcagcgagtggacactaaccttggtggccacctagagctatcctagtacaaatatgtttgcttaaaaggtgcatatctctaaggtagagtacaagatcaccttgtaatttatcaactcaggtgctcttttggtcgggaggatccgaaagcacacagtgggaagtcagcaaaaataccaataaacatgcttacatgtaatgcattacctacttacctgatttctttatcttcaggtcgatccgttgatgtagatgatagtgtgatatcagacggcaaaagattgcaaaatctgcactgcgaaagctcacactttcagatgcatcaactgccggagaaaggatcgagagcgatgtatgtggattttttttccatcaatcattacttcatgagtgacaactgcaactttcctagcaatcgtttgctggcttagtatggaaatgccggcgataaaatatgatttggaggaaaaagaaattgcaacaaagaagtggaccatccactgaagtcccaactctgtttggaagttagtacgtcgagtaatactgcttgatagcatcttccgatcgagggaccaatctcaggaaggtccaaacgaatgcaacccaaagcctaaggttcattgtttctgcaaatgtcgtgttttaatcacaaggtagcaacctaactattccgacaatatggatcgatgcttatctttattcaccttctatcatatctgtatatatcacaatgccgacaagtcagtaataatatgcgtaacatggaacctgaacttttctgataagtttattgcaaagttttagtttgcatctaatcctcatactaaaaagaagtgaaggtaggttgctttccctctcctaatgaaaaaaaaaataaagaataagttgtctgaaatgcagaaggatcaatacatgaaacacgcatacctcactgctatgcagtggaaacacctttgttatgcatctcccatagcccaggacctctctgaacatctagaatcctatatcctttgaaagcccgatttcacctaaaagttagatcttagatggaggcatcacatgagaaatcattctatgaaagagaattaatggaacttatcaaatgcaaaaaaaaaagaaaaaaaaagaggaagaatgtgaacaacacctgtccaactggaaatgctttacatctcatggaaattgacacgagcaaatgatcgatgatggatcatgtctctgctacagatgctttcaaccattgaagattcctgcttctcctacaaacattcactaccagcttagatggaaaggcaaactgtcaaccagtggatcatgcaaacacagtgaaacagaaaagctactatatcgtgggctcagtaagtcagaaagatacacatcaacgttctggatggtctgcatggacaatcaatctatcaaaaagctagataacaattacatgcatgcagcacagcagtactgcccatgatctagacttatcttttacgctatgcagttattcctgaaaataaaaggcagtacggaccaatctatcaatgatcagaaatgacaagcaaagcattaaagtaatagacaatcattagttcacattttgaacagatgtactagatatgcattaaacgtacataatcttttcttgattctcatctgtaacaacctctgaacaattattagtggaaaccttaattctctaagcacgtatcttcgtacagttccacttcaagtatagaacagctgcaaaccttatgactgtactctggccggcccggcgaaaaaaaaaacccttatgactgaacaagccctgattcatttaatcaaaaacagcaaaaccgagtccaaatcagcctcagctatgttcctcttgcagttttaagaacaaataacagttgctccaatatatcagtactggatgttaaacacctaacggccatttgcttattgtctcggtattacctgcaatattgttctatagcactaaagtaagaaggccatatggccatatcatcatttacgaattttgaaaggggaagctatgatccttacctcaaccacattattctgatttgaggtgcgatggattacctggtggtcaaattccttgataagcataattaattccaatcagattgatccaagaaaaccgatcagcgatctgaccggtaacagaagccagaaggaacatcaaatcctgagatagcatgtacaagttactaactactcctaggtagtggaagattgatgtgcttcacttggagatgatatgagataaacatgatgtcatgatcttaggaacaggcgtcagcaggacgggcatcaggagccctatagtatgcactcaagaaagaataatatagttcgtaaactattttaccttgttaactagagagttgggatcctcaattgcaaaagtactacggagttttttttttctagccaacgtgaaaatcataaccaaacaataagccaacaaagttcggagatgctggacaatccggtctggcgatctccttactggcggttgcgatctggcaatctcccgtcttctgttaccgccatgatctccccgggctccggccgctgtctacatttgcaactcgaatccactatcgcgggagaggagagggagagagaacatacgcgcatacggcaaatcactggcgagtccagccgccggggtttcgccgccggtgagtcaccagcggacgatggctggggcttagcagttgggctcggttgcgctttcccgtggagtcgtccgccgtttactggatccacttgggtggcggcccgttggaagtttcatggtaggctttccgctagggcaatcggcttcttgttgggtttgtctcgggccttgaaatcatgggcctcttgccgtcttctatagtccgtaaccaagaccattttggacgcgcgctgctccgtctcatcatatggaactttcctagcgatcctctagaaggcagaacaaactctaaacgcggcctaggcgattaggatttataggcgggccagcgttcatgttccgtgtgatattacaggattcatgaagttcgtgaaattttcctccaaaaagaagtaaagtgcacggacggcatctaaacttgtgtacgtgtatcatctagattcctgaactcttataatatacttttgaatatcaaaatatcatacaggtccaaatagactagacccattccatgcgctaccgtgatatgctacggtgacgtctatgtctgttggtgggatccacgtgtcagtcaaatagtaaaaataaaattaaagagtgaggggaaaaaaagaatgttttgaaattttgaaaaaaaaatacaaagagaggagaggatatgagagagcgagaggagaaaatgatttatttatttatttaatatgagactaatatgtagatttcactgacacgtataaactatcatggcaagtcacatcagcagatatattggattgaagctcgtttgaatctatatgacacacacgataaatctgaaatccaaaaataaattttaaaagtttagataccaatatgacatatccacataaatttagacacacgtttgcactttactctttaaaaaaaaagttcgagaaaaggttatgttatttttccatgcttgttagtcacgtactcttcacgagtcaggaatgtcgttgggtttgtgatctcaaactcttttttttattattttcaaggatgccgttgagtttacggtctcaaactctcctttttttatttactagaaaaattgcccgtgcgttgcaacgggtggagactattttaatcttattattgttatacggtttaattaaggtgaaatttactatgagaattcgtctggatatatatatatttctatataaaaccatgtgatgtaattagaagtctgatcatctcaagttagcatgcgagtttttttaaagagatttcttatatgactcatgtatttacaaaagcgaacgaacttaaaacccgagtcaaatacggatttgtatttctaaaagcgaacaaacttataaaccgattctacacggatgacgtaccaaagtaccggcaaaaacatctttaatttttataatattagagatttatttttatctgactctagattgcttgaaaaacatgattttggaggaagagacatcattgcaaatatttttttagaagaaattgtaaatatgttatgaattaaatacgggaccttaggttaaaattatacaccccttaccactcccctgtcaaatgcatctccctagattgtttgaaagcaaccgtagatacggttcgcccgtgaacttgcagcgcagcgggagatcaccgcccaagtctccgaccattttcatttctggcttggcagagttcacatcagcaatggcacggtaccaaacttcaagcatcggagcatactttatccaaatttgatttttaaattttcaattgatttcagtcttcagaatggcggacagttcttgaaaacctgcagaaatcgtaaggttgacggctaatccatgacttgcgcctcaaaatgctgaggcgcacgcgttacatgcctgatcctctggccgcccaaccccaagtacccaacacttcctatccaaaaacacgcactttgcttccggatgatagctgcaacaaaccatgagccccacatattggacactgccttgaaggatcactattatgttgttggtttggtttgactgagccacggcctggagcaacctgcttgcttaatcctctcgataacacggttaacacctgcggattgccgtggggaaatgctcgtcctctttgtttattccagaacaccagatcacaaatagccaatcatgtacttcctgtttcggcgcaagaggtcgcctacctgcacaagttctgtgcagctgcctgctagctccagcttcgtggccctcgatctgtgctgtgcccgcgctgtccatcccgatcctgtcgttcaggtgatcccgtattcaagtcatcaatagttacgccaatgtaaaaaatacgttaagacacttttaaattgtaggaataaaaatacacagaaaatttgattaagatgcaagggaaaatcaaataattgcaaaacaagaaaaaacaaagaaaaaccattgattagaccgtaggaaaaaaacggatgaatttcggatgagagtgatgaactcaaagaaaatttttcaagaatttcaaatgacaataggaatttcaaagatccataggaaatttgttttaacttttaaaaacttctcctctaaaaaaattgtacttttacaacaaattttctacaaaattaaaattctttaaaattcatattttttttcctacgaatcaaaagggcatttttctatctagactgataacgcagaaatgacagtactgtattcactgcgaggtgcgaaaagaatattccataatattatgactggataaagttgtatgaaaatattttaataagattaatggcgtgttagggagtaatggaaccggagaagtaagcgtagaccgagttttagcgaacgttgcgagaggcgggcggcctacaaagcgggcccgcgtttcccggcccacgtcagcctgccgcgcctaccgttgactctccccagcccgatccgaaaccaccacctccccaataaaacccacgcgcggacacagcgcacgcaaaatcgcaaatccacccacccaaactcacgaattcgatggacaccgacctcggcggcggcggcggcgcgtcggggatggacgaagcggaggcggccttcttcgcgcggcgcgggcggcggtgctgctgcttcccctggccctcgtcggcgtcgtcccaccagcgggtcggcggggcggaggaggagagctggtggcagcgcgccgtggacgcggtgctcaaggtgcgggagtggtcggagctggtggccgggccgcggtggaagaccttcatccggcggttcggccgcggcggcggcggcggcggcggcggcggcggcccccggccgcacaactacggccggaagctcaactacgacgcgctcagctacgcgctcaacttcgacgagggccacggcgccagccccgagggcgactacaccggctaccgcgacttctccgcccgttttgccgccccgccggcctccgccaagtcgtccatggacctcggcggccgggacgccccgccgctcttcaacccgccgccgccccacgacggcgccggccgggcttgacctctcgttcctctcccccacaatcacttcaccggatcaaacgagaacacggcgtcctgtcctcgatttgcttcgggttgcaatgtcgtgatttggtgagaagcgagatcgatcgttgtttcggttcggttcccctctcatcttctgtttccttcaattgagttcgttcgttactgtacaaaaaagaacatagatttgtttaattcgttctctgtcatcgaattgtcgccgtgaattcgtcgatcgtgtcgtgccacagttttgtcccgattgaagcaaacacgtttgaagttttttgatcgatcaaattttactccctctgttttgcctggaaacttgcatgaatggtaagaaagaggaataatcaaacctaattccaatccaaactctgcaatctgaaatcatgccgtgttccagctgcgagtgattgcgacccaagaattgaatgtgaggagaccttgggaaagagccgtgcacgttggacttctggtcctacaagcaacttgagactagcaatagcaatggctacggtcttgttcccatcgatccttccgtgtgacgtccacttgttgctgagaatagcttcccattgcctctcacattccttcctaactggtaactgcggctgcagctgcgtgattaaaaggtgtctatttgttaatcacgggaattacgagctatcggttcagataatcacggaccatggtattgaattccaggcaggcaatcgtgattgatactagtcatatctaactatgaacaggtaggtacttgctgagcaatataggattatttgcgttgcatcaaatcataccagaaacagtttggtggattggatatagtactaccactttgatcatttgatgtctaataagagtgccagctcgtaaagcctacagacattcacagctactccaaccatccaatggatcataatgatttgttacaaaaaccacacgtaatccatgaaaataaagatcgaagatatagagtatgatacctgtgagcagaagcatatcatttcctcatttcatcctatcttggtctttacccatacgttactga

SEQ ID NO: 8595 - DNA, 2458 bp, Oryza sativa
aagaaagcagaatccccacttcaccctgggacatgattgctgagacctgaagcccgtggtcccaatgtttgtacaatgatatgtacaagtagagtctaaaacttgcaacaagaaggaatatttgcatgaattgaccaaatctggcttttccaaggaaccattctctgaacagctggtaaacaatgtactactagcaagagatacaaaagaaaaaaaacagcggctactggaactgctgtaaacaatagttctgccgaatcggcatctcgctatgattgcagtagttgcctgcagcatttggtactggttgaacactaatcatttgcacaccaatgattttagtagctcagatctcaaaagcaaaacgctggaaatcttgtcggtagtacacatattgtttaatcagtgtggtgtgggtgtgtgagggctggcacttcttcattgctctgtgattaaatatgctaaagatgagagactttataatttagtatggcactatacaagtattgtaaaccactaacagctctctaacagctagtatcatgtaatataataataacatgataaatatcaatggcactcaaaaacctagtcatcaccacctggcgcaataaccaaaagctgaaactattttgagttggaaacctcgagcgataagcaaaagcttgggcacaagcaggattgacaaaagacaatggttgctacttgtctgatattatcaaacaaatagcagcggtaataatgagtttttaacggacaaggaagtcaaaggaaaagaaaaggaggaaggacatgaccaacatttgcaacaatgaagggttacacctttcagagtgatgaacaatagatatcactgcaatttattgacatgtaaaatactgcaaatcccaaatagttaccattggtataatggaaatattaattgaaaacgaaggtatctggctttgaataaagggtttcagacttatcatggatgaagaaagttatcatggacgaagaaagctcatggaatgctttctgcgatgccaaaagagaaaaaaaaatatggttctaccatgcaagttaagagattcttgaagatggtattgtaaaatccagaaagcatcttttaaaagtaagaacattaatctctaaggtatttatttggatttaaatatttagtacattgctaagagaatgcaccctgagtcatgcaaagtaaaggccctccatgcatctttctggttacttatcaggaacaacaaagtaaaagaaaaaaattaacttccagcaagatgtaaaaactatatagttatttaccatcagtccaaattggtagctaaagcaagttagaacttcaatcctccaacaattatgataagacgtccaaaagtgcactttataatgatattatcattcaaaaacaagatgtcgttatagacccttcttgttcagaaacatatgccttcctatgttttgaagaaaaaaatgctcacaatctttccttccatatgctctactttttaaaaatttcccataatgaattatcatgcacatgcctatattgttatgctagagattgaaataaaatttatgtatgagggagtagaagatagtaggatacaggcactgaagcacatacatcactgcgatatgtgagttcttttttgggggggttacaatgaaatgactgatgggtttactcagactttatgcaatcatcccaggaaattgcaggtcgttaatcagaggtttctccttaaatgggtactcctgcgacttaaatcccagatgtgaccaaaatgtccaaaggtgacactaagggaatatgttctattagtaaattgatgatgcaagcaatctgtgcagttgtctggttattacatcgcagcacaggttcctatttgatgaacataataaaaggaaactgagtaatctagaacacctattatcatatactgatacaagaaacagtggaaactgcattaatcctgaacaatcacaagcagggtgaaatatgtaagcctgtcaaaaattatctttcgatggggatggtcattctagtgaaaaacatacacatgtgaaattagaccaaaagaatagctatagttaagaaattcaacaaccagcactacaaaagaaagaactatagacagtgtcacatatttgacttatctccagtagcatctctcttcatccacggaaaactcgccgtttctgagcaattgtctgaaccagctggcagcttgcccttcacattagaccactgccaaatcttcgacatggagaagctctcacctttactctttgcacaaatcctcttgccctccataatttcagcattgacagagcttatgccagtagctcttcccttcaacctgctgcccacgccatttttgttacgacctgggtggagagccactcgaagttcagaagccccaagaacatattggtaagtgcccatggagaagcacctcct

SEQ ID NO: 8596 - DNA, 3552 bp, Oryza sativa
tgaggaagagaggagggtttgacgaggttaatcctcctccaactcccaagatcccctccccctatcagcgcaaaaccatcgcaagaagaaacccccccacccccagcaaccaaaatccgcagacgaaaggatccaagctcccccacctaaaaaaggccaaatttggtgcaacgcggacgactccaaagcactagagcccaaaaccgggcgcgcgcgcactttcgtgcgtggagccccggatcagcagatcgggggaagggagggagggacgaagcggatggggaacaaagcacccaagaattgtgtggccggttgggttcacctccgaattcctcctgtgcgatgagagaaccaggcgaggcgagaaggagagggacgggagcggtagcttttggctccgtgttgtgttgtgttgggctttgggtgcgcgtcgctttcggccgcgctagctttcgtctccgtggaaaggaggacgcgagcccccgtgtaggtgtagccgcctcgttcggtttccgctttgacccgcggaatctcagctcaaaaaaatcatcagcgccacgcgaaaagacgagaaaaattcatccgatctgctctcaaactcccagattctgctcaaattttaaacgtggacgaaaatttgcagtgcgagtgcagggacagatcaatggagcactggaccgctatcgttgtcgtccaacctgtcgacaaaattaagaattctgacctttgtttgaatctatcgggcagttcgtcgctgcgagagattcagacagggggacagcgagttcacaacaacagttctgcatggggcctcgctctgtgttgtttagcacggaggaggggggaccagattgggctcgtgccatgtgagtaagtcttggcatttgttcgtagcaagtgtaggcgccagtgacatcgctgtgcggcacatggccatgcagatgagtgtcctggaacaagtaggcggcagcactgtagtcctttgtctggtgcagctgggactccagcaacggtacgggagaaatcaggattgaagtaacgagtcgcgcagaattaggccctatttagttactaatttttttttcccaaaaagtcacatcgaatatttgaatatatgcatgaaacattaaatatagataaaaataaaaaataattgcacagttatgagagaaatcatgagacgaatcttttgaacctaattagtccatgattagccataagtgctaatgacggcttaattaggctcaaaagattcatctcgtggtttccagtcgagttatgaaattatttttttaatttgtgttcgaaaaccccttccgatatccggtcaaacgtccggccttaatagttggaatcactcgggagtatttgggagggaattggaagatctagttcgccacgtcatgtgtttgatttattactatagctatgatttgttgtagtttcttaatatttactttctaactttgttacaatcatgattataacaatttattgggcaaaaaaaaaattgacatccttgcccagcacgagttataacaatggtagacgtgactaaacaactcttaaagtggtctaatatatctatattcctaaaatgaagtagtgctagttgcagtaaatttgttcctgtctaccctgttttctttaaaaaaaattatctcttgaactccttgtttttttttaaaaaaaatcgaatcttaatggatagcatgtataaaatcatataaggtcaatattccctatagtgaaaggatacaaaacatatattaaaaagtacaatttaatttactgtaaaccattttttttttgtgccaatagcaaagtacggacatttattagtaaattcttagaagtatgatagaatataaacatatttcatatgtaaattctcgtgacatccagaaattttaactatgtataattgtaccacggataatctagaatggtataatgcttatgttgttctgcaattgcaaataatcatataaggggaaaactatatttaaccacttaaaaaatgtggttgtgctacttaaaaccataaaatatgatacttactacaacatggccaagtgtctagactccaccttgaaagaatctttatatcgtctatagggtagtgaataggcatttcctgaaaatttaaaactcttttacagcggattagtagcactcggaatctctaggcctaggagattggagtctccgagatgacaggaaaatacccccaaaggggaacaagccatcaacacaactagtacatagaaaatatagcaataatggatgtaaactagtagaaaacaagatacacaagctatcacaagtaactcgcaaaagagatatctatcaatagcacaaaaacggtaaaagagtgcgaggagacaaacgatttgttcccgaagttcggattctccttcgagaatcctacatctccgttgagaggctccagggagccagatctcacttgatccctttcctcaccaagctagcaatcacaaggaagactaggtttccaagcaaccacttaggattagcaagtctttaaatgaccccaatgtttgtttagatgatgagccccaatccaccggtggcacttgctctaccaagcataactctttccttgttgagatgagggaaaccttcacaaactttccgtggttcaccacatggttggaagctcaccgggtgatgccttgtcgtcaaggagggttgacctccaaaagtattaaacacaatcgaagatttgcttgctatgaacttaaatgctcaaagtagctctcaacttctattctcaacctctcttcaatcccaaatccttatattctcaaatccccttctcaaatcacactcacaaaagagttctaccacaaaggtatgatatcagagagtggctctttggttttggatggttctactcttgtccaaagttagaaaccatggatggaggggttcaaatacccgagctctaaagaaaatagtcgttactcatgtttatgcgcataccccgaagtctcctggatttggcctggagccttcggtccaccccaagaactaactgctaacacacgggaaaccttctcgggtgcatggatgttatttccagagcctcttggaagcctggcttgcataggcccggagtctccaagtcccggcccaaagcctcagggaagccttcttgagtactcgaagtctcatggccacctgacaacaaccaagaaaaaaaatgtgtaacttcttactccggagtccattttcgacgatctgattgatacacataatccatagcttcaaatggtctcctacggcccgtacgacaatgtcttcacttgtccttctccaccggattcggtttgtcgacgccaagtcccttgcttgcccttcatcaccacacggtctatcatagccatgcttcgcttgcgcttcaccgtattgtcataggtagcctttttatactccgcgtgttcaggggccctttggatcaaataattttatgcaggaatttcatatgattctaatcctataggaatttttcctatgtggccatttgac

SEQ ID NO: 8597 - DNA, 664 bp, Oryza sativa
cgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgag

SEQ ID NO: 8598 - DNA, 955 bp, Oryza sativa
gggcccacccaccattgacacttcccacactatcgggtgggtcccgacccggcaactttttcctgctgcccactgacaagctgatctggcggattttgccggcccacttgccatgcactagtggtctagtagtggacaacgggtatttgtcattactgcgcaatggtaacgcgtacacgtcctgcccaccacaacgtgcgtgcagctgccaggtgggacctacgtttctatccccagctgggccccacgcgtcatgtgaatggtatctttcgtgccatgtgctgggccggggcgagagataatgcttcctgatggtgggacccaaacattaggtgggccacctcaacttgcgagcagttgggcttctaatggactgtacctcttccgttttggttggtcatgggcttctctgtcgccccccttacgtgggctggtcgttttgctttgttgcctccatgggctgaaatgggcttcatggcccttcactaattatttgggctttactgtacggcctatcttaggagccactgcacaaagattaggaataagttcacttggtgaccctcaaaagtgattgaaatctaatccgtgaccctaaaccacaaaaccggtgcaatttgactccctcggtggttttggagggcggtttcgctgatgtggcgctgacgtggcggtattgaccgggtctcctttacacgtggcgttgacgtggcgtttaggtggcatttagaattaaaaaatatgtgtgggacccatttgtcattgacatagattgtgggacccacgttccccttctctctcccctccctcagttcattccctcttcccgccgctccctctctctctctcctgcggcgggcggagacgacggtgaacggtggagacggcggtggaggcgcgacggcctgcgaacggcggcggcgcccgggctgagctcccccgtgggcgggcgggt

SEQ ID NO: 8599 - DNA, 1240 bp, Oryza sativa
  unsure (1)..(1240): unsure at all n locations
ctgcaagtacgttcatcagcagcgaaaaacgagtggtggttgcagggcaatttcaggtggatcgatgaacccggcaaggacgctggggccggcgctggcgagcaacaagttcgacggcctgtggatctacttcctgggcccagtcatgggcacgctctcgggagcatggacctacaccttcatccgcttcgaggacacccccaaggaaggctcctcccagaagctctcctccttcaagctgcgccgcttgcggagccagcagtccatcgccgccgacgacgtcgacgagatggagaacatccaagtgtgataggacgacgagatgtcgtcgatcgtgtcctcttactcggaaaattaccagtcgatctcggtctcgtcatcactagctacgtctttgtgtgtgttttgtgtcgtgtcactgctgcttcgtacacgccggagagagttacataaaacgcgcgcgcgtgcacgggggagtggcgctagctttggttgcttggtggttcgtgtggggtacgtagattgctcgctctgttaattccggggctggagcctgctaattttgggcgtgtgcgtgtgccgcttgtgcatcagtctctgccgtcaaattgtgcgtgtgtgccaggtgtactatctctccagcagttgcttgttccacttcaattcacccccaaagtaattaaaaggatgtcacgttctctcccctatataaaacatctgcgactttatatattgttgtgggggttgcatgtcttgcatgtgcgttatcattccgtcaatgattaactgatgatgtcgctaatgatcgatagagcttggttgacctgaacaataccgtggggcactggaaagagtattgtcatgatatcggcccctgttgcgggcatgaacacttgttgagaaaaccgtacaaacagcactaaaacagtgtgttttcatgggatatggcaccttagttttctcttctcctcttctccacgtcaagaaatagctatacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8600 - DNA, 738 bp, Oryza sativa
aacttcccaagccttacatgaaaaactcttttctcagtaactgttggttcctcatccatgggcttcttctgtctggaagattggaatccatcctcgcattcttccgacagccggcccttctccaacctctcatcaaaatcaaacatcaggctctctatggtcaatccggggacatagagcgtaccacggcaaagcgggcacgtcgaattggacagcagccatgtatctatacaatgcagatggaaggcatgaccacacaccggcaacaacctgagcctgtcctcaccgtcgaactcacacaagcacactgcacaatcaaacggctccttgtcaccaccaacaatgtcgcggtaggcaaacaccggcagcgcgtcgatgaacgcctggtcgagcccagaatcgtgcaagtggaacagctgctggagctgccggtccatcgcggcgtcccgcccgacatgccggctgtgcggcgacggggcggcattctcggctccaccacggcggtgctgctttttcatcagcagcctcaccaggaggtggagaaggccggagatgaagaagatgaccgcaagaatcactatgatgaacaacaccgcggggctaatcctccctccattaccaccgccatctgccgtcggcggcggcggcgggggtcgggtggtgtacgccgacgagtccctgacggcgggatggataccatgggaaggagagcgataggcggatagaggtgcgagagat

SEQ ID NO: 8601 - DNA, 725 bp, Oryza sativa
  unsure (1)..(725): unsure at all n locations
tgagcacgaacgacgcgcatatcgctccggtgaactgcgccgcccagtagaacggaacctgtgtaagggagaaaaaaaataggttgaaaagatgtttcatttcaacgctttaaccctgcacctctagctggagatcgatctagagcagtcgcagtagtatctaactgcacattgcgagatgtctctgttgaagccgggacgaatcggaaatncggggttnccggggttcaaaaggccctcacnncgggtggtggtgttgctaaggtgaactatactnangatagagtatgatagcggactaatagcgagaatagcggcaactagcttagccccggattcggtgccgatcgatcggacgacggcgccacaggcgatcgatttccggcggatccctatcgatcgaccgaatatatggcacatgaaccaccacgcacgccaccgcctttacatgaattcttgcgtcgcgaccggttctcctgtactgtatcgctacggacacttgtccctgctagctttacgtgcagtggcaacaaaaaagcctcgaccacgatcatactcttgtcttctactagcagcagcagcagaagtgccctgtggattgcgatgtaaaaatagactatatggaatgtgatccgtggcaactaactcagcgtatcccagcttagtggcttcatctttaatttggctgtgctggggttttgacgcgtgattgctcgtgttcaatt

SEQ ID NO: 8602 - DNA, 7341 bp, Oryza sativa
ctactgcccaacgtgttgtctggctgtactattgtttgtgtgttgctgatatggagtggttgcttgctttcaggctccagctagctagacaaatgtgtagtgaaaaggacctatggattaaggtcgatatatgttgttgacagaagagacgacattaattccttatacaatgcggatgtgtgcatcattatggtatatataagtttaatgaccttgaaagatatgtgattggttggttcggataacaagttacatgagcatataccacctctcgttgccttttgactttctttctggccggcgacataagctagactgaataatttggcatatatgcctaaaatagagatttaatttggcagaatcaaatccatggcaacatcttgacaagaacgcgtgaataaactaagtacttaagtgaggactaaattagccaatgattttgctctcttgagatttaaaaagtttttcagataatgaagagggttgcgtcaaaaattaaaaaaatggagaggatcaaagctgacgaaactctgaaaattgtagctatcggaggtaaatttaacaagattcagataccatcatatgtaaaaagacaaccggaacaagctaaggtcgtttcagaaaaaattcttatgtgactactaatattcaatcagcactcaattggttaggtgtctctgctaacatcttttggcaaagaacagattgaaagaaactaagaaagcatctagctagtatgccgaagtagtgcatggcttaagtcgtacacatagctaactattatattgcatatatattttgatgcaagaagtaatatatatgaagaattggcagtttgaggtagctgtgttgctgcatctgcatacctgaatccaggggaaatgcctgaacacggcgaacgcgagcgtcacggcggggttcatgtgggcgccggagatgtggccgacggcgtagatcatcaccgtcacgatgaggccaccggcgatcgactgtcccagctgcgatatgcgagacaggtcgctgccgctgatccctgccgccccacacgtcatgaacaccagcaggaacgtggccaccacctccgacacgacctgcagccatggcgatccaagcagcgtgcacgcattagctcccccccagctcaatcgatctcgaatcaatcaagcaaccagagaaagacagataaagctctgaaagtctgaagaattaatcattcagctccagactcctcaccttcttgaggaggtgaggagggaagaagtcggcgatggccttctcgccgtagtacatggtaggcatggtgccgttctgcaccgtggagagatcgtggatctcgttggagtagttcgccctggagtttgttctcgagttgttgctggccatttctgacgctctatctagctgagctacttgtgcagcacgcgagtgcaggaggtagaagaagaacaagcagctcaagctctaacactggctggctagctcgctcgctccgtcgatcgcttgctcgttgtggtaatgagcaggagtatttatagggagatcgagctagctaaggttgagaagcctgagcaactgggaggtggcaggtactagtagttacagtcctcactgccttttgattaggcaggcctacttgtcggagcaccactgggtacagtgcttgcatgcatagctcattagccctaattaatcagcataagatcattgtttctggtctaatttttcgacggggattcagattttgtttaatccgttcaaacacgttgtcggatcagcattggccgagaaacagaaacgcatacttgattttgtattctcgtcgagggcataaaaccgcgcgtcatccccccgtgaacgacaacgagagcaacgttgcctctgtctgctgttagactgaaataattgtgggttttcaattcacaaggtgttgtaaactatatgcctggataaagcgcgacgtcgaggtcatgacgccgatatatgggtgacgaacaaattctttttcttttgtagattgggggctcccctgaaagaaatgatactatagggatggatatttttggtcattctacgtacgttttccatgccgaatgttaatacgttttttttgcgaaattcgtcacctgttgtaagttgacatttttcataatctatactcgtagaagagacgaaccatgtgtgccaatgccaactaggataaaccgtaccgaaatttactattggccgaatttgccattgtccctgtcagaggttgccgccattgccagattaatgatggatccgtggcaactgaacaaattttcaattgtaggattgccatctctggtgaccaaattgaaatatccgagcagttaaggatttgcaaaggtgacattacaataaggggttatcctaaccactctattacgcagtgtgcatgcttcggttagcaatgctaagcaatgtcagagcagaggacgttgcacttggatggtcactgtcaaaactgacctgctactattgaaaaatctcatgtcagttggagtacttcagcaatttgcaatcctagcttctctcattgagcttagctcacattcagtttttctttttttgccgtactgtacctgtaggatactccctccagttcgaaatgtttgacaccgttgactttttagcacatgtttaactgttcgtcttattcaaaaacttttgtgagatatgtaaaattatatgtctacataaaaatatatttaataatgaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaagaatgaaagaacccatattttgatcggtacagctcgttgcagatcagccactcgacttggtgaaaatctcaggccttacagagtttgctaggtatttcgttcacgaggtgtttcaatcaggtttctttcgcaaaaatgcagataatttattgatttgagatgccttctgtaatgagcactcatcaatactttgtagatgtatacatgtagaatcaagaactactttacgagcaaagcaaattaaatgaaaataaatggatattggtactgaaaaataccactaaatacacacatgtgcaaacagagagcgctttctggggcacgtttagaaccagcaccttattttgcacgatctacaggatgaaaagacagcttgtgctgctgaaaaaggaccaatggcttttggttgctctccctgagatgagactagcgcattggcatgaggccaggccacaagagggaaaatccacgcttctctgcaaccccttagcttttcatgagaggcatggaaccaagatagctgacgagtgagcgatcagatcagtgaatcaatcacagatgcaccatccatccagaagctggcataattaccttcgctgattattgatcttcttttgtctgcgctcctcaggccactagtgtagttcttgttaatcacttttgtgtgtatgaatctaactacatttcctggcataatgctaggccctaccctgtgatcaagcagtagcaaaagcaccccatgttgaggtcaggtgtaccatccgatatctgctaagttgatatggtgccctgaaccattctctgaagaagcatcgtttagattcagaataaccatggttttactttgcacaagtctagctaatactgtaggtaggttccctgatgcatctgcaatggcgcgcgcctgacctcagaacttgaatcagttattcctatatggcaatcaatcatgtctgtcttcccatcgaatcacctccgttttcacggccttaacaaaagatctgaggaccatatatgttctcgattgttgtcgaaggttctagatcgattcaccactgtcaaaccaagcaattacgtatggaactatgaaacatatcggattttgacgaataatgattacacatatttttaattcttttctcctatattattatgtttcgaaatcagagcagataatgtatggattcatatgtagatattgattgttctggaatcagacagaaaaagacggactcatagtatgtcttctaatttatcagccgtgaccaaaatttaaattttaaaacataattgtagtgttgaacttaagtttcttacttggaatttattttcaatattgacttataaaccgctaagaatacggatataaaaattttacctgtaaattactttttattgggaaagaacatgtaacctagcagttacagtgataagtagcacatctaggttttgagttcgacaccccaagagagtgaattttaagcctaattaaaaaaaatcacttgttggccctgtaagatcgaacaacgagaactaagattaccaaacagagagaggggagggggaggggggttgaatggtagcaacaccaaacacttttagcggaattaaaagttacaccagtgttagatctttggtctgactgtacaagcctcattggtctgaccgcgcaatcaagccaccgcctcttgttgacacctccggtccaaccgccatagatccgattgtatgaccgagtagttgccgttggtctgaccgtcggtattcttccggtgtgactgttgtactccgagcaaatcacaaatcgaaaaccctcaaaagtagattaaagtttatttgcatatattcgtgtttacaaagtgcaataacaacacttctcttatagaattggactaaactcgaaaccctaacttttctttaaacttaacttacacataatcgatcacaagaggcctcaatcccctctctatttatacccgagataagcagcctaaaaccatgaatctaacttgtgcaatatatcctaatccactaggaaacatttctcgtacctaaaataaacttatctctttccaattcaaattccaatcttcctaaatttaaatcgactccttattccatatgtacacaatctcccatcgtatgcctcatggaatctccatcaaccacgtgcattgttttttagcctaagcatcacgcatgatatcccaatcgcccggatgtcatcttctctcaagttgattcctgaccatcatcggcaacgctctcccgatgcatcaaagcacacctacacaggaatcaaacgaagaaacatatctgagcataagttcttctcaactttactcaacattattacacatgtatagaattcatatataagtcataatcacgaataaacaaataaaaaacccgaaaccaacatcgacataaagttggccggtcatgctgtcgttttggccagtttgacagtgcacaccacgccagtatgaccagcttatcctgcccggtctaactggctccacacaaagagcaaaactacttcactaataatcttcaaatatcgaaatcaattatctcatatgccaattgttcatcataaaataacaatcaaaacacactttgatttcacatgcccctcataaaaatgtgttaagaatcaacctatggagcgtgggcctcgtataggaagcatgggcctcaaagaatgagttaaggaacgatccatatgaatgagtttgcgtgtgtgtgtggggggggtgagggtttgtggcttttctcggttggtttgatggagccttcttcttaatgaaaaccatcggacacttattttctcactggtcaagtttttttaattatttttcgttgtttcgtttatttttctacagtttattagctatgagtaaactatgaggttgagagctaggttactcggttaaattagacagaccaccggaaagccatcaaatttcaaaaagtgttattaatgaatgagggtacaaacggtagaaatgacatgagccattacaatttttacggtggtctatactgatgatagaaaatacaccactaatgtagcaaaccatacagctgttacttatctacagatcgaacattcattaattttggcatcaaaccaaactttcagctctaaccaaacttacactaagctttgatggtactaaaattttggcaaaatatcagacctaaccagccttttaccaaaactttggcatggtccaaatattgacattgttaaaatctattatatactaaaagtccattaaactttctacaaacgctctcaagttatcacgtggcgctctaataaattagagaaaatcctagaaattctaaaaaaaaagcaaaacatctacctcttgattttcacttaaattgatgggtccaatattatacaccattagataaaattgatcttaaaacaaaccaaataatatgggtcccacctctcctatttctcccgcgtgcataagtataggtcacgtacgtacatgtgggcctgtagtacgtacgcctccctccatttttttcttttttttcttcttttttccatttatacaatttgatatatatttgtttaaataatcatattttttttaaaaaaagaaaaaacatcatataactctttataaacacaggtaattaactaaattagctatacagactttgaaaataaaatttacaccatattatatgtaaattagctctaaaatcaatagtgtaagataatttactttgtactattattttcatataatgcactattttaaaataaagcttacacaatattatattgtgtacctatcaaataaacaatttaagatctaaattaactaatatatatatatatgtgtacttaaacagatagacccattatttaaatcatcggatctatttttttattactttggactattattctcaaataatgcattgttttaaaataaaatctacaccattaccattatgttgtgtacccattaaattgacaatttaatatatatatatatatatatatatatatatatatatatatatatatatatatata

SEQ ID NO: 8603 - DNA, 11217 bp, Oryza sativa
tatatatatatagatatatatatatatatatatatatatatatatatatatatatatatatatatatatatatatatatatatatatatatatatatatatataaactaatttacatttgcactaaaaccggtggacccattatttaaatcatcggatctattgttaataatgtctaaagttctctttttggcccactgcacaatgcacgtctgcacctctacctttcgcacatgtgacaaagtgtcgtatttgaggcatcttgggtgatcacgaccgctgcagcgctaccacttttgttaatagcatgaaaaaaatattaaaggtgtgatgcagcgagagaagaattaagtaccgtggaacacttaactctgtttaagatgaaatcgagagtttattaaataataattataatatattgtgttatgttgtatttggattttgtattatttgttcgtacagttgaaagaaatcattatgttataattgtgaacacaatattaacgaatatcaatagaactcttactaggataagagtgttataagggagtttaaggccctattttttccctgattccatcttttgaattttcatttgcacgctccatgctttccaagttactaaatggtgcttttattaaacaactttttaactttttagaagtcaattcattcgtttataatctcaaatagctatcacataaataagataattcatcaatttcagttatcctaacctctaaagtacatattttttttcatgcgagtcatggtgataagtaaattggtgatcaacgcataatcaaaatcgtatgatgaatctgtaagaactactatgaccaattgtaaataggtgtcaaaattaattgctattaattaaacatctaatggcttgctagcgacatatttaatttttctctacatatatataaacatggacgaagctagaacgaatattaacatacatcccatacatatatattacatgttaatattctaattacatgtggtaagtccattaaaatttcttaaaatgccctcaagatgacacgtggtgctctaataaattagagaaaatattagaaattctaagaaaaaaaaaagcaaagtatctattacttgattttcacttgaatcgatgggtccaatagtttataaactattagattaaattgatattagaataaactaaatactacgaggtcccacctctccacctttggtacgcacctactcccctccctttttttattttttcatttcttcttttctccatgaatatgcttccctccctttcttactatatcatgcaccttcatgagacgatttaatctatttactcaagaaaaaaatatatttcaaaagttgtaagtacttaatccatctcccactcaaagtttgtaaatggatttttaagatatcttaacaaaaaatcgaacccttaaattattataaaataacaatatccgaactttagtttgcccttaattatgagatattttttttaacaaacaataaaaatcttacctttcaataatataagtgcccgcgcgtatgcgcgggccaccttcctagttttgataaaggttgcatcagtaataaaccaaacaagcgctttggtggttctacatgatcaaaagcagtactaccaaacagggcctttaacctcaaaatcactgtaactttaactgctctatccagtaatgatagtagaagcatggatgtatcactacatgattcattcatttgagcaaagccgacatgagaagaccagcaatccagcatttgatcgtggtcgtctgatggttgaaaaggcatttgtatcgacttatgctagcccctatcaaggttggttatccgtcagcgtgatcgttgattttgcacggaaaacaacaggaaaacataaggtctactggaacactacgagagtctacgatacggacgaactgaagggcccttgcgtttgacgccgggtttaggtcgccttggctccgttgatgtcaccgtttgggcgtccgtgtaggaggggccagccaagtactgcactgattagttcttgatcactctgctggccagtaatctctcttcatcttaggtcggcttggctactagtagttgaggagtaaggccctgccttttgtagctggcacacgcttgaaactgttgacaatttttgctccatcgaacatcaggttcagactttcagtcatcgttttcgatccccttgcttgttgcagcaatttcattcagagaaagcatgtgtgtcaatggacactcttcagctgcaagaatcaataatgtacttccttagagtaagtttaataacggagccaactataagcttatagtttatattaaagttaacatatatagtaagtgagctacaaggttatctctttttttttctcctcctctctctatctctcacctatgcatttaatgtatttatcttgaagtatgtgaattgctagctcttgtattagagccaatcctctctaattttcaaattctctttcatccacataagcttatagttggcttatagcctactagtatacttgctcttagtattagggtattcccaacccaatgactaggatggtgtccatagcattaaataagttaccacttaggataaaaaatgatgtggcaagtgaataaatgaggaaagagaaggaaaccatatcttgcatgggacatggttttctacacaacatccaagacatcatgtgagataaatagcattaaattggagtatggaatagtggtgtttgcattggaagagtagtatctaggactagtttcttgatgatgtggagtttatggaaactatgtctagtgttatgggttgggactgcccttactgcttctaaatgagacttgtgactgctggtctcctttgatttacttccttacttgcatgagatttttttcatgtgttattgacgtactacctccgtcccaaaataagtacagccgtgaatatccgtgcccaacgtttgaccgtccgtattatttaaaaaatttgtgaaaaatttaaaaatatttagtcacacataaagtgctattcatgttttatcatctaatagcaataaaaatactaatcataaaaaaatttcaaataagatgaatggtcaaacgttgaacgtgaatagtgcaaaactatacttattttgggacggagggagtactgaagtactggaacaaatatctgatgatgttccaatctttctttagttattgcaccggtaaaagattgcaataagaaactggagttagtacgcactttaggctaccctgaagaattttttgcatggtggttagtttattgaaggtgtggtgtcatccttgcgtgtagagattatcacattgtctaatcaagaagagccaggagctaagctaatctagctcggccgcgaacacgacagcaagttatcttgaaggaatcagtcagttgactaagcaggctctcgctctctccagtccagaaaagcttcggcatttagaatcccctgtttgcaacaggcgacaaggcaactttcatatggcaccaaacatgtcggtaacagctgatgaaaccgtctaatttatctgctaatctcgctgttttttcccttgtcaggatggctcacaagtggaccaagttgtagaatgttgcaaaacccgttgtttatcatggccacattcggctagcgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgaggccgtaattgaaagtcttttctgaagaaaatgggaataaagatgaggatttgatacagtaaaaggctgtttggggcgaattgggctatcggctcagtaggattgcttagttgatctaacctccatatgggctgacgctgatcatgggctttacatgggcgagttgccatggcccatgggctgtcttgcgcggaagaggcgtgcgtggcagttgatggcggtgtcgccgtgagagaacggagaagcggagaaaccgacccgtctccgcctcatccaccgctccgccacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggtcgcctcccccgtcgagcacctgctgtctcggttcgaggtttcttgtgtgcgtactgcgtagctaacatcacttcctgcctactcattttaggatttgagcggcggggcgctcgtgccggtcgaggggcctgaggcgccattgtttgcgcttgaggtgagcggtattagtatatgaaaatcttagggcatccatttgctttgagaagctttgggctatgcaacataatcatttagattgtaatgaagtgttagcatatgaacatcgtagagaacatccattttgctttgagaaactttgagctatgcaatataatcatttagcttctacagtaataagctgaaaacctctacctgtgaaattctaggatttgtttggaatcagaatgatttaatttagatcaaccttctgattgacttactctagatcaatatagatagtgcttgagtgtggcatattcgagttttaatgcagataaatcctgagaaagcccgagaagagtttcgtgcagcaagtcagaagaatggagggactggggtaaaggacttcatggatggcatgggactgggagtgcttgctgagcaggtgcaaggctgcatatctgtttactgtcgctctctgtatttcatcacctcccattatgtctgaatgttgtggtccttgtgttcgtgaatttgcctgaattgctttgtttaactttggtattaccatcttattccatatagctgggggagttaaaactgggggagttattggacacaccaccaccaggattggatgaagcaatagcgatttcaaaggtgagaaaaagcaggtcatgggctttacctggttcatcttgttgttcttcttctagcatgtgactcctacttgcatccaggttatgcaattccttgaagcacaagagtatagcatgtttagacgcattgtttttgacactgctccaacggtaactatcctatatatgtgaatccacaattgactccatacgcacattcacattattacctatgatttgtctccctcatcaacagggccatacactccgtttattatccttgccagatttcctggatgcatctattgggaagatcttgaaggtattatttgcttgattgcttctgcaccttttgctatcatgctacgatgtaaggcctgcagtacatacataattgatgaagaaaatgtgtattatcttgtgtaactattatcctgcctatcgtcacacaaaacaaagtcattttagaatgtgtgtagtcaacacaagttaactttgaccataaatatcacttaaaatataggttttggggctatgaaaaatgatatatttaagtttgccataacaagagatttcataatactacacttatgtaaccttcttttaaaaaaaatgctaaagaactaggtagtcaaagttgtataatggtgaccagagagagtagccactacaatcttgttatttttgtggctaaatggtagcgggaagcttattgcatttctgctattattcatttgtgttcgtttgcgcagcttcagattgtgctttttttttgttaacttgtgaaattggaaggctgcctatcttgttgaatatttatctgctcaaatacattgtttacatctttttcatcagagttttttagacacttgttagaagaaaccgcttatccttgttctgcttcatatgatgaaatatcatgtctctggaatttaataaggaattaatgcaaagttattcttcaagtcctgttaccaagagctaggcattccatctaagttgtggtttgtcatactgatttatcatctttttttttccagcttaggagcaagatcgcttctgcaacatcagctattaaatcagtttttggacaagaagttcaacagcaggatgcagtaagtatttgcctaaaattcctctgaacttggtgtttcttcaccatgtctttaaacctttgaatttgttattctcccccttaaggcaaacaaattggagcagctgagagaaaggatggtccaagtgcgagaactttttcgtgacacagaatcaactgaatttataattgtgactattccaacagtaaagattctgtgtatccattcccccaccaccttctgtatgtatttatcagtgtaatagccatctttatatttccttttggcatttttcaggtgatggcaataagtgaatcagcaagactacattcttccctaagaaatgaaagtgttcccgttaagagactcattgttaaccaaattctaccaccttcgtcatcagactgtaaattctgtgctataaaaagaaaggtagagttcataatctgccgaaatgattctctagtaattgtctgctgcttgtagaaactgtgttgcagggccatttaccatcttctttcatccaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctaggaaaaactatcctacggggtaagtttttcaaacagaggtaggggtagtatacacaatggacgttgcagtactgataaaccagtgactggggtagtaatcttcctttctgtctttcgtagtactacaagacggttgaagatcttttccatcctatcgagatgtactactccacttctgttctgtgcaggttgaatatatgtggcccaatcacatcttgccactaaaaatcttacatttatccatatactccacgaacagtagattttactcatccctgattagacccaaaacaatcatgagcacggtagacaacacaagcttagggcgtcttgcacgattaggtattgttcggtttagaggggattgaagaggattagaggggactgaggggtaataatttcacaccataataggtattgaataaatcccctctaatcccttcctcatgagaattaaccgaacaagcccttaccccgctacacccaaaaatgtttccgctggggtgcaatactgctatcgatggcttcttacgtaggaatttcatttttctaatattttttcattaaaaattgtacaaatatgacaaatctcttttataaaacaaaggtttctatagaaattatgcgagcacatatgttcacatatacacatatttcatatttatgactaattatttttttcaacgacaccgacaaatccgtcaataggctttatttttctttcacaaagcccgtaaacttccataggagcctactacatcagtggcttcgtgccgcactaacgaggcatctatagtgattgactttatcaatgtaaaatatgacagccaaatattttgatgggaggtgttcatggttatatgtacgtttatactccgtatgagtgagtagcactccctccgttctgagatatttactagtactacgaatctggaaatactctttattcagattcattgtactataaaagtatctcatatatccaaaaatttttatattttgagaccgagtgaatatatgtttgtggttttcctacatgtgagtagagtgcatcagtggatattagagcctccacgatatgggaatagtatcagccagtgtgttgatgacgtcaaagctcaaagggtagatgaaaagttcatgcttcaaaaatggcatgtcttggaaactgggattttcctaataatgagaaatcctatgtgcagagaggagacaaaagcactgctcaacacactgcaggctgcaaagatttgctagtactactactccagtacacaaacacatcattggccacttccctaatctcatttaacgtttgcataacgcactcattctgcggttactgcattagctactcatgaatgtggctatttactagtagtacaattctaagtgccattcccaggaggagtgagcagcttctccacccttaatcaggggcggagctaattggttttggcgatcaatctgcctcgtcgagtcgtcgttccgccctccacacttcccagttcgcgactgcgccaacgattgcgcgagcaccgctgccgcaactcaactcccgtgaccgacggcggcaatcggtggccggcgaggcagcgatcaggatcagggtaagtatatttcatctcctcctcctgtcctttggccctcccttctctgatccctcccgtcttcattaagctctaatcctaggtactaaattactaatttgattagtaagcggttaggccactagaacttgcgcccttgccgacggccaacacgacgctcgcaggccacaagacaaaagctgaatgaagcaccggcatcgcatgaactgatcgcattgtgttggtaaattctatacttctatgtcgacatattacatttatagtgttaaagaaaatttatgttcagttggaccatcctagcctaaaatcgtagctacgccactgcccttaagcccttgccaatggagaagtggaggttctatgggggccatcagtttcagagttacagctttcacgaagaggagaacctctttcaggattggaggtaagcagtcaaaatctcatgcaaggtttgtgtttttactaatactctctgaagatgctatcctttgcaaaactttgctcattttaccttgttttcttcaagatgaacttctttttgcactctgcattagaaagagaacttcactgatgcctgtaatttatgttgtactcttcattgacactgtccatttttgccatcttggagtcttgattacctgctgctgggagaggatgagccctttttcactcaccacttcagcactagtgttcatagcaacttcgtgcaaggtaatacaggtctctgtaccgaggaagaatgaagcatcatgtactcaagcaagtatgcagtagaaagttttgaaagttcatgtattttctatctatcaatgcagacgagctttacaccctcttcgacggagatatcctgagcatttggggcgacatgaaagaagacgcctatcacaggagcgacaaagatggcggcgagaaggaagagaagctggatcatgagaaggccatggagctgcagctgcaacgactcccgagcggccgtcaatcaggggaaaagacactgacgttcgagctcgtgtcccagtacttctgcctgccgatcaagcaggcggcgcaggagctcaacgtcgggctcacgcttctgaagaggagatgcagggtgctcggcatcccacgatggccgcaccgcaaggtcaagagcttggagacgatcatcaagaatgtccaggtagtatttttcctatctcattttttttctctcgattagatggaagaggtatacacaccagggtttgaaatttcggttcgaaattaatttcggaaatttcggcccccaccggtatgctcaaatctcgtccgaaattttcgtttttttgcaattttttgtgaatttgtcaaattttattcaaattcagttaaattttcaaataattccggccagaaatttccgaaattttggtcacccccggcataaaatccaatttcgaaattgaaaaccctgatacacacacgcccctgtagtcctctatcctggtgatctttgatgggcgaagtcatttaccaacaattccattaccttaccataagagttttcccgtaattttccatctatgtaaatagtatagtgt

SEQ ID NO: 8604 - DNA, 1429 bp, Oryza sativa
agggatatgtagcaaggtgactctgcttgtagatggtaacatcaggatagtgcaggtaatcaggttattttggctgatcaaatgtgtaggcagtaatttctagtcaggcttttaggtatgacccaaggcagaaaagtaggaatttttgctgtatatacctcttttctagccaagtcttcactgatagtaacagtactagtttggtatgttggtcatgggaagtatcatgtatatatctgttttcagacacgatctggcgtgtgaacaactagtgcttttagttctgaaaataaagatggcgtcttttgctgcacatttgttctgtggagaaattcagaattgcatgaagaacagctaaagtaaaccatttcatgtcattcaccattcgtcaggaaacatgaaccatgcagaaacatggagcttatatagtagtacattgagttcacaccgaagattggtgtgcttcagtaatccaaccaaactgcccccaagtctgaacatcaccttgtgttgtacaagaaaatcggacagggtcgatcggtacacagcctctctctcttatccatctctacttacgcttgttcaaatctgtttgatcagccgcgaatctgtactatacatgcacactgatccaccgcaaattgcagtttctaatgcctcaagaaaatgaacaaaagtgttcgatcgcggtcgtggtcatggcagctcaggctcacaaggtgaccttctccatctcccgccggagggcggtggcgcggacgaggctgccgatggtgttgacggcgagcttgatgtcgtcgagcgggttgcccggcacgacgcgcttgtagaggtagctgtcgaaggtcatcctctggacgtagtcgtcggcgcacatctcgacgaacgcctcgcgggcggcgttggagcggtagaacaccttctggagcacgtcgagcaccttgtacgtcggccagtagaggcggtcgaactcggccaggtacctgcgcaggtcgctctcctccaccatccgcgtcccgttcgccgacccggccacgatcgcctccgcgcacatccgcccgcttttcgccgcgaagtagatcccctcgccggagcactttgtcacgtaccccgccgcgtcccccaccagcgtcaccctccccgccaccctgtcgaacaggtgtcaaccccgaccgatcgaccagccattgatttgatgcagaaatgcttgtggattctggcattgttgattacctcttaggcctcgggtgctcggggatggggtgagcctcgacgcggatgatcttgccgccctcgatccggtccttggcgcgaaggcgggtggcggcctggaacttcttgatgtcgggcttgtgggtgacggtgccggtgccgacggcgacgtggtcgcacttggggaacacccagccgtagaagtccggcgagacgt

SEQ ID NO: 8605 - DNA, 488 bp, Oryza sativa
gtggaaaactgcgcctaactcgaaaatgctggacttgctcaagaaaattagtaataagaaccctatgatcatcccataactccaaaacatactgttcatgttgccgaggaggtcttgtacagcaaaaagatcgactctgggaagacgctgatcccctccttgatgcacaacttgccccgcacgaaggaaccgaaaagggtttggattaatattcgccattgaagcttgcagattggattgaggtgctgagtttgctaactggaaagaggaagaatgagcgtcttctgtaaagaagggataacttttttaacccattgtcttttagccataggcctaacatatttaatgctcgtaacaacctccttaccagcaggcttagcaatagtattagatttcacaagatagactttcccaatgaaacagacttttgggccttactgcacaaccttctaatatggcccaagttgaaacaaagattgcaccgaaca

SEQ ID NO: 8606 - DNA, 629 bp, Oryza sativa
ttcgcaaggggaagcagtaaagggtgccgcagaaacgggatgacgggccctttggcagaaacgggagggggacccgtgactggcccccagcaccggcacaggcgtagtgaatgcacggcgtactacgagccaaaccatcgttgctcacacttggcgcgtatcctcggggcgggcacatgcgaggcgcagcgccagcgcgctgctgcaaagggacgcggcccggcggccgcgccatgtgtcgcgcgggcgaagcaggggaacgtgcaagtgtcctgtgccgtgcgtgacacggggtcccctcgccgcgtgccccacggtggtcacctacacttgccacgtgccccacggtggagtaactaacctaactgaactggaatgaatgctgtgggctggtggtgaacacgtcgcacatgcacgcaggactactactacttttgcaccccaagttctagagcaatggtttggtgtgttcggttcacgccaaaattagaagtttgattgaaattagatgatatgacggaaaagttaaaagtttatgtgtgtagaaaaatcttgatgtgatggaaaagtttgaagtttgaagaaaatgttaggaactaaaccatgcccaaggttaatagtttcggcga

SEQ ID NO: 8607 - DNA, 167 bp, Oryza sativa
cgtgcgccacggcgtgaccaacatgggcggcgcgcccacggtgctcaacatgatcgtgaacgcgccggcgtcggagcggaggccgctgccgaggagggtgctcatctcgacgggcggcgcgccgccgcctccgcaggtgctggccaagatggaggagctcggtttca

SEQ ID NO: 8608 - DNA, 31511 bp, Oryza sativa
  unsure (1)..(31511): unsure at all n locations
tggtttttcacttcccccagctggacactgtcttttccccacactttggtgaaacctttggctagatccatttctgatcatacaccttgtgtggtccaaattggaactaatattcctagagctaatgtgttcagatttgagaatttttggattgaacatgaaggttttttcgacttggttcagtctatctgggataaccatggttcctcccatgattctgctaaaaatatttcttcaaagcttaaagctttaagaaagggactaaaaaaatggagtaagaatctttccagactccagaagcttatctctaactgtaataatgttatctcttttctggacagtattgaggaatacagatatctttctttgttggagtggaatttcagagtttttattagatctaagctgcttacttacttaagatataagcaagtttactggcaaaagagatgtaccattagatgggcaaaatttgggggagaaaacacgaaattttttcatgccatggcaactgagtcctacaggaaaaattctattgcttccttgatagatgttgatggtactataatctttgatcatgagggtaaagctcatgtggcttgggatacttttaaaggtagaatgggagtttcaaattttgtgtctatgccttttgatctctattctttaattacccctcaaaatggtctggaagttcttgaggctccttttcccaaatccgagatagataatcttgttaagaatcttccaactgatagagctcctgggcctgatggtttcaatggactttttatgaagaaatgttggcccataatttgtcatgattattataatctttgtcaagattttcattctgggtcacttgatttaaactccttgaaccactcttttatcactttggtccccaaaaagttgacccctgaaaccataaatgattacagacctatatctctcatgagtatctctctaaagtttttgacaaagttgttggcagatagattacaaaaggtaatcctttcagtcattcatcagaactagtatggttttcttagaaggcggaccatacaagattgtcttgcttggaactttgaatttctccatcaatgtcatcattccaaaagagagatagttttgttgaaattagactttgagaaggcttttgataccattgagcatgaggccattttgcaagtcatgaaggtgatggggttcactgataagtggttgaattggattcagaagattttctcctctgcttcttcatcggttcttcttaatggagtacctggaaaaaatttccattgtaaaaggggggggggggttagacaaggtgatccactttcccctcttctttttgttttaggggctgatctcttgcagactattctcaatagagctttctctttggggttgctctctaagccctttccctcaaatcaggatcagaatttccctatggttcaatatgcagatgatactctcctttatgctaaggctagtggaagagaactctttactttgaaagctttgctccaatattttgctcaaggcactggtttgaaagttaattaccataaatcctgcttaattcctataaacatatctgatgaaaaggctgatttgctggctggagtgtttggttataaggttggttctcttccttttacttatcttgggctacctttgggaaccactaagccgagggtaattgattttgcccctttggttgatagagttgaaagaaggttgtcggcaaatgctgctttcctctcttatggtgatagacttaccttggttaacacagttttttcctctctgcctacatattatatgtgtactcttttgttgcccaagactgtaattgacaatattgatagagcaagaaaacattgcttgtggagaggttcagaggtaaactctaatagaaagtcgttggctgcctgggataaagtatgcaaaccaaagatgaaaggaggtcttggagtcattaacctttcaatccagaatcaggctttactcctaaagtttcttgataaattttataataggagaaaggtgccttgggttgacctcatatggaattcttactactcaggttgtgcctcatttttcaacctcaaagggttctttttggtggagagacatttgtaagttgatggatttattcagaggtattgccaaatgttccatgggtaatggttattcttgttgtttttgggaggatgtttggtctgaaaatccaccattaacctttctaatgcctaggctgtattcttttgcaaatgacaaatgtttctgtacataaatatctctcgactgatatgtcagataatttgattcttcctctctcacagcaggcttataatgaatatttggaactgaccgagtttctcagcaacatcaacttgtctcatgagaatgatgtttggtcttacatttggggtggccttaagtatacctcccaaaaattctatgccctcaattttagatcactgcagcctccgaggcatttcctctggttatggaagagtaaggtttctcaaaggttaaggtttttggttggttgcttctgatggaaaaattaaataccaaatttatgcttgatcataagcactgtgcccctcccaattgtgatctcttttgtgtgctttgtcaacagaggtgtattgaaactcttgtgcacctcttcttttgctgtcctttttcggtagcctgctggaatcatattggcatctcatgggattcttctctcaatttggagagcatgcttctgttggctaaagctctttatctaggaaaatgttttatggagaaatttctcttaggtgcttggaatatttggaagcaaaggaatgggtttatttttttaggataaattgcctttgttctcttcttggaagcaacttcttaagggagatttgcttcttttgctgtttaggctcaatgcacaagatcaagatgtagtcagggactggatccgtctgctgtaatctctttgtaatttcatattttatttttattaataaaattattctaacagcggggccctcccctgctgtgttctcttcaaaaaaattctaattaacggagtgctcgatctgttgtttttatacttttattgtccgcactttgtaggaaaataacattggcgttgttcggctaccctagctataacaacaagcctgacaatagtgctccgtgccttttatagctgtaggatagccgcaacaatgtcaaccgaacactgccaatcatcatttcaaatctttacccttgattcaataatttaaaaacacaatagcccgtatagatgtatcagctgccgtttactctacgattatactactacaagtagaacgttgggcgtcaaatgctatccaaaacgggtgccaacgttcgaacggccccacatggaagcgtagcctgttcacacggggtgcaagaacgtcatttccctacgtttttgaattcgaaaccgcatccagagagccgaaggttcctgcggcgcataggccacgtccataggccacacgcatcctaggcactcaagccaagcaaccaacggtgatagatgcgggacgccccatgcaccgggtccacggaggcctcagacgctccgttccttgtcacgtgatgttaagcatggcctggaccgggtctatacgccacacgcggtagagaatgcctacggggcttagcgccactcacccacgggtctatagacacggtctatgcagacgataggctaaaacatttcgggcgtgtgccctatttttttcaatttcgccgggcgggcgcttctccctctcacccattcgtcatttcgcaaatctctctctctccctctccacgccaatctctctctcgaggagggcgatcaagccctaaccctaacgaagccccccgcgacgccgccatccagatccccggagccagaggcattgctcgtcgtgccgggagattcgccgatccgccagatcggcctgaccgaggtgagttttttgggggctaattttagatttctagggtatttttccgtgagctgttggtctgattcgttttgggggattcgtggttagggttccgatggagggttccgaggcagcgcagcagaaggacagcgtgaaggtggtcgtcaacatccgaccgctcatcacgccggagctcctcctcggctgcaccgactgcgtcaccgtcacgcccggcgagccgcaggtatcgatctgtttggggactagtttgtctggttgggtaggatcgagtggcctgggggacgcgatgcttctgggattttgaattgggtgcatatatgctagtataaattggcgaatgatgtgacaggccttggggtttttagctaattcgatgataatttgggtagagtggcttggcaagggccaacggtttctttgctgggatggatagtgaaagatctatgcttgcgctttgctgattctgagctagtttgaataatatctttaatattatagttttaccactcgcaactcctatccagatgtctaaatcctaatatgaatgctagttaagaatattgtaattttacctggacttttgtattgttaaagattgcttcaaggcccaactggtctgacgatgccttctgtgctattgtaggtccaaattggcccacatgtcttcacgtatgaccatgtattcggcagcacaggctctccttcctcgttaatatttgagcaatgtgtgcatcctctcattgattcattattccgtggatacaacgctacagtcctagcttatgggcaggtgcaaattctttagtatggtggcactaataatgatgctagaaatgtttttttagataattgttttgtgacttgtatttttcctctaacaaaattagactggctccggcaagacatatacaatgggtactaattatactggtgaagctaattgtggaggaataattcctcaagttatggagacaatattcaaaaaggccgatgcattgaaggatggcacagagtttttaattagggtgtccttcattgaggtatcatacatggtggcatctattgttgttttgccagttccaactgccatcagtttcattcgtgataacatttttgagatcttttgtgtgcactccagatcttcaaggaggaagtctttgatttgctagatgcaagtcatgctgccctcagacttgattcagggtctgtagccaaagcaactgcacctgccagagtgccaattcagattagagagactggtaatggcggcattacacttgctggtgtgacagaggctgaggtgaagacaaaggaagaaatggcctcatttttggcacgtggttcttcctcgcgtgcaacaggaagtacaaacatgaatagtcagtcaaggtaagttacaaaggaatgatagtatgcttatttaaatttacagattagtttatgcaatttctttatgcagagattatttttccttcattgcttctggggttcttgtgccatgtttttaccatttaaaaggttataaatacaatattagcacttcatgcataatgaaacttgcactcgttaagctgcatgcatgttctggttttgcattttgtatttctgcataataggtatagttttgcatgatatatttgcatcgacgtatagatgcccaaaagtatgtgtttttgttatcaacaaaaaggattgggtataactttattgtacttcttgacattattggagccaataatataattggttagcaatggtagtatgagacaagtaggtgttttttacaagtccatttactatttgaaaatttgccattaggtctgacaattctttctgttggaatgacaatttttctttgtagccggtctcatgctatctttacaatttcaatggatcaaaagaagacctcgagtgcctctgacaagttatctaacgatgactatgatattttgtcctcaaagtttcatctagttgaccttgcgggttctgaaagggctaaacgaacaggagctgacggattacggcttaaagaaggtaaggacggatttacctattaagttgagaatataattgggcatctgatctgaacagtgttctatatattttgtggctgcaggaatacacataaatagaggccttctagcccttggcaatgtcattagtgcattaggcgatgaaaagaagagaaaagaaggagcatttgtcccatatcgggacagtaaattaacacgtcttctgcaggtatggatcctagttatgtcacaagcatattaaatactcaaatccacgaattactggacataaaaatatgcgattactttggacctgattgctctgtcacagtggcacgtttgcatcatgctcattactatattcaattttttttgcaggattcgcttggaggaaacagtaaaactgctatgattggtaggtatatatgtcttgatagtaaatgttgtattggtagtatctttactaaaatccatcttctatgttgtttatttacctgtagcttgcattagtcctgccgattcaaatgcagaagaaaccataaacacactcaagtatgccaatcgtgcacggaacattcaaaataaagctgtggtatggtcattctccttaaaggtatgctcacagtattttttcagttgatataattttcccactgtgtcctatgtgtagataaaccgtgacccagttacagcagagatgcaaaaattaaggagtcagttggagcagttgcagactgagctcctgttctcccgcagtgggagtgctgctctagaagaactgcaggttggttttgcagatctgcaaggtctggttgaatttatcgatttattgtctaattttgtttatgcgtctttcagctgctgcaacaaaaagtgtctctacttgagctaaaaaactcagagcttaaccatgagcttaaggaaagggaattgtcatatgaacagttggcacaaagtgcacttgccgcccaggtatttatgattgattcctgtaccctggtttatctaagtgaagttccaatatacttgtgcataacattattttgtagtactacatatgagttcacattgctaggtgatgctgtatataggtgtattctagatcatgtaatatgtttctctggtaactattgcaattagtatgaaacacatgaaaattatctgtaacatctctagaacagaatgtagctagtaaactaacatgcaaactgtctaaagaaagtaggcgtgaataactctgctaacaataatatgttacagcttgaaaaggaccagttgatgttgaagattgaatcagcacgcaatgggaaatcatgggatgacattgagaatactgatactgaccaggtatgtccacccatctcctgctcttcagatttgtgggaatatttcttaaacaacgtaattgaacaaatttttacatatgcttttgttctgagcaggatgtggaggtcatgaagagatatattttgaaaattcagcagttggagagtgaactgacaaggcaaaagttctctagtacctgcaaaaatgatttacatgatcggtttgccatggacaaggatttgcttctcgatgacttgggttcaggttgtgaagtaggaacacctgatgcttcaagtaagtaaaaggaagtcagaattactttcataaaatgcggttgttatacttttttgaataagtagcttgttctaagtcacattttacaatctagtgacttctagcactatatctaggattatctgtatgacatgttgattcttcttttaacatgaccactttatgttgttttagctttacacttgttcacacgagattggtgttaatgcgtagaacattgaattgaaagcagggcttttgtgcatcacacagtcacttttgagtctgcgctctatgatattagcagtgaacttgcctgtggtgtgttcctgtgtacatcagtatagaataatataccactaattaacttactgaaattaacagttccaaagaactgtagaatttttcgcaccaaggactagggtttcaagtactggtttgtatggagttattggcccctagtgaaatacagtaacgggaaattggatcactaactggttactgcccggaaaactctaaaattaaaatttgaacattctaaatctaatataggtgccgtaaactttagaataactccagtacctgcaggtgaagccgatgaagaaaaggaaagagaccattcatccatgcaagacaaacttgataaggaactccaggaactagataaaagacttcagcaaaaggaggtacaatttccccttcttaacaagtgttgctgttcatagacaaggctacaacaatttgacttggtctaaacactttttacatgaatttgattattctaacactagcttttaagttatatgtatatgtatatgttttgatttatctcactcatccatgccatctgtacaccttttttttttcgaacaactgactttatatcacatctatgtgaaatttttttacgttattctattgtttgattcacggggagtgtaattatattccattttcaattccaaaaggcggagatgaaagaatttgcaaaaagtgacacctctgttctcaagcaacattacgagaagaagttaaatgagatggagcaagaaaagaaggctcttcaggtttatttgattaaaatggacaatttcttaacttctatctttaaagattagtaacccttttttttgttttcagaaagaaattgaggaacttcgtcatgcattaaccaatattacttcttctactgatgagagtgcacaaaaactgaaagaaaactaccttcagaagctgaatacacttgaatctcaggtgcgcacacactataactgccttttctcttcctcagatactgattgccattgttttgcaggtctctgagctaaaaaaaaagcaggaagctcaacagcagctaatacgacagaaacagagaagtgatgaggctgctaagcgcttgcaagaagatattcatcgtataaaatctcaaaaggttttctcctcacagtttcctagagacccaaacatagtttagctttatattctgacatatcctcaatatgtgttatgttaggttcaacttcaacaaaagattaagcaagaatctgagcaatttagatcttggaaggctgctcgggaaaaggaagttcttcaggtatttgctctttctgcttgcagtttgaattcttgggaaatccaaaattttcaaaagactggggtgatcacgtgatatttctgttaactagctcaagaaggaagggagaagaaatgaatatgagatgcataaactcctggccctaaatcagaggcagaaaatggttggatttctcagtcatctccctttctagactttctaggtaacatgaaagtaataccattcttcttcaaaacataggttttacagcggaaaactgaagaagcagcaatggctacgaaaagactgaaggagtcgcttgaagcaaaaaagtccacccgtgacacatatggtaataagctgaaaacatcgactaattttatttcccattcagattactgtgcacttgtgagcaagtaattcgtaaatactgcctcatggttgaaaatttatttattttttaaattttcaggaagtgcaagcggttctgggattcaggtattatcactgaaactttgattattttttgtttgcatatatagaaaataatgctttcccattgcatttcatctgaaatattctcttgatatgtcattaggctttaatgcgggccattgatgatgaacttgaagtgactgtaagggcatacgaattggttcgcactacgagcgacaaatgcaagagtaagtctttgtcttcatgatggatggacttccacagggtacatttattttttttaggtataacacattcatgtatcaaataaatgggtttcagtaccttaattacaaaaggtagcccctagaactcgacggtatggatacagcctgagttaggtcacatgatgttttttttttttttttgggggggggggggtgagcttaagctgccattgaagttagggtggttggtcttcttcgcacatccagttggacttcttttctcttaataatgcaatggcacacaaacttttgcatattctttttttttttttttggggggggtgagcttaagctgccattgaagttagggtggttggtcttcttcgcacatccagttggacttcttttctcttaataatgcaatggtacacaaacttttgcatattcctagaaaactgtcttgatcttttcatctaaattttaaccaaacttcttttgtttccaaaaaaaaaaaccttttgctttgagccaatccacaatacatcattctgatcagtgcagttcaaataattgttcctaactttcattctggttgagaaattgtttctcattattctcctctaatatcattttgtttttctttaacaggagagcagcaatctccaaggaaatagcaaagctgaaagagtgtcccaggctatgtctcctagtgctagaagttctaggatatcagcgctagaaaacatgctgtcatcatcatctagtgcaatggtgtctatggcttctcaactgtctgaagcggaggagcgagagcgtgcattcaatggtaaaggcagatggaaccatgtaaggtcccttcctgatgcgaagaacacaatgaattacctttttcagttggcatcatcttcaaggtatgtcatactttgctttctgaaatgtttaaatcctcttaacattttctttggtgtttcttttaatacgaataaacaaccctaatttattgatgctgtttttatttgatgcatgttgcctatagatgtcaacaacttgacaaagaggtgatgtgtaaagagaaagaacacctcatttgtgacctgaaggaaaaggtggttgcacttaatggtagaatcagacaattagaaactcaagtgaaggatttgaataaccaaaatatgctggtaaatattctgttaattttgcagtctggcaaatctgattacattatagcaattttcatgatgcatttcaccagtatatgtttgattgaatcgtgtgtgtgcttatactttttcaatccacagttatttactgctataagtgaagcaaaaaatcctgttggcacttccagaaagggtactgttggttctgaagatggtcaacattatgctatgcgaaaggtattttttttgtatcttggttcatctagattatatgtggtgatatccaaaatgcactagatccatataatccttgtaaagtgtgtctgacatcttcccttttgcatgtagagcattcgagcttcccatagtttacattatagtaagaacagcttcttgtggtctgatgacatggatatatcagattctgagaaatcggaaggatctgatgcagattgggaagcatctgatgcagactacggagcatctgatgcagattgggaatgttcgaagaaggtcagaagacgtcggcaaacagtgtccagccatctgaatcctaacccgggtagtggtactacacaaaaaagtgcaaaatcagaaatggccagtcaagaaaagtctacttcactggaccttgctccacagtgctgctcatgctcgaaatactcatcctgcaagacccaaaaatgcgaatgtagagcttcaggttcacattgtgggggtgattgtggatgtattacctccaggtgttctaatagggtggatatgaaggaagaaaaggaaggtggtggggtggttgaagtatcttcttcagatgatgtggatgatgcaaaagttcaggaaattgtgaaggagggcgtcatgcttcttgagaattctatgtcagagaaggaagctcaagagacaaaatcaagaaaaccactggctgatattggaaatggtgtggtatgtgctatgcttcactccaggccacattgtcttgttgattaaatttgcatatctttcaatggatataattaatcatcatcattatcgtgcagttttccatgtcacagaaatgcctcatattgcttcacactcctttcaggtgaaacaaactggggcaaaaccaaagcaaaggaagaattggcgcaagtctaccgttcagctcgtcccttcagcgccacctctcccacccacggcgccgcagaacaccgagccggttccacggaacagagacatacccctcaggctgccccgagcaatgtcctcaccagctgtggacagcatccctctcacggaccgcaacgccgcgaagcctgacgaatccatgagcagcaacaaggagaacgtcactgccgttcgtgcgagatctcctgctcggccgagaaagaacgccaacgagaaagagaatcacttgcgatgattagttgatcaattggctcactcgagcctgtgaagctgcaagcatccaacggctttgttgcgaagccttttgatgttacttggtggtggggatgctgcctcggtgtccctcggcatggccggctgcggaggcaaatagaagtgaacctctggagttcctgtgaactgacccgctcgtgatgcaccgttgtttcactttgttgtcttttgttaagctatggctgatcactcaacgttgaatgtagacactttgtacaactcttgttgagatgaattaagttggttaatttatctcatggtaatgggtaacatttccatcagttggctcgcacttcatcttcgctgccttagcctatcctagttccttttgaaaaaaagtttatttgttttcagttacttctttcagtatgggtaatctttgggctcgctgttttgccttggaccgtgtcctgggttaccatgttcctgtataattgcttagtggaatttaacttgcattacagtagtaaatgcgtaaccaatcccactaaaatgctgccaatgtaggagcaaattggctcaatctgctgatcaacaatggaattcaaaacatgataatttcaatattgatagaagaactaatagtgtgtagatacccaacacgagacattaagcgagcactctaaattcactcctctagaaattaaccagcaaatgctatgagtctgcaaaagattttttttttttgaaaaaaaaatccctcttaaccctatgtatctcatttttgattttttttcccttagtgttactccctttgttctttgttatagaataaacaaatctagtactaaaggatgtatcacatctcgtgctttatttatttgggaataaaggatgtatcacatctcgtgctttatttatttgggaatagatggagtaattgttaaagctatattaatgatgttgtcttggtcttagtttattcaaaagaaaataattaccttgtgagttttgattaaaaagccaattattttataaatgaaatcagtaatagtagattattgacatggagttgaacctacctactatcatctgtcatctgtgaccagtttctcgtaatataaggcagcagcgactagtggctgtggttcaacagatacatctcggacactgttttaaatcggcgattgaaatgaattccctcttgtttcagtttgtagggactaaagttgtcaatttcttttagcagaaagattatggtccttgaaaaaaagtactgagattcacatgatcatacatgtgcatgttattagggcattcctaatgtttgttacaaaagttggtagtaagataagtccatgtcagaagacaatagtagattgaaaataaatcacaaattcacaatgtatatatatgtagagtggataataaggacccacataaatgtagagtggataataaggacccacatatatgtagagtggataataaggacccacataaatgtatatatatgtagagtggacccacataaaaaacccaaaacatgagccatgccacaattaaaaaataggtagaacacaccacgaagtgacaagtcaaacatgtttaactttgatcattaatagcaataaaataataaaaaaagatcaatcatgcaaaattggtgttatttgatttattattaaaaaaactatcacaatatacaactctttttatttaaaacatcttacttttatagatattgttggtcaaagtagcattttagagactgtgtcaggatctaaaaatacttatattttgagacggatggattagtaattatttactactttcacaatatatcttatctggtggcaagaatactttaatccctatatacccaccttttcactatattatggatgcaacatattaaactatttggcactcttacaagtgctaattaagtatttgtcattggacccacatgtcttagacacttaaggacccaaactatgagtgataaatttttaattgctacatcttaaaagtggcaaatagttgaatacccctgtggatgcccttatatatggatagtatattcacccgtggaaatttatgcattattaaaaaaaacacacacaaaaagttggcaaattgcaagacgaggccatgggcggatctacattactagggctagtgtcaggcgacaccgacgacttttagcaaaacctataacaaaactgcttatctatatgttataacaaaatgatctaagtataattagcatactatgataccgatagacacgttatgataccaacgaatcgattttctggatccgccactcgacgaggcatatccgcctctcatgctggagtgctgggtccagtcacgggacgatacggatgaagtactactcctcgcccactgcatgctccctagtcccttccgtagagatgcacggtgcgccgtgccgccgcgcgctgtggccaggggcaacgccacgtttagcttgccgagtgcacaggcaccagggaaaaatttagtttttagttattagcatctaatctccatcttttatgcactccctagaaaaaaatatgtgtaccaccttcagctactgcacgcagcccatgaaggcctaatttcaaatattaaatcatctaattagcacttttttacaggttattatcgtctcattaaggactcagcttaattatatattttgcccattgctatgtagacatgtactaccagattttttattttggtaagcattttttgtcattgtatacattacatttacatttctattacatgcataaatgaagtgtgcactcgggtcctccgtgctctagattcgcccttggctgtggcgtcgactgatccgcgtgtgcttccctggctggctggctttctggccaggtgtcggtggacgaacgttttcattgtgctgttggcttccgcctcctcgcggcgccggcgccgtgaagagttgcaaacagcagggaggaaatatgtaatctgacatgttagacgagacgatggcaaggcgccaaggcagaagagtctgaactctgaaccagtacaaatcacctcgctggcgagttggctatgcaagacagcagagttcaatcacattaaacatgagaagctagaaggatgcacagtctcacattacattcgatccagtgcatcgaatagagactagaaatgccagtgccgcggctgcatgcacatttcacagacccgtacgagatcatgcacgatccatggagagccgatggaccgaacagttccacgacaaccaacatatgctgcccaaccacttaatttccgcagcttcttcctttgcccaacaatcagtcaagaccgggccacgccgcacagtaccacgtacgtacccggccatgttacgttccacctgcagatttcttcatcttccacacacgcccaacaaatcattgcccaggttgtttctttcggcgaaaaccctgtacactgaactcggacgacgaacgagttgacggctcacgacgctaacacgcgaacgaacccggtcatctgcgtgcatatgcagcgtgccctcgcggcgtgggcacggcgagctctcgctgatcctgtgcacgcaccgtgcggtcaaaggatacaaacatgtgtccatccatccacagggaccccggcccccccgtatcgtccatcatatcgtagtacgcatcgttgcagccacggtcagcgaaatatacggagatgaccatactgatcgtgtatggggacagtgatatatatgtatatggagtatgtagtaggggcgaactgtacacacaggtcgtggacgccattgcgagtaattatgaacgaattagcagtgcacaatggatgacggatcacagcacgtaatgtgtgtggtggtgtttggatacatggcctaaacattagtctatatagcatcgaatgtttgaacatagactacttacaaaaactaattacataaatgagagctaattcgcgagataaattttttaagcctaattattctataattagagaatgtttattctagcatcacataggctaatcatggattaattaggttcaataaattcgtctcatgaattagtccagggttatttatggaatgagttttgtcattaatctacgtttaatacttataattagtgtccaaacatccgatgtaatagggactaacaagttttagtcctatcaaaacaccccctaattatacttataattagattcgtctcgcgaattagtccagaattatagaatgggttttatcattaatctatatttaatacttataattattttgatatgaggaggagtcaaactcaacgatggcgatcgattgatgtgaaggactggatcgatcacggaacctttcacgtttcccaatgcatcgatcgatcgatccgtcgacagcgccgctgcatccgccgatgagtgaaacggacacactcctcccctttacaagttacaactcacatgacatcggccgtacgtgcatggatgcatcatgcatacatgcatgcgagcgtcgcatggacaaacatggtgaaacacacgacatcgaaggctcgaagctagccgtgggcggccggaggcatcgtatactggcagccagcgtaagagagtgacattgaatcgattccaactctgcaactcactgtgtctctgaaactggtgtggttcagtgaaacagtgaaatccgcacggttcattctagcatttttcacattcatattgatgttaatgaatctagataaatatatatgtctagattcattatcattaatatgaatgtgggacttacattgtaaaacgaaggaagtattaattaataagttcaacagtgttttaagttctttaaaagaattcttataaactccttactgataaaaaagtatactataaaagttttaaaaaaatcaagattcaactataatacaacacattagcatttgtaaaaagcttataaaaaaattgctatgcacccgatacatatgcacaacttacatccggctaattcatgtacaggtgatgctgcttacctggtctcgcatggtaaaacactaaacttaatgattgatggatgtggtagtcttatagcattactcttctctttataaaaagaatatttttatatcattttccagaggttaattgccttcgtaggtttggctgatgtgacatgcatgatcgagcaactgtcttgcagcagctgggttttcgtcatgatgggtagccctggtctagttgctttggtgcattggctttggaggcaaattgaattgatctggacatcagagacgtgaaccaatccgcaatgttcgcatcatcagggcaatgttgccgttaaaattctttcaatgaacttgtctcttgcccagttgcattacaaacttggccaattgtcatcctaggatatgattgaacgaaagggttattatcacgatgagtcatgaaacccataattctcgatcggtccataatggtgaacacttgaactatgaacccttagaacattaaaaagttggcaccctatgttgtgtgaggaaaatgtatcaaactttacgctatcaatatggcaccgctaatatctcaaaaagattgtaaaatcagttggtaataactactttataagtttaaggctctggcagaggttttataggattttctaaagaaaatcatatgaattggaaatgttccactatgggcgagatgatagggagtatcatttttttttcattttaaaaattattttaattatgtaactgatgtttaattaaaaagtggaggcaaacgaatttatacacgttcgtttaaattgtacttccataaaccaaaatataacacattatagtttcttaaatttattctaaaatataataattttttcacctacattatcttctcaaccaaaacaaaacaccttctactgttcaaattatgtatctatcttcttttttccaatcaatcacaatctttttctatttaattctattaaccaatttaatatatgtgtctaatcttaaaattttgagtaaatttcaaaaaactacaactttagtgacaaaactatcagtttgctgtaacattaatgacatgtttcagtttgctgcaacaatagcatagaaaattatcataaaactacaacttttacgctatatgatgctatagttgttacctatatgtactgtagcagcacataacgtaaaaggtttagttttgtaataattttccacgctattgttgcagcaatctgaaatatgtcgctaatgttgtagcaaattgatagttttgtttacagtttcctaaaatttactctaaaatttccgatattacgcaaaaatcaaacttgctggtaagaatgcagtacagtgtgattgatcgacagaatctgacgtacaggatatcgtatgtacgttgcagtacgacacctccaactagttcaaagcacgcagccgcacacatgattgggttaatatagaataatcatcacaatgcgacactagaagaaaaaaaagaaaagatgttacaacaaccgtgcgcgcacagcctcgagacggagacgtgcagagagagaggctaaaacactaaaacccctcgtcgggtttagccacgtctacgtagtacggcaccagcggcgtcgtggcggcgctggtgctctcgccgccgccgttgcccgccgcgtccatggcgtcgtccagctcctccttggccacagagccgccgccaatggcgccgcgaatggcgccgggcgccgccgtggggccgaccgacggcagcttcgagaggagcgcctccaggctgctcatcgacggcacgatgtggtgcatctgcgccgccgcggcatgggcgccgtagtaggggtcgtagaggtccatcgtcggcgacggcgcccaggccgcgtcctgcaggccgccggcgccggggaacgcggccgacgacgggtgcggcagcagcacgcccgggatgctctccaggtacccgaacttccgccgcagcgccaccacgtagctcaggtcctccgccacctgcagccatggacgcaacgcaacgcgacgcaccaatcgatcagcacggccatgccgacaccaacacggcggcgagctgtacgtaagggtgtaaatagttaacccgtaacctacttacaggttaaaataaataatttattttgatctataaataagtttacggttaactgcttatacccttagctataggcatacattgcccccttatttgtcgtgcatgcatgcagctacgcgaagccagtgagcgagcttgacatgatcagtgacaccaagtcacccacagtgcaactgccagggttgaaaatttcgaatcgaaatttcggtcatttcggtgaccctgatacgatattaatttggccgaaatttttgaattttttaatttattcatgaatttggataatatttttacaaattcaactaaattttgttcaaaatttcagaaatttcggaccgaaatttttgaaattttgggatttcggtgacccccgataaaaacccctgaaccgatagagtaaaccctggcaactgctgcacacagtagagtgggtgaagaggactgaagaacagagcagagaacgggcgtaccttcttcatggagcctaactgtacaacgccttctctgacggcgatcagagcaatggtctgccaaaaaagagagtaaaaagatcatcagctttggcattcacaaactctttcttggtaggtacgaggcgtacgtgtaccttgataccggactggaactgagcttcccatgtccttggatgctgcaatcagcagaaattatacggaacaaaaacatgttaattgttgttattgcaagcatcaatttaggagttttaaccgaactgattagataggtgagaagatgctgcagcttacagaatcggcagggttgttccatgaggtaaccaggttgatctcgtgctcattggcctcctgggacacccacttgtggccatggtcagctgcaactttcccaaccaaccttcaagatggatcatcgcatcatgagatcgtgcttcacgtgctgactaaagtgattagcgtaggttttcccaaagaacatagattactaattaagaaagacggccaatactatgacactaattaattaatgatgtttcaagccaaactgctaattaattagtactaccacatacccttccccatagttgtagatgtcatgggacatcttgaagaagagctcaggctggaggcccttcacctcatgcccagctgctgcatagtcagtgtacccggcagcagctggtgtgtcctcttggtcacaggcagaggctgcaaagttgcagaatccatcctcccatgccaggatcctaggcgagttttgtaaacccccaagatgaatcacaaacacgaattaatcaacaaacaaatacaaatgcataaggaaagaagatcctgcaccaaccagttcctcctgtttcctctactcctgtcataaacaccaccctgaagatcccatctgaccatattgaggaaaaaaaaacagcaactagcatcaatactaaatatggagcaaaatgctactgctaattcttttactgtcaaactaatcagtgtcatcaagtgagtattcagctaagctgggattagttgactcactttggaggagggtagtttcttgggaggattcgccagaagacggcgtacacccactgggagtcgccttgggtgcagaggccgcgcagcgtgtgctgcagtagctgtgtcacagccagtgggttcagctgctcctccattgcagctgagctgaagctgcttctgttgctagctgatgctgcacacacaagcttatagacggccaaggaatcaagaacaagatactctagatgcttgctctcattagctatccacagatcactgtgtatgtgatgaagctgccgcttgatttgaagctgaagggctagctagaaaaagttgatttgaagctatgagaagttttggggggcaggggccaggagtaggtgtaggcgtttcctttcttgcttgatagcttccactttgatctctctaataagctgcaaactggctgggactttgtgaggccaggccaccacagagggagcaaccatacttgcctgaatttatacacagccactcaaccgcacacactctgaagagagaggaaactctttcaatcactcggggatgccatctcgtttattcaaacacattacttaaactgttataagaaaatctttaaaaaatagcgcactatccaataaatatttagtctaaactctacttatacatggagaaataaaaaaacaaatctaacaaatgaacagtatttgtactatttacacttgaatttacttttgttcttaatgtatagatcgagtttaaatttgattttcgatagagtaatagatggaactctggtctacaccgtcaatttttcatatattttttataattatctattatattattaaaggaatagaaaaaggagcctccacgttcgttctcatggcctagaaattctcgcattaatcggagaaaaagaaaaagcaggacccatatagaaatacaatttagaaatagctgaaattcgaaattaaaaagtaaggaatatttgaagaggagactagagtccatatagaaatacaatttagaaatagttaaaattcgggattaaaaaataaggaatattagaagaggagactagagtccatatagaaatacaattaggaaataactgaaattcggaattaaaaataagaaatattagaagtagagtatagagtccatatagaaataaaattaggaaataatagaaattcagaattaaaaataaagaatattagaagtagagtatagagtccatataggaatttaaaactaactaaaattcggaataaacacaatagaattaaaagtagagctttgagtccgtataaaaatacaatttacaaataactaaaattcgaaattaagaaaaacatgggaagaagagtttaaagtcaatataggaaacaatttagaagtaactgaaatttgaaattaaaaaattaaagaatattgaaagataagtttagagttcacatagaaatacaattagaaataataaaaattcagaaataaaaataaataatattggaagaagagcctagagttaatatagaaatacaatttacagaaaattcggaagtaaaaaaaagaaaaatattaaaagacgagtctagagttcatataggaatatatataatttacaaataactaaaatttgatattaaaaataattaataactaacacgtatataaaatacaatataaatattacacatttgtagtttcgtaaagttattgcaaaatttaaaattatgatgttattttaatatattggaataatataatgagaaatcatatatgctattatatgagagaaaatataatgatgttagccgcgcaatctacgcgggccaccatgctattttatattgaatttgagagatgaaattagagacgttcgagattagaatctgttgctataaagagagtcatactactacagcgatgactttaatgtggtgcattgtttctctcttgtcatagctttagccgagtggctaccataccttgcatatatagctttcctttttccttatgaattctgctctctagtgtctgtctccttggtgcccgcatcaagctgatcgtacgtctgtgtgctgacggagcctttcttgcttcaattcttcttctgaaaagcttggctccgagcctccaaccactggctaaagaaaagtaaaaaaccaaatttcgcaaaagttcatatgatcttaaaggatcgcacttgagtaaattcccaagtgcaatggaccttacatagttacattcacctaggcactgttcaagatgaccaattcacagtggtttgcggtgcccagtttctcctccgtagtccgtatggtttggagttttgattcgcattgcgtcagtattaaatccggggtcaaatgccggacccagcaaagaacacttggatggagctgaatggctctgcaattctgcgttacaattggcaacacactgtatgagatgaaattatggacaggccctacattggtctctcattctgacactgcgtgagagagtgctcagggatttttgtcactcattccatttcttctaacgttcttgatcctgatttctgaataatggcactgcgacgccaatgtgggtggccctaagccaataaagatgcaaagtgtgctgctgccttgagcaggggaacgaggaaattgctagctgctgctccctcttgttctgacaacctggaccaccggtctctccgaataacagtgttgtagtagtatgaaattagtatatcagatctgtctatgtgaatgtgtgcagatgcatgccatacaaatttatgggcctttgaatattcttatttaacttttacaagttattcgttttcattatcgtaaggcaaacgaattgatgtgtaaatatgtgaaggaccgtgtagagaaatgtcattaacaaaaggcagattttctctaagaactccaaaaatgcaatcaatttgtaaataaagggttgaacagaacttgctgcatttgcgtattacttttccaggctttagctaatttttaggcactatgtgtcttttagcgcagatgtaccaccctagtgttaaatttgtcgatcattttgatccacacacgcgcactatatatgcatccgaatccatcggtcactcgcaccagaaagctaataccaagagtcgtaagcatgcatgattgcatgccactttgtctgagacttcaccttacctcgatctggaattggtgtcaaatggggagcaaagcaatccctgcagggagccaatgactccaatgagtgaaggttgtaccttctcgttgcccaggatgatcccagctcgctaacaaaaagcatggcaaggatataggcaccatgttcaactcaataaatttcattaccagtatgtttggtgtgaaattttacgttcttgagagagtacttataggtgttaaaattttacactaaaaattttaatacctcaatatgcgcagtaacccatttttggtggtgcgcatggcagtaggttagagagtttatgtgttcaacttcaaacttggtaggtcatattaggcacaagagaattcaaatggcacgtttttatggaggccctctgccatcgatacaatctattagattaaatgcctgagaccttatttggatagctcgagatttaaaataaaactagtgaaaatctggagaaactaggttttcctagtttctagcatatatttcaaacctatgtaactataattttttagattgtaagtgagattctaaaagaaaatgtagctgctaaaaactcctacaataaggttgaatttgacatggtaatacacacttaccttgtttttctatgactgaaattgaaactttgcaccacccttgaaaggaatataaacaggtagaaaagtgatgaaagaaaaaaaattgaagataggggggcagggatactcagagcacgtatctttgtctctatctctactattataaaaattaaagatgtttttgccggtattttggtacgtcatccatgtataagtcggtttttaagatcatttacttttggtaatatagaaggaatcatatgagaaatatgtttaaaaaaactcgcatgctaacatatccaagcgaactctcacagtgaatttcatcttaactaaaccatataacaataatgagattaaaataaattttcacccgttgcaatgcacgggcatttttctagtcagtaaaaagtgaaactttaaatgattcaagaataagccacatcatttcattaataatggccatcggatttataaggagacagaatagctaaaatcattatggaccatcggatgaaggatcgatgatgggaagggcctcatcgtttggcttttttttaataagccaaaacggcttattagataataaaaatgaatttgtaggtaaacttttatatatgtgttctcgatgacttaaaagccaatgctaaaaagaaactacgttgaaaatatctcaaaatcaatgtcaaaattaaatttaaaaatttaaattttagttttttctttgactgaataggccatccgataggagccaaaataaggttcgagagctatcacgagtgttcaagtgtcttcggctgaaaatctcatctgagcttttttattctcttgtcaattttacacatgcacccctataagatcatttattctagggtcctctaaataaacaatattttttcaaatatgcttttgctctgatccatttacttacttagaaactcttaggaattttgtattttaaaaagtgaccaatgatgcaggtggtggggttgatgacatacgcaaagtggtgggtttatttactgaacgcgtacagtaaacttgaattcaatacaacatacgcataacaaatttgatatgatgacatggcgatggtaaaatttctataaataaatttgcttcaactaaatatataagctttgtgatacagtttagaagtttgacataatcacatggttaattatttgttattatggtaataatgcttaattcatatcaataaatgacacatttaaaattttaacaatgatggaggtgtgggcgtgaaagtgtggtatattattagatgtgatcttaatattgttacttacaaatcaagataaatctgctaatattatttatgccaagtatattcttcaaacgcatctacttaagttgtaaattactataataattatagctaattactcaaaacaacaaaccacaagtaaacacatttaatataaagagaggttaaaggttgcgagaatacgtgaccctataagctagtattaagataaaggatatcgccgttcacaagagcatctcagttatgtacaaacaggataaaaagaaaaaaaagaaaaaggggtgctaaaggtgatgtgtcctaaagtccggtgcaacttttttcgggcggaggtggctagatgggcgtgcccgcctcacgccatagggcagtttctatcgttgcagcctctacaaaagtgatggaaggtgtacacatacaaattcactattgtgtcgtctctgtaccatattttcttttgttttatctaaccagattgacaaaaggtatgaaaaagtaaagaatatttctatttttcacgttaaacccaaatttatgaaagaacaccaatcaagattcaagaattgtttcaacagagtgaagtgatcatgcattcttcccatatgtatttcagtatccatctgcttgtctgttcccttgagagggacttgtgctgaaagaggcaagagctttgaaatgttgccatcgggctcatccgctcatgggcaaagcctatgccaacactagaatatgagacgacatgcttgcaatttctattccttgtttctgataggaattccaggacatgggatttaatgcagatgctgtgggagggaatgaaggtatgggcgtcagggatggcaagggatatgcatttgtgcatattgctactggattttctcattgtcctcatcccctgtacctcaaacaaatgcaacaatgccgaagaggtcaccaccagaaacagaagcagaaggctctcgaatgcaagaaacttcaaaaaccgaaagatgagaccctctgagccggctaacggctggggtgacagatatgaattttttttatacctaaaaacaatcacacctgttatttgcatgtgattaaaatagttataaaattatatgtgcatgcgacttaaatatatattaaagtttttaaaaaatagtaaaatcgattagaatgacataagtttgtacacaaacataacaggctaaatacgatctacaactaaaaataataattaattaaactagacaacaaatagtgctctatgcagcacaaatataatttattgttttttcttcatatgtagatcgaatttagactggcatgtgttgtgtagtgacttgtattatcataatttatactgttacaattttctctataattttttaagacacatgcataaatttaggtgtgattgtgtctaggtgtaaaagataatttatgttgtgatggcctctgattaatctcatgccgtgaggaggtgacattggaggaggcggcttccactgtggagtgagactaaaggagaaaaatatattgggagcgttcagcaggcggctaccacggctgcagctgcggctgctcacagtgagggtaatactattcgtgccggctgtgccgcagccacgaaaacggccgccgaacaggtctatttttacccatttaccagggagcagcacccagtaagcatggttgtggtatcgacaggtacccaatctcaatagttgctcgatttggatggattaacggcttagatttggtacctcacttcccgtcttccggatgataatacacttcaacagcctacattatagttcaaggatcacacgccaaaacctatactatgttattaacccatatttaatcaagcttgcagtaatgctagatatacgatcgcagatcgccgtacacatgaagcaaattgggccattggggggggggggggtgggtggttcagggttgcgttggtcaaaaccacgaatcgactagacagaagacagatcgtcccaagtgcagagaactgcagatcgcaaagccagcatttgattacttcatcaacactatccatgtttgcagcgaaacgatcaaacgaaaagctccaagacgatcacgtgaccgacacctcattttcgtagagtatattgctctgctcagtcattatctaaaaaaaattgctctgctcagtactgtggagagcagcagaagcggggagaatttagttggaaactcagcatacaaactgcatagtgcaagactcctttttttaaaagatttaactatttgtcactcttaaatttaacgtttaaccatttgtcatttatgtataaataatatatggatccttatatatctacgatatgtaattataggtggccacatttaacagttgcaaatagtgttttttttttggcgcattggtgaggtgtggggctcgaagagaatagtgcagaagtttgtttttacggggggaaaagggatcatggagacatcaagtcatcaacgaactgatcaagaaatgttgtgccttggcaagtagccctgtgagagttgttgattgatgagatatagtataatactatagcttttgccaactaagttagctttgtctttgcaggtgtcaacatttttggattaggattgtgcctctctttttcttcagatagggagcatcttttccatttgaatccaggaatgctagtagatcgattgccattggataagaacatgattccctggatgagttccaacaggttcagaggataatggtttgtatagatcgaaagagcacatcattagggaacataaaaatgataactttctgtcattgaatgatgccctccctaccgtaccccagtaaccttgtggtgcttacctccactgcaacagtgttcagctatcaaatcatatgcgttatccaatccagtggcaacttgcaagctgcgactgtgacacatagtcacatgcatgcagctttcattgacatgcatgaagttacattattcagaaaccaaagaaagatgtgtgtgcaggtgctactgctagtactgcatggacagatgcttccatgtgtaaatggacaaccattcacagctagtatgactttaacctctccaaattgcagtcgttgaaaaaagcaagatccaatgataacgttagacctgactgaagcatgcttccaaatgattaagcagagagttctctgaagatactgctccagtacagtagtagaagaatacagccgttcagtacagcacaccgttgcgcagtctcctgcagataggacagtcacagtacttgttacgtactcgtacttctccgtatgacaagttactgttccattaccttggcctgccccactggtgattaaacgaagattttatggcttgcaccgctgcactgacctttcttcactctgcttatgtacctggagactggcactgaaagtctgaattgatcactcaatccagcactgtatcctgtggttctccctgaccacgacatagaaggatgaacaatgtgttaactataatcaggagaatttattgtactattagtactccgcatatacagtaaagtagaaacagatgtcataaggtttatcaggcctctgattatcatgcctttacatctcctggcaaacagccagtcaaatgcacctcaatacacaaggggtctgcatttgcacatgacaccatcactaagtgtctgtgtctactaccactagactactcatgcagcatcaatcaagcactgacgcactgcaagttcttgttctcagttctcaccatctttacagaagggaaggcacatggaaaagctagaagaattataaggggggcatcaaaacttgttcttcctttaccatagggccagtctggcctatggattcttcatcaaacaccattgatggtcatatcatagggtgtgagagatgagaatgtgaaagtagctacttctaccactaaccaatttcttgagaaattagctgccatcaaatcagttaacctcttgcaaagttgaaacttgcaaggtggattgatgcgtggtcacttaactgaccacttattattgggaacagtgttcagtacagtagccaggagcacaagactgcatgtagggcagtgaccttgttttcactttgtgcaattgatgcttttacaaggtgcccagctgcagaacggagatggtaaggtaacgaaataaattacatatgaaagacaggaaagccaaaaaattattagacagtcgatttattagtaatctgaagcctatgcaaagtccatgaagcacaccgcttctgcttatacattctaacggattgacgaggaatagttgggctgttgcctgttgggccaagtcactcttaggattcaggtagaacagatcaattcagctacgacaagtgaggttccaattgtgaatttcagggtagtacgcatatgcatatgctttgcacgtgtggattgctgctaaaaccacactgtccataatgctaatcagttgaaataagatccacttctgatggactggttaagccaaataacatgcnntctactgttggacgtctgcaagcacatcaagcattgngtcattcatgaggtcatagtgttgatacaaactaggaaaggtcatggacattgacaggcttatgagtacacttagtactagtagtagtaatgcaggcaaagatgttgcttttcctgcattgaaacgacttcagaactcagaaatgatgtataactactcctggaaacttattgataacaaagttcaattcgaatgttcgatgctagtagtgtcttccagatctccctttcaacatatgtaaaaaaaaaggaaaaaagattgcagcatattggcaatcagctcgtgtagtttgtcatattaaaagtaaattcatataatggaagcatcaatcgatgtcatgtaggcaaagttaggcatatgtcatggtctgcatgatgaacgatgaaagaaataatagcccgagttgatattgtcttttgaacaagcatgcaaatcagccacagttaatattgatcatggactgtactttcagatacataattattgatcatgcagttacaagccttaaacggtcaatttcagaaaaaaaaaaggagcgtctcatttcaaattgtgaatttaaatggaaataaatctaacagaacaaatagaaatggtattaacatttgcccttcatctagtgagtagtcacaattgtttcagaaattgcacatgataagtttcagtttcagatatagcactataataatctaacctgtaatcatcataattccacaggcaaagtatatactacctccgttttttaatagatgacgccgttgactttttctcacatgtttgaccattcgttttattcaaaaattttatacaaatgtataagatataaatcac

SEQ ID NO: 8609 - DNA, 934 bp, Oryza sativa
tattttccttaaaagaaaaattgactgatgctttttttaagggtacaagggaaacgtacacagcaccattactataatatcgaagtattgattaaaatatgtttggtttctagcctatcaaaatacggcactgaaaatatgtctatattatcaaattttgataaaattagaagcaccaacaatatgatctcataataaaatctagggccactagagaaaataccttgcactcagcgaataaagcctgtgcgggtcgccgcacagtggcagtgctaactggccacttcgatctcagcttgactgaaactccccccgaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctctccttaggctacattaggcgtgatctcataataaaatctagggccactagagaaaataccttgcactcagcgaataaagcctgtgcgggtcgccgcacagtggcagtgctaactggccacttcgatctcagcttgactgaaactccccccaaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctcct

SEQ ID NO: 8610 - DNA, 510 bp, Oryza sativa
tgccaccgccgccaccaggcccaccaccaccatcaacaccacccaccacgacggcgtggatctggtggtggacaacctcgagctcttctctggtgacgcggatccggcggttggccggcggctacaaggggaaatcgacagtcgatggccggcggcgcggtggagttgatgtctctcccctcctcccttcaccgatgttgacgccggcgtgcctaaggtcgtcgccccgcggccctgcacctctctgctccagcgacgggagctccgactccaatggcggggataggagctccgactttggtgtggaaaggtgatgatgaggatggcgacttgacggggaggatggcgacgtgagataggaggacaaaaaaagtgacaggagtggcatggttccaattttataaattttcaatggcacccagctaataatgtgaagagtagtggcatattttcaataaggcatatttacgatgggcatggatccaattaaccctaaaatataagggattt

SEQ ID NO: 8611 - DNA, 921 bp, Oryza sativa
tgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccgcccgcgcgcgcccgcaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcagctgggtggttgtgattggattggatggtccctgcagctggagctggggtttgtgcggggttgggtcgttggagttagctgggttcgctgctgttgtcgcccgcttgctggctactaggaggagtacgtactaggcgtggtcaccgtgggcgtattgtgcagcgagtagtagggttgtagggcatgcacgcttggacagtacgggtgcccgggtctgtaacacgcgcgcgcgtggctataattaacagggaggaaccaaatagctatagat

SEQ ID NO: 8612 - DNA, 412 bp, Oryza sativa
caaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaaccttaagccattgacagcagacatcactgcagctttttaccaatagaaagaactggaatcagttctacag

SEQ ID NO: 8613 - DNA, 1054 bp, Oryza sativa
tgcatccattggctatagtagcagtggaaggcggggacaccatgatgatagagaatcgcatagtaggcgtgatgaacgtgagagatctacatccgttgactacatgaacaagcgaagtcggcatgagcatagctcaagaagctcaagaacacctggtatcatgtttgtatctaattcttttcatgcttaggctaattggcttgtcacttgctgataaaattgtggctgtgattgcaaattgttagcaagatctgattgggacagtggccgatgggaatgggaagatacacctcgtcgggagtaccgtgatgatcgctcaaattcccatagacaacatccttcaccatctcctatgcttgcagctgcatcccctgatgcacgcttagtgtctccttggctaggtgggaatacgccacgttatgcaggtaacaaaagctcagctattcaatgttgtttgcacttttcttctttaatttaaatcaaataaatcatacttctattgttgttttgaatatccagcatccccatgggataacgtatctccatcacctgcaccaattcgcgcttctggttcatcaaaagggtcttctatccacgttctggtggaagatcccaccagcttactttttcgtctacatctgcatcaaatgtaagtcaggattctgttttcacaaaacatgcctttatgtaggaaaaatcaaaacatgcctttatacaggaaaaatcaggtgttttttttttttgcattcatctcatatgttgcaagttcggtatgattattttaagacatccatacacccaggaggtgaagtagagtagacgaagattgtagtcctatgggctatatacattgtagagagttggaagccccattcatacattcctaaacactatcacatctattgagaaattaatcctccttttagcacgacagtcttttaatgttgaatctcctggaatgccgatttttagaagtggtaactctgctggtaatttaattcaaccatttagaccagtgctcgaaacaatgataaatgtaatgaagcatgtattt

SEQ ID NO: 8614 - DNA, 439 bp, Oryza sativa
cgctcactgtggatggtattttttatgtcattgatagtgggtatggaaagaagaaaggggtccattccacggatgggttggatgctcttcaggtttttccagttagtcgagcagctgcaaatcagcgtgcaggacgtgcaggaagaactggtcctggcacatgctacagactgttcacagaatcagcttaccaaattgagatgctacctaacccagtgcctgaaatccaaaggaccaatctggggaatgtggttctgctactgaaatctctgaaagtcgaaaacttgcttgacttttgacttcatggacccacccccgcaggaaaccatcctcaactccttgtaccagctctgggtgttgggtgccttgaacaatgtgggtgctcttacagtaataggttggaaaatggttgaattcccgtgggacccaactttaccaa

SEQ ID NO: 8615 - DNA, 1321 bp, Oryza sativa
ctatcgtatagaaactttttgcaaaaacacaccgtttagcagtttgaaaagtgtgcgcgtggaaaacaagggagagggttggggaaaaggggtgccgaacacagcctatatttatctcaaattttctatgtatactcatttatcttgtcaaattcacttgttgctttaggcaccctcatcatttttccttctatatatgacttgtttcagattgccgtatttgaaaattttcattgatcatttatcttgtttgttggttgttttattaaacatagtattgtcataatcattgtcagataaccaatcatcgggctaattatcaagaaacttaaagcaccctaccccacttcaatgaccaagatattcaagggcttaacatttgagcgggacatgtcattttactacctttgtcaaaagctcgcatatgccctgttatatcattgaggaagagaagtagactcaatggatctaaagtaccaacacaagcatgatcccatgaggcacgggatatatagagattaatgtctagatataatggataaagaaatggtggctctacccttagttcgcattcaaagattaccaaatatggttaattagatatataacattacaaattttttaattttgaaatttaccactactattcatttatttagaactatgctattggtatttgtctgaaattgtaatggtgccattgacatacatattttacatatatgtgacggaaataccctcatcttcaacctctctcctctcagtctcagactctcagttgcctcggtatagcaggagcagcaggagctctttctcactcactctctaattaatccttttgtgggttaattagatatatgctgccggtggagcttggcgtggtgcctctcaccagcatcgggggctagtctcgtcggcgtcgccaaggcgcggcagacaacgggcaggtaggaggaggcgatggtggcgttgcagtagacggcggcagtggtcgtccaccaccacgtcgccacggccatggccccgccagtggcgcgaggacgaatggaagacggcaggacgctggcgacacgaggatgagcagacgaagccggcgatacgaggtggacgagcggacgccagctcaagattcggcggagctcggagcggacgaggctccggccagctctcggtggattcggcgccccctctctcgctttatctggatctgggcgaagccacttggggcggagctcgggccaggatgcaccactgctcggctagacggcgtcggtggatctgtgacagggaggctcgggcgtagctgcgcacgaccggtggc

SEQ ID NO: 8616 - DNA, 1278 bp, Oryza sativa
catcctcgatagttagagggttattcgtagttttgctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactacgaccccatcgtggaataagccaaacggtatttttacaaatgaaaagtaatggtaatttgtaaataaaattttttaatacgtgttcttagagatccaaaagcaacaactgaaaaataaacttcgatgaaaaaaaaccttagggggatccactagtt

SEQ ID NO: 8617 - DNA, 659 bp, Oryza sativa
attataaggatttgcggcatatgcggccttaggattcccatagcctccgacgtacactgcaggatgggagcaccatgtctgatgaagttatattccagatgtgcaacacggaaagagatttaaactacatggtcaaccttacaaattatgccctttggttgacatgatctgatttcaaaacattaagtatccctacataacacagatggtcccgaaccactaaaaagagtactagagaaaaataagcatccagagtttgttaagtaccttgattgcctccagacacagcagctcgtgacctcttctcggcctcagctcgaagcttctccacttcagaagccactgatatcaatttcttctgcatctcttgtccctgctcatagctctcggcatatcctttcttctcaacctcaatgccagatctgcaggtcaaataatacaaccatataaggttgaaaaacataaggttattcttggaatttcactctctctactactccaggggtaactggaattcattttggacaaaaaaaaagtaagagctcattccatttcaaattttaattataatagatcgtaacttgaccagacaaaccaaaagagttcatagaaccaagagaatggcaaaacaaaacagcgatggattgttttctcacaag

SEQ ID NO: 8618 - DNA, 792 bp, Oryza sativa
cttgggtgccccggttaaaaataagaaaggaattaggagtagcaaaaaaggaaaggtgaattgtctgacgggggcacaaacggccgcatttgcagcaggcagcgaggagattggaacgcgatccttgcggggtacggcggagtaaatgggggctttgaattggatgaccgcattcacatcgtgctagtagtagtacatgatagctagcccttgctcccatcaataggtaactgtgctatctacaggagccactgctgccaaagaagcttatcatcccttcactcccatcttctgaaaatgcctgtagcatgcaagaacgaccatatattagtgtgtgtgtgtgtgcgtgggtgggggggggggggtgttaacgttttggatactgttatttgcaagatcaagacgggatacagttttctacaggacgttgttgattaaagaaaatgaagaaattacggacgaaaaaagatgagtagtaagaccgccctcgcagtgatcgcaattaatttttggttctttaaatttgattaaatttattactgtaaaatttagtcaaaatttgttatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcat

SEQ ID NO: 8619 - DNA, 1313 bp, Oryza sativa
gcgcttgttcaagctgtgctgctcggttttttgctcggctatgtgcacgaaaaaaaaatcccaaaaatttatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacagacagcgcacgcatccaccaccccccaacacgggagcggagagctcgccgccggcgatcgccgcaggattctgagggcttcttccggcggccacgggagatggttctgctcgaacgcacgccgttggtggtgcccgaggcagcagcagcagccgccgccgcctcaagccgcttcggaggccggtcgcctaggggtttgaaggaaggggcccccggccccccttgatcccatccttcccttacctcaggtaatggctagatccaggatccaaatcagcccctggtcccctcgaattaggttctaattggggggggtggaattcgcggaaccgtggcgtggaataaggttgggtttgccctcaagttgtgtgcgtacgcatcgtactgggattctgtcccttcctctgagttatgtagttaattgggcgtgtgatttagattttgacacttcgcctttgcgattcctgttcaattgctcagtggcagtgtgcagttgaatttggacgaacggaaatgtgagaaatgggggcgtgtgtgttccgaaaaaaaaaaaagaaaagcaaagggtatgaccaccactgtttgagtgtctggcaacgacagaagtgcattttgccgagacattgtgactggtcactcgtaatgtccagtgttgggacttgggaaggatttagttttggagctgatttgttttgtgcagctaggttgatttttcttgtgaaggattagcttgttcatgtggagacggttctcttattcctttatcagttcttgaactgtcaagtaatgtaatgtgcccactttctgtgctccttctgtactaatgtgctgctttctgataggtccttttggtaaaaactttgcatatataacttatttttatgttcctggtactattatatctattttataaggtaaatctaatctttcatgcacatgctggtattcatgcataatttatctatgtatcactgcggtttgtttgtcctggtcagggccccagtcctggtgtatgcattcgtttatgttagtttctgacttggtattcaggtctatcaacaaggct

SEQ ID NO: 8620 - DNA, 700 bp, Oryza sativa
gaacctagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctattta

SEQ ID NO: 8621 - DNA, 598 bp, Oryza sativa
cctagttgacacccaccaagtttagggaccacccgtgcactttactctttgttgagttccttttgttcgagctatatagacttgatataccctgtctttgcccttttatttcgtagtaggtcataactaaacctattgaagctgctgtccttttattttatagcttatgtaaaagagcagtgctgttcttttgacttgaacagtaaagatgttaacaagtttgtcttcttacaggatctgaggcaatgtttgctgatttatgctatttctctgtcaaatctgttcaggtagtcctttctgttgttttaagagtcaatgttgcacttcatatccttgtacttactatgtctaatgtgttgcagcttacctttgtgtttcttgttcttccatgcctgctactgggttacctagggcaagctgcatttcttatggaaaatctaacagaaaatcagcaggtcttctttttatctatcccgagtaagataaactggttcatctatgtacctcttttaaatctgattttctgatgctatggattgttttcacacaaaatgaaatggaatctattatcccctaaattctaaatactttcattccg

SEQ ID NO: 8622 - DNA, 972 bp, Oryza sativa
tcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaactgttcgtcttattcaaaaacttttgtgagatatgtaaaattatatgtctacataaaaatatatttaataataaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaaga

SEQ ID NO: 8623 - DNA, 8026 bp, Oryza sativa
tgtcactgaattcatattcagaaatggtacattttcatgatttctttacctgattggtgatgtgatcccatgacaatggtgaacctaggccttcgagattttcccggagtgccttccgcattccaatgattcgatcagccataccctgagacaacccagtggcgatattaaactcctttccatgcttcacatagattaatctattaggaacttacgtagttaagacttcttaccttgacctctttcaaccataaactctttaattctggatcattaaggattatggagacaaccagtgcaccatgaacaggtgggttgctgtacattggccttgcaatctgttgcaattggctcttaacagaaactgcttgcatctcatcctcacacagaatactgaaacagcaatacaaaatcagttttatgatcattagagtatgatcattgtttaaagaaaagataacaaattggatcactcaattctatttgatgttatatactcttccccttaatggaacaggagggcttcctgaagggaaaatatttcagtctcgctagatatgagttccacttgcaaattccttttttttttgagaaatcaaataactaatgctctaagacacgtttcattttcaaggaccatgcatggaattagtcatgcaatacagagagtagctttgctatgctctccctgaagaaaacagtacaaatcctgaatcaacagtagttaacatgatgtaaattttgtgcctcttaattatatccagagcataggagcactgcattgcacaactatataactttcaagcataaatgacactaggcgagtgaatacctcaagcaccctgccctttgcccatacagtcccatgttctttgcatatgactgagcacatccaatttgatgcccatcttcaaggaagattcggattgccttagcatctctctctggatcaccgctggcaaatccttggtatgccatgtcaaagaatgggaaatgattctttatctgtcaaaacacataaggaaaatgtgatatctgtcgttggtgataacaccaacaaaaagccagtccttttcacttctgctaccttgaattggtaggatatctctctccattgttcttctgtaggatcaactccagtaggattatgggcacaagcatgaagcaaaaagaatgaaccatttggagcgttctgcagatgagaggaacaaaaataaattaaaaggagctataggaaacccatcaacaggtcagaagcacctataagaaagtgagaaaaactaagtgtacctaaaacttatcatttatcaatgagaaagaaagctaaatcagtattgactctacaaatatctaatttcaaacaatatccatgatcttgctacagataccagcaacaatgtaataattcctaaaagtaagatatctttctaacaatactggagaaacgaatcaccttaatatcatccatcagtcctgcgaaatcaagccctcttgactctggatggtaataggtgaatgtcctttgaggtacttgagcatccctccaaatgttatgatgactggagaagttacacacactgaggttagaatgttagatactgatgatgttaacaatattggagagcaagaatcacaggtgcctaccatatcatgtagagacagtaatacacaccatctacatctatgttttctcttcctatttctttctttaagagatttttcttagatgtaaagaaaacaacaacaattcatgtctcagcaggattccaactcacttggaccatgtaggtgtaggtatgtagatctgtgaatttggcaagaaacgcctctggaaatcggcaaagagccggcatgcacctgtgcctgaaagagcctgcaccgcagcaatcctcttatctttgatgaaatcagaatcctcaccatatgccagctttagtgactcttcaatcatctttatacttcctcccattggaaggtactccctgttttacaaaattagtggaaattagaacttaaggcaacctccaacggtccagcactaaaacaggtgtagcatcaactgcaagacagtattatgctttagttgatcatttttttcaggacaaaaaaaaaaaaggattggagtgtctaatctgtactgcaatgatgtttacttccacaccacaaaagagcataaagaagcatctggaaaccattttaccacagaatgcctacaggaggtctaaaccgcggcaggatgggacaacaataattttttttttcgcatcaagcgtacatacattgcgtgattgaagaaggaaaaggaagctttacacatgatccagatcatgtttgaaaacaaaatactagtgatagatcacgcttcagaacgaaccagcggtatcagcatgcttttatttcagaatggaactaaaaatgaatcaagaaccaaagattattgaagctcatatctacaaaacacagcaggtatagctcagatccgcacatgcacaagtaatcaagcattgaagctaactggaagagacagggagggatctcgttctgacatgttgaggttgccggcgatccggcgctcggcctcgcgcacgcactcgagcacgacgggcttgccgttgtcgtcccggtaggcgccctgcagtttcagcatccccgcccaacatctccgtcagaatcaagcgagatcggggatcccaatgagagagagagagagagagagagagagagagagagagagagagagagagagagagagagagacgtacgacgccgacgttgactttgtcgggggaggggtcggcgaggaaggcctcggtgacgccgaggatggggtccttggaagccggctcgacgtggccgaacagcgacgccatcgccctcgtcgcgtgcctcctcgccctcgccagcgccccgacccgccgcccccggatcgcggccgccgagcgggacgacgacatcgccatggctggcggatgggcggcgcggcagcgaggaggaggaggtggagactggagagcaaagcagtgagggggagaaaagctgtgggtgtgtgggttttggtttggtggttttcgcgaggaaggaggccaaaagaaaaggtgtctcgctttgatgattccttgcgtcgtcctccgaagctttttgatgggtgcgtgcgtgatgagtgacgctgacacggatggacggatggctgcgaataccagtcggcgcggacgcaactcttttttttctttctttttcttttaccgttttactgctagttccacagtgtgggagcacctcgcgaggaattaaatttaaaatataccattcactttttttttatttctcagaaatatacttgatgtaattttatttgcataaaattagcattggtctcgcacgctcaatgagcgagaccgtcacacttgccgctaatcaacaattaattagtgattaaataataagataattaatcgctaatcatcattaattgatcgctaatcttttaattttggcaaaatttgctacatgacactcaaagaaagcggtcttggttaggggtcatctcgaaaacgtgaatttgtcctatgacactgaaaaaacatagtaatttaccacgggacaccacgagcattaaaatacaatattcaattagttgaggagagagaaatcacataaaatgtctattctaccctcgtcttcttcttccttttccgtttcttcctcctacacaggttgtgcgaagcagccgtgagcaacgatgaggggcaaccgcgacgggcggtgacgaggggcagcgtcacgaccgtcgacgaggactgcagatccacgacgagccgcgaccgagacggatggttggatctcgcggcagaggacaacggctgagaaccgacgaggtttgatggcttaccgctgctctttgtttgctgcgagcttgaagttagcttgctgctgctgctgttgcgagcctttgaacaaacggatggggttgccgccggcgaggatgttggcttcgcagctgctgttgcttcataaacagagacaaaaatgctactcctgttgctgttacttcacaggctggcgacggctcgtggcattggacatcgaggatgggtcgcggacgaatgattgaaggacgaggcgccgagcggcggtggcaaggacgccgtcgcgatgggcagacggacgactttccacttgctgctgctctttgttgtgaatgaatggatggagttgtcgcccgcggggagaacacaccgtgacgaactgctgtggaagatggcgggggtggacaaagcgacgggcagcgaggccggttttggtgctgagtcgaccggatttgatccccgtcgacgaagattggtctcaggggcaaaagtgtcattttgtgaaaattctctctctgtaatagcgaaaaattataaaataatacgtataagtatctatcaacaaattaccatgttttttaagtgtcctcaagcaaatacacgttcttatggtgttcctcagcaaagaccatatttttcgagtgtccaagagcaaattttgcctttaattttcgaaacactttcgtagacttgttgcacgagaatgctcgcggtttgacacgctcgtcgctcgacaccgcgcggtctcacgctgcccctctacaagactgtctgcatcttcatcccacgtcaattttgcacaacggttcagcaagaccaacggtatatttgtgtccaaagatttgcatctaggatatttttaagaaaaaaaagatatgaacggtatattttcaaatttaatttcctcatgagtaccatcacggtgtaaaattttaaacgggaaggctaaaggacagaccctaactcctcgcttgtgtgtaggcacccacattgacgttgcctcactcttgatgcggcagactagcacgtcatatagatggccataaggcccgaagctaggctagacggcccggcccatagcatggctatttggcccggtctaagcatggcatgccatgactggtgtcgagcccatgccggcctagcccgatagttgggccgtgtctgggttgatgccttggcatggtggactggcccggcatgacacgaaccaatgagcacgaaagaaaaatatggtcgagggattcaaaacagacttaattcagggcatgataaaagagaatagggatgcagaatagacttattctagaaatataagatggcccaaagagatgagcgagggaacagacttgtggaaaaagtatacttcgactccctcaactatggtccaagtatgacttaaaacctccaaacaaaaaaccgggtatatcgactcctccaactatcaaaaccaatgcaaaatatatttcttagtggtattggaagcggttttggctgacgtggcgcctacgtgggagtgttgacccggtcttcatcccacgtgtcattaacatgtcgcttatgtcgcattttagtgtaaaaacaaacaaacaaaaatacatgggatagagatttttataataccggcaaacaaacaaacaaccaaacaaagtaccagcaaaaacatctttaatttttataatagtggagatagagattgttcggtttttggcattaacttgtgattaatcatttcgctatgattttgttcaaattaatccatccaaaacttttctaatactttaattctacatactatttggcgcatggtgattttgcctacatgaggtattttggtgattgataatttttatgctataagagaaaattcgtctcaaggtagcgattgttaaatatgtgatccgaatttaggtctacactatattcagattaattttcgagtaggacttgatgccttttcctgttagttattttttcttttatcttctataaatactcttgtaaaccgtataggaaggttacgttcactgctattccccgacgtttgtaattaaactcaacgatagtgatcatttgccggtcgattgccggtggaattgattcagggtccgttcttttcagattttcggatgacgactctagctgcagccgtggcagctagactaccgttcagagtattgagcctaggatcgattgatcaccttgcacccactggcactagtactgcaagccacggcctctgcttgcccggaaacattggcctaatcgcttgtgtttttcatcgcggtactagcttgcccggaaaccttgccttaatggcttgtgtaccgtacgctaattgcaggctcggcagatgtgtgcatttgtccacctcaaaaaaaaattcacctcaaaaagatgtgtgcgtgtgtaccatacgcatgatatgtacgctgttttcttatgttccgtggaagaaaaagttgggtacctcgtacggtgccaccgccacagagcaagtactcccttagttttattcacataaaaagtctttttaaatttttttctaattaaagttttttaagttagactaaatctctacaattataaaaattgaagatgtttccgctagtcatatgtggctgcgtttacttcacgccaaaattaaaagtttggttaaaattggaacgatgtgataggaaaagttggaagtttgtctgtgtaggaaacctttgatgtaatggaaaatttggaagttggaagaaaaattttgtaactaaacatagcctgtgtttgaatcggttttagttttatgtttcggttttaattttatgtttttgtcaagtaaacatctaagtagttcccaaacataattttttacactgtcacaatcgaatatttggacacatgcatagaatattatatgtagaaaaaaaccaattacacagttcgctaggaaattgcgagacgaatcttttaagcctaattgcgccacgatttaacaatgtggtgctaatgacggattaattaggcttaataaattcgtctcgcagtttcctggcggaatctataatttattttgttactatactacgtttaatacttcaaatatatgtctaatatatctaatataacaatcaaatctaaaaattttcctcaactaaaccaggcttaagtataaccacgtatctctagttgcctacggtgcgccgtctcttcattgggccaacataattttttcatttcagcccttgttatatataatttgttttactggttagatcttttacggaaagaaccactgcgtttttaagtgactacgtatgaatagacttccctctattctatgctagggaattctatgctatagcagtagatagttggttttaatattatatttcttactattaaatttgagttttaacattcgggttgactaaatgtatttaagaaaaatatagatcacacatattataggcagcgaggtctagaatatatctactctatttttattgattgataggtaagtacgtataacaaattgcgttagatgtgaaccaattaaaacaaggaataaaacacatctattagcagtaacctttatttagatttgttaaaaataagagcccaaaacattcaattaaaaagaaaaacaataccttactttttaatttagacttaaaatttaaacctaaagatttacgtcttcttaaatgattttttttacgtgaaacagcaggagcaggagaggctcctactgcgctatattaataataaataaaaggtttacaatatttacaaaaatacaaaacaattaagagagagagaatcaatccatgattgcaggatgggtttgtctgcttttttactctgtgcatatgcagagcaaaatccttcttgaactctgatttccacttgactaaactgatagtcacattgttgaaaataaaatcattccttctacaccagatgtgccaacaaccaatcgcctgagcttcaaagaagaagttgagatgaaaagatacttagctgttgtaatcatgttcatgagctccagcgctagatttcactgaatgcctatttgctgccagcattgttgtgcaaatgtgcaggagaagaatagatgggtcatgctctctacaatcattgcttaaatatttgatatatcttactattaaatt

SEQ ID NO: 8624 - DNA, 7810 bp, Oryza sativa
tgtgcgggctcccttcctaattggatcctaacaggaggacgaggggctcacaagagacacattgggcctgtttggtagagctccaactcctaaatgtagctccagagttgggtttggagtagagttgtggagtagccctgtcggaggatgaactcctcgagcgggggaccgtgaggcacctcctttgttggttcggccgggggctactgtcgatgatatgggcccggggatatcgtgcttaaaggggagaggtcgccctcgacgtccacgtggcacttcccccgaggggttgggcccatggatgagcggtagccgcccctctccgcccctaccccttgggacggtcaccacgcggccatcatgcaagggtagtgcagacggagcggacgtgccacgcctcatttaatgtggcgtgctgcacgcttgaccgaatcgtgaccggtgcatgaccggttgagtgacagacgagatggcggcaagccacgcgcgccctggccgtgtgtcagacagcgtgcggtgcggtaggtatgccttatcccgtcaaaatgatgaggggcacagtgacttgcaaccattcagagccggcttgaccgacctggacacacccgggacggcgttcctggcacattcgcacccaaaatcctccccgtgtcagcctgcatcgaccggcatgatttgatgggccccgcacgacagccgatactcagaggacttccacgttgtggcgcaagacacacatttaatatagggaatatttactcccttcactgggcggcacacccggtgcatgtgagttcccctgggagtataaaaggaggttcatatccaatgaagagggggatcgaagaacaaagagttggatcgtttagccctagtttgtacaccagagattcagagacttggaaagctcagaaaaaccatcatacacatgagtagggtattacgcttgttagtggcccgaacctgtataattatctttgtctcatcctctttgagggacccgacccccttgatagcttccaatcttcctagctgcttagctttcactcgctgcccccagccgaaacaacaaaggaggggcctcacggtcccctactcgaggagttcatcctccaacagctggcgcgctaggtagggggcgcgttcgtgttcacctgaggagcactcatcttcgtgcgccccaagttttgtccggtacatccatggcgggagtcatggacggcaagctggtggtgtgtggctgatgaggaggatcttgaccctcgtcaccaagcacgacctacttcgactccccctcgccgcaatcctaggcgaggggagggccgggataagtctggggactcggccatctcactgctggcaggcaagggaggacgctgagaaagagtgcgctgccgcctcacgacgacggtggcacgcctcagggcgcacttctgcgccaccccttgtcgatccagagccagagacctcggtccggtgctggctggacgatgtggccaacctggtcaccaccgcacagcggcagcttgccgctggcggccggacaacggcggctggtatatcacgtagtacgattgccctctctttgtcgtcaagatggagagcacaccgggtggcggcagcttcccgccactcgtcctcacacccctcgtcgatgcccgcagggagctgtgggcgccatgagtgtatctacggagaaccggacgctcggcttgacatcgagcgctggctggatgtgcattgagccgcccgtgcgccgagagtaaagagggtggcaatgcgccgagagtagttgtattgatcgatagattgatagattacaatgacccagggtgtatatatttatacccatagggagatactagtccttgtcggacaggaaagaaactaaagataaaaggaaaagataaagtccttatcagacactaaacacccttttctaaagataaaaggaaactaacaaactattcctaattagtagataaactgtcatgccgcatccttcttgaactcggactcttctggataaattccctttagttgatccgactccatcgagaacacggttggtggtgatttgacgactcccatcggctgattccataactctgaagccgatactgactctaagccgatgatgactttgggcttaccaaattttgtcgttaacacatgccccccagttttggagtgtgaggacccatgctccaaaattctcttctgtctgatcttgttaactccaaaattgatcttcccttgcttcttgcaatcggctttcataagccgatactgtctgcattaaatgagctagactgtcaaactcgtggcagaagaatctctctctgataggtgctgacaatccttggaatgcaagatctgcgagctgctcatcacttagattcaaactataacatcgaccgcggacattacaaaatctctgaatatattccatagccgattctccttcttgctgctcaaccgatattaaatctgaaagcttcaactctttgattccaacaaagaaatagtcatgaaattgcttctcaagatcggcccatccttggataaaatctgatggtagcgatgaaaaccatgtgaaagctgatccagtcaaagacaatggaaaaaaatctaactttcagagcttcttcagccgatgcctccccacattgtgctaagaattgactgatgtgttccattgtagatgtatcatcttgccctaaaaactgggagaaatctggaactttgtatcggtgtggcaatggcaccctattaaaccactcaggatatggcagccgatacacagaagtatgttccttaggtttgattccaaacttctcctctattatctttgcaattctatcgggcaaatcattgtcatattgatattcttcatcatgcccatattgacgaagttcttctggccgatattgatatgcttgcccctcgagctgattcttttgaacaattatttcaggaactatcttcttgaccacatcttgtagtctactcatcaaaactccaaactgatcaaacaatgtgcgatgaactgcttcatcaactatatcttgaagtatttcaactatcggcttggggaatcgagtcttctgagttggctcttctggtgtcatgatgaaacattgaagacaacgcgtttgaaaatcagctacaaactgctccatctgttgcctttgttcctccgttaaatcctccactatgaccatgatcttggcattgacttcttcttcaaacatgtggatataaaatcatggtcccaccgggcgtgccaaaagcgtgttgatgcgaaaaacacgaggcctgggagatctgcttaactccagtgcaggtccaaaaatcttgatgagatgcgggtgtgccagtcagtttgaccctgcaactgacaagatatataaacagtagatcaaacggctgatcggctgacaagccgatggagtagttccagccgatgccgataccagccgatagccgatgccagccgataacgatagggttctaagctatcggctttatgtccaatgtagagtctgacacttgacttaaataatgatataaaggcaatcgactgatgataatatagtataacaataatataatacagtataaaccaatcggctagcaatgagatgatagaataaacactgatccgaaggttaaagcatacatcggctggaggtccaatgttataaaatccacaatattagataaacagtaaaacctttgttgtgatcggctaagtccaacttatatgtatatgcagtccttgtaagcccatgcaacgtccagataactcatcggctgaaaccccgatgaaacccttattggcaatcaagaagcaggctagagattatggttctaaacatgacttagtagatcaaactcaactgatgcagtactaagtatgaaaagaaacataatatctagacaatcaagccgttgactgatttttagggtggtaaatgtctaagctaatctaatctagcaacacgatttagccgataccggcagaaaccctaaagcgagaagcggccgatagaggtaaactgatatgctaagactagattaacagagacatatgataaataggtagacaaatatatcatccaaaccggagcaatccaagaggtcgaatgtactgatgcagccttgaacaacgctgatgtagatgagacaattgcctgggccgacggaacgtaggacttaccccttcgctgaagatcgaaagccgatgcagccccgcgtcaggtgccaagttccatcgaatgataagtaaaaacctcggtaaagagggtggcgatgcgccgagagtagttgtattgatcgatagattgatagattacaatgacccagggtgtacatatttatacccatagggagatactagtccttgtcggacaggaaagaaactaaagataaaaggaaaagataaaatccttatcggacactaaacacactttctaaagataaaaggaaactaacaaactattcataattaatagataaactgccatgccgcatccttcttgaactcggactcttctggataaattccctttagttgatccaactccatcgagaacacggttgctggtgatttgacgactcccatcggctgattccataactctgaagccgatactgactctaagccgatgatgactttgggcttaccaaatttcgtcgttaacagcgtgcggtacaacggaaggacgatgagtccctccactcatacatctagcagttctgtcaggtccgcaacaccatcgatcccatgcatccctcctcacgcggtcatctacgcatttaggggggcgtgtggcataaccgcgtgctgaagaaggtcgcctccaaggagcacaaaacatacgcggagctttttcagctcgcggatcacgtggcccgcaaagaggaggcgtgggcttggaactcctccagctctggcgcggcggctgcggctgcccctgagtcctcctcctgctccaagcggcgagagaagaggaagaagaagagatcggtccgatccggcgacaaggaccacgtcctcaccgccgaaggcaccttgcggcccccgcacaaagaaaaggccgcgagcatcaaacagaaggacaccgccgccccttgtgagagccgctcactagataagtggtgcatcatccacaatacctccacccacagccttgctgactgtcgcacgatcaagtccttggccaagcgcgtcaagaagtcgcatcaggagaagcggcagggtcaccgggagggtaaagccccggagacctcggccgacaagcggcgagaggaggccaagaagaaggcccccgtcgacaatggtgatgaggacctggagttctaggagcttgacaccactatcgccaccgtcgactgtggagcatgcgcccacgcatccgaccgtagctttaaggccatgaagcgcgagcttctggccgctgtccctacccatgaggcgacacggcgagcacgctggtcggaggtgaagctcaccttcgaccaaaccgaccacccgccagtggtttcccggggagggcagttggcgctggtggtatcgcaaaccatctgcaacgttaagatgaagcgcgtcctaatcaacggcggggtcgcactaaacatcatctcccccgcggccttcgacgccatcaaggccccagggatgaagcttaagacgtcgctacccatcataggagtgaccccgggacacacgtggccgtccggtcatattgtgctcctggtcacctttggtgatcctaccaacttccgcaccgaacggctcgactttgatgtggcggatctcaatctgccctacaacgcggtccttggcaggcccgcattggtgaagttcatggcggtcacccattacgcctacctccagatgaagatgctgagccccggcggccccatcaccattagtggcgatgtcaagatcgccctgacttgcacgaagcaacgtgcaatcaacctcgcagccggagaacggcggcggggggcctgagacttccacctctcgtctcttgaagaagcggatgacttctggtgacgaggtgtccgtcaagaagattatccttggcaatgatccgtccaagaccgaagattggtggtaacttggacgacaaataggaagacgcgctcgtctccttcctgcgggcaaacgccgacgtctttgcctgaaagccgttggacatgcctggggtccacagggaggtgattgttgacgaaaaaatcgaacacaccggcctgggagatctgcttaactccagtgcaggtccaaagattggtgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggttatatgtccaatgtaaataataatataaatgcaatcggctgatgatgatgtaataaaataacaatataatccagtataaaccaatcggctagcaatgatatgataaataagcatggatccgaaggttaaagcacacatcggctggaggtccgatgtcatgaaatccacaagattagattaaacagtgaaacctttgttgtcatcggctaaatccaacttatatgtatgtgcaatccttatgaaccgatgcaacgtccagataactcatcggctgaaaccccgatgaaacccttattgacaatcaagaagcaggctagagattatggttctaagcatgacttagtagatcaaacttaactgatgcagcactaagtatgaaaagaaacataatatctagacaatcaagccattgactgagtttttagggtggtagatgtctaagctaatctaatctaacaacacgatttagccgataccggcagaaaccctaaagcgagaagccgatagaggtaaattgatatgctaagactagattaacagagacatatgataaataggtaggcaaatatatcatccaaaccagagcaatccaagaggtcgaatgtgctgatgcagccttgaacgacgccgatgtagatgagacaattgcctgggccgacggaacattggacttaccccttagctgatgatcgaacaccgatgcagccccgcgtcaagcgccatgtcccgccggacaataaaataaagtagaaaaggtaaaagatggcgatgcgccgaattgtattgatcgtagagatagattacatagaccccgggtgtacatatttatacccatgggttgatacaagtccttgtcggacaagaaagaaactttcctaaagataaaagtaaaagataaagtccttataggacactaaacacactttcctatagataaaaggaaactaacaaactattcctaattaatagataacttgtcatgccgcattctctttgaactcggtctcttctggataagcttcctttagtagatcaatttccttaaccgaatatagcaagaatccgacaactgacgacttgacaactctcatcggctaatctcaggacttcgaagccgatgactactccgggcttaccaaatttcactgttaacagtgatcgagcaccatctagccgtgcggccggacgcgagacccgtccgacagaaggtgcggcggtaggccccggagcgacaagcttttatccgcgaggaggtggcgcatctcctagaggccgagttcatccgagaggtcatccatttggagtggttggcaaacctggtgttcatccccaaggcgaggg

SEQ ID NO: 8625 - DNA, 5511 bp, Oryza sativa
tcttaaggacattactagaaatataattcccagcaatgatttacaaagtctgtcagggttatggataccacatacctaatagtagttgactaaatctcggcaggacccaccacataccatgtcttatacggaaataaccttcggatatggatagagttccggataaggaaagacaaccagagttacacaccagggatggtgttcctggtgcattcgcacacccaaaatccacttccattaaatggtgaatgagggggatccttcccgtgtcggcctgcgtcagccgacatgatttgatgggccccgcacaacagccgatactaagaggacttccacgttgtggtgcaagacacatatttaatatagggaatatttactcccttcactgggcggcacacccccgcgcatgtgagagaaccccttggagtataaaaggaggttcatgtccagtgaagagggggggtcgaagaacaaagagttggatcgcttagccctagtttgtacaccagaggttcagagatttggaaagctcagaaaaatcatcatacacaggagtagggtattacactttttagcggcctgaaccggtataattccctttgtctcatcctttttgaggggcccgatccccttgacagcttccaatcttcccagctccttagctttcactcgctgccctcggccgaaccaacaaaggaggggcctcacggtcccccgctcgaggagttcgtcctccgacaagcccaaacccagctccacatctctagtttattttatgatagtgctctagtcagctctgtacccattttaagtggagctgaaattatttggctgagctctggagctgtgtcaaacggacctatcatcttcgtacgtggagaagaatctccatcgtgacgtacctaacaccacctcactgtaccgtgaatagcctaaggctgggttcggaggaggggttggacccggcacgcaaaacgatgttcgcattaacgtgtgattaattaagtattagttaattttttttcaaaaatcgatcaatatgatttttttcaagcaactttcgtatagaaactttttgcaaaaaaaaaaacacatcgtttagtagtttgaaaagcgtgcgcatggaaaacgaatgtgggggagttgggaactcccggcaaagaacgcagcctacatgaggttacaagtctccatttttcaaaaacatgtgctataggacacaccctcgttggtgttggcgcacgtgatcttggtgtgcacgcttgagtgcatctgtgcatccaaattgtactcgggataaaaaaaaagatttgtctattcgatgaactaggagtatttgattttctagcacacattattggagaaatatatgctgaagaaaaggcacagattcttactatacatcaagctgcagactgaaccatcatcagctatctgaaaccaatccagcatcccttgtgctcacaaccaaggagggatgctctgctcactccagaacagctgatcaggatccacctcacccttcaccattgccagcctcctgaagtttcccctgaagtacttctccccccacaccctggcctcctcatagcttgtgtttccctccacattctgccccaaatccaggtccctgtagttgatgtatgcagccctggggttcttgctcacatagggtgtcatcagctcatgcaaccccctcacccagctcagatgatcatcctcataggacacattcttgtcacctccccacttgacaaagtattgcaggttgtagaggtatccgctccggtgagcgtacggcgtgccggattccggtatccggctcatctcgccgccttgtgggtcaatgtcgatggagccgtcttcgtcttcgacgatcttggtgagcaattcgatcaggccgggtgtcggaattggtgaggttaggtagtcgagcttgatcttgtagtagtccttgggttgcagtgtcctgtcaagaagcacctctgctggttggccattggtgtagccgtaggagtacagcatggattgcagccagttcatctccctgcaatcggttggtttgatgccgagttcgggcaaatggtggtcgatttgggtgatcatgtcgctgcaatttccaagaaacaatgatttgaacgtcaccaatggatgacgagttgagtcgtcgccgtcgttgatggtcttggcctccatggacattttgacgaacaggttgtcggggagagcgtgcgccacggcttgccatttggtgaggaggcggaggagagattgctcgtcgtggccacctcgccggagtaggaggcggtggacggtgaaggcggagacgacggccgggacggggacgaggttgacggtccaggagacgacgatgccgacgctgccgccgccgccgcccctgatcgcccagaagaggccctcccccatggccgccctgtccaggagcctcccctcggcgtccaccacctccgcgtccaccacgttgtcggcggcgaggccgtacttgcgcatcatcgggccgaacccgccgccgctgaggtgcccgccgacgcagaccgtcgggcagattccggcggggaacccgagccgcccgccgctcccctccgccaccgcgtagtagagctccccgagcgtggcccccgcctcggcgcgcgccacgcccctcgccgcgttcacccgcaccgcccggagcgccgcgacgtcgacgacggcgaacctcggggaccggccgagcgagcggtacgagaggccctcgtagtcgtgcccgccgctgcgcgcgcggacggtgaggccgtgggcgcggcagcagacgacgcaggcgcgcacctggtcggcggtcacgggcgtgagcaccagcgccgggcggggcgtccgcggcgaggcgaagcggaggttctggatggtggagtcgagcagcgacgggtaggaggcgtcgcccggcgcgtgcacgagccgcgacgggtcggcggcggtcgccggcgaccgccgcgcgacgcaccggaggaagctctcgcgcagatcgccaacgccgcagccgtctcgccaccgcgcggaacacggcgaggcgagcagcgagaagtggaggaggaggaggaggaggagagggaggcgcgggcggcttggctccatcgtcgtcttgctcgaggtcgcggccggagctttgctcagctccgctcccactgcgtcgaacgggtcacctacctgctcgatctttgggtttggtggctacacgtaatgaggcatccataaccagaaagaacctcaattattgtgatttatttttaaggaacctccgattttaagataaaatatttcaaaaagccttatacttttcaaaaaaaacctcatattttactattatactcccttcatttcttaacaaattacgccgttgatttttagcataacgtttgactaattgtcttactgaaaaattatataaatgtcattttttttgttgcaacatattttataattaaaaaactttaagtatgacttataatttatcatatttacattatttttttaatctaataagatgatgggttaattggatcgatgccactgcaactttaccaaattaaaaaaagccactactattcatcatatcggctgggtgccactgtaattttagaaaattggatccatgccactcccgtcactttttccatctcatctctcacaccgtctcatcctcatcccctccacaccgcgcgacggccggcacgagcggaagacaagctggcgcggtcacggccggccctggtggggtctctccggcgcggtctccggtgccgagctccctcgccaccgccaccgagctccttcgccaccgccgagctccttcgccgccacccaggtcggccttgccgttgacgacgctgacaacgaaagccacctcacgggtcgactcggcgaccatcgtgctgtcggggcatgtggtgaggaagccgaggcatccaaggagaaggcggcagagtgggccgcggctgcgccaccgtctccggccagcagcgtcagcgtccctggccaaggacgcgcacgacgaggtccttttcgcagcgaacgaccggcgaggcgacgaggagcagccgcatcgctccctgcggtgtcctcaaccgccgtcatggcatgggggctgctccgcacgggattccggccttcactcgcgcctgcgccaccacgagaaccctaagccgccgccgccgccgccgccgcttgcgcctgcgtcggtgtcgtcgccgaagccggagtcagtggtggtgtcctctggctcagtcctcggacggggaaagacggcgtcaacgggagtggatggaaaacgcgacggagtggtatggatccaatttcccaaaattgcagtggcgcccagccgatacgatgaatagtagtagtatttttttaatttggcaaagttgcggtggcatggatcgaattagcccgatgatgaatggtcaaacattattctaaagttaaccgtgtcatctattaaaaaatagaggtactatatgattattttttacataaattcatactagttgactcaaaatatgcatccctctcgtgtattttatcttcttttcctcaattctgcactgtggtattaaaaaacttaacgtaattcatgacatgagaataagctaaatatacacataaattatcaaaccatcgatgatcaacgctagttgcaaagcaactgacatttatattatatactccctccgtttcacaatgtaagactttctagcattgctcatattcattaatatctatatgtatatgggcaatgctagaaagtcttacattatgaaacggaggaagacaaaatatctcatacaattgtttacagttttaaaagaaaaatattagccaaagtggatgatttaggcttggacctaaaggttataagaaatattttgccctaaaacgtaagattgcatgaagcaaattataaaacttgggattttgagttaagaatgcccccaaaaccagaacatgatgtggtattttttttaaaaaaaaatactcctaattattcagctagtaggtgatggtaattgatgaaagataactagccaaattttcctgttaagcccacagctaaatttcaaggctttttttaaaaaaaacattatagagtttttttttttagtctcagggcagacccaaccaaacgttttcagtcccagtggaaagaaagtggagctggttgtgatgatcaaaaaatgaataaagaggtgaagtggggtttgggccaatccataacttgaaattagatttatgagtttgagagccctactaaataggtccttggtctctcaaagtttaaattttgtgaacataattagatttaattttagggttttttttaagtctgtttttttatcgttggcttttaaaccgtaataacacaaatatttatgttttatttgtgaattattactttttttgctttgttcatttttcttaaatgatcagagcatatgttttaaaactagtgaggatcacctt

SEQ ID NO: 8626 - DNA, 21663 bp, Oryza sativa
aagggaaagcttttctaacagctgagcctacaggtgaaaatgttttaagaggtattcgcctgggccttgttgaggatgactccttcatacttgacctggaaccacttcatggcatcctccttggtcacccggtgctggatcccaacgcgagacttgcacctccgacgacgggcaacacggtagccagcacgctcaagcacaacatagaagtccattccatagatacctgttgaggggtcgtacctgcagcacacaagagacggtttagccgtattttttcgaaggatagtaaaaccatgtgatgtgtgcagaaaattataaattaaaaacaaaaacacacttatttcaatgtgcttttggcgaataccaaacatcgtattggtgcattctctccatcatcagctatgcacagctcaagagcaatgcaaactacacatacgaaactattatggtgcatatgtggacaaacttcgtggacggtcaagatcaaagatggtgagcgtgtagatcatttctaaattggattgtgaagaagttccaaagggttgctcagatcatttgttagtatgaaacttgctaatttggtaggcatttctatgattcaaataaccaagcatttccagtcactaaacagttgttaatacgtccatgatggatagaggtaattgggtccgtaaaaagacagtactaacaagtatccaaaggtgaaacaagggataaattgacaattcaattagatagtttttttctgcaagtataaaaaacaatcatcatgagtaaacatgctctgatgctgaatgccaagtgaactgctcaattagtaaacaaaatagacaaatgacaaaattgcactgatggtgagaagagcttcccagaggttctagagttctaactcacagtacatttactaatagggtgatgtttctaccatagaaatacgaagtttgtactgtttcgtggttccagaccttctagatttttgacaatgtggctcttttacaaaacttattttataaatagacccccaactgtgaaacaaagtgtggttttgattcattgtgatgggaaaatggagagtgtcaaaagtgaagaaaatgtgtgtgttgactaacataggtcaggatgtgatatttgtgcccgaaaaacggtagttttgttacgtgtgtgcatgtgatcgaattcaatcttggtcaatggcaaggaccagaactatgctcagggaggagcagtccggtgaggtcaagaggccatgtgataaggtgggattgacgtcaggatccttagaggtcaaccggggtcaacgacggatcgagactaaactcagggaggagttgaggtccagaacgatcagggatgccggttgacaagcttgaatacaatgcggtgcacgatgaacggacacaatgttgggaggacttcgcaacgggcttcacaaggtcaagtgtgcaggtgtcgggattcgcgaagagtaatgtatgatgcaaatgcaagaatgctccccctatgtgcctaactccccttttcaccaagatctaaagcaaaattttaaattctcaatgagtgcattttgctgaatatttctccccctttggcaatgatgacatgcaaaaatgcaaaaaatgagacattgcaaactttaatttgagtgaactttggaggttaccagctagacatatacaaaagaagtatgaaacatgacaagagcaacaaggttatatcactagcaagctttcatgctatttctagaaaaagcttaaaagtaagcaatccaacgcataaatatgcaagattaacattatcaaaaacaaaaatgaccccatgataccatgctaatgcccagttcaagagagtatcaagatggtaataaaacatagaacatgggcttttagctctatcacattggcttttaattccttttcggatttttgaaaaaacctataccccattcgcgatggtacgcctaatcttagcagtgagcgagtgatgagggcgccaaacagtgtcatcaaatctcaaacaagttttccagttagagctcctgttacaggtagtctcagtgctatcttcagcactacttatgcgtaaacacactcagtagcctgggacaaaagcagtggtaaaacacataaagcatagaaagaacataattgatgcacccatgaacaatcaagcgtgagcattcaaaaggatgtgccgaaagctattgctaagatgataaaaacatggcatatctatgagaaggatattgcatcaaaagcaaacttctagagcaagttgtgcacattaattaagttcaagtgtagattcaatttaagcaagtatcaatgcgcatgaagagcatagcatgaacatacaagctacttaagcacgtgtaacctagacaaaagatctagcttgcataaaagtaagagatgagtatcaaaaagatgtccagtaaattgttaacaaagctctttaatgaaaagatgtataatacaatgcaagaaagtaaacatgatgcaaatgttacaaatgcatgcaaaagaaaagaactccctctcaacgcaatccacaggggtggatcacccctaactcactttgcaagaactcacatcatgctcaatagagaggttttgtaaaaatatcagcatgtcgtttctcggatttaacaaactctagcacaatgtgttgacgaaaaatccacgcccagctaatggtgccaaatctgtgttgatgcgaactatgtcgacaaacacaatgccgggagatctgcttagctgccgggagatctgcttagcttcagtgcaggtccaaaaatttggattcgaatgcgggcgtgccagtcagtttgatattgcgactgacaggatagataaattgatgatcacatagtcgatcgaccaataaggcgatatggcgataccagacgatgttgataggattttgaacacatcggctatatgtccgatatagattctgacacttagataaataatgatataaagacaatcgactgatgataatataatgaaataaatatccaataaaccaattagccaacaatgatatgatagaataaatattaatctgatggttaaagcatacatcggctgggaatctgatgtcattagaatttaaatccaaaagattaggcaatcaataaaaccttgctgcaattggctaaaaccaacttgtatataatccttataagccgatgcaacatttaaataacttatcgactgaaaccccaatgaaacattgattcatgtttactaacttaaataaatctaacttacaaccacaaccctacagggcgaacacaactggatgtagcataaggttgataattacctgatagatttaagcaagccaatatgacaccaatcaaagtgatcatgtattaaatttgactaagacagtaaaatcatcaaagagaaatttaacacatcaaataaaccccccgatgaaacattagcacgaacctatcggcttaacaagactttgattattaataacaattgaggtcggacctaaccgatgcagcacgagattgcgtttaataatctgatctcaatgagtcgataaaactttctaatgcgatggatataacaaatctatttaaaatagcattgtgattgtagagatatgtcggctaagacaagatcagacctaaccaagatagtcctaactaaattgatgcgtctctaaacacaatgcaattaaaaatacaattcaaatatcaggtaggtaaaatataccaaccgaaccagagcaatccaagaggtcaaagcgatggagccttgaacaacaccaatataaccaatacaactaccagggccggcagaacttaggggttaccccttcaccgaagatcaaagacatgcagccccgcgttaggtgccaagttctgcaggtaacaaaaacctcggaaaagagggtgttatgcgccaatattgatccagagataaatggcaatgaccccaagtgtacatatttataccctcgggctgatacgagtcctaatcggacacgttacaagtttcctaaagataaaaagaaagatagaagtcttgatcagacactagacaaaacttaaggaaaattactaaaaactacctaattattagatagaattaaactgttatgccatggtcttcacgattccttcctaaactcgatctcttctagataaaattacatcggctgcttgacttctttccttaaccaaatccactaaagaatcttaccaaattttggtaaattttggcgttaacacaatggtacatttctaaacatattttcggagaaagtggtaccgtatctcaatgtgcttggtccttgaatgttgaaccggattcttaacaatgttaattgcactgttgtcacaaaaaaaacactcaaagacaagcaaccatacaccttcacttgtggttttgaatttaaacttcaaaagcccaaaaggacatctctcataaagaggtacacacccatgggcaaatgggccggcaaagtgactctaagggactactccaaagggctccaaagggagcctactcaccctaacatccacctctctatttatagcccaagatggatgaaatccccctaagataatgtcaaaattgcccttggggcaaaacccatagctcagatgaaatctaggccatccgttgttccttctcctcaaaggaaatatctcagatgtccaaacgagccgaagcttctcatgcgcacgcactccagggtgaacccgtgattcgcgcgaacgcctcctcggccaatcaccgcacgcacttgcttgcatttgcatccttatctgtcacttggtcttgatttttcaatctcttcaaataaccaagtttgacttgcaatattatttgctttgtggagcaaaatcaaattttcaaaattttgcttgaagttgccaatgtttccatcaagggggagattgtgaaacaaattgtggttttgatttattgtgatggaaaattggcgagtgtcggaagtgcaagaaatgtgtgctgactaacacgagtaaggttgtgatatctatgcccgaacaacgggcgttttgtttacgtgtgtgtgcaggtgatcgaagtcaaccttggtcaatggcgaggaccgggactatgctcagggaggaacggaggtccgacgcagtcaagaggccatgtgacaaggtgggactgacgtcaggatccttggaggtctctctaggtcaacggcagatcgggactaaactcatggaagagttgaggtccagaagagtaaaggatgccagttgacacggttgagtacaaggcggtgcccgatgaacgaacaccgtgtcagtagtacttcgcaacgagattcacaaggtcaagtgtgcaagtgtctgagattcgcgaagagtaatgtacaatgctagacgatacatgcacttggacagcgtatgtgtactgtactcatgcaagcaagtgattgggttgcgcatatgtgcacgtggcccaatgccatgcacttgtgcatgagtctgatcgacttggcttggaggaggtcaagccaattaggctcttgcttgttgacccaagacggaggcggtaaggcgtccggctagcagccttgttggcagggaggccgaaccatgctggtccaggtgatggtccaagacgatagttgcagatgaggcctggctagatgcaagacgcagcgagggcatggaggcgaaagccgtacggaacatgcggttgtctcatactcgccgcacaagcgcataaggtcgcataggtggagcgcgcctcccagagacgcgtggtgaacgggtattcggcgagcggcaaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttccgtcatcttcgactataaatagaggggtggatgttagggaaagtagtgtccctttagagccccttggagtagtcccttaaaatctctttagtgtcccttctgcccatggatgtgtacttctttatgagagatagccttcagggcttttaagagtttaaattcaaaacaagtgaaggtgtatgattgcttgtctctttagtgttttctttttaacacctttcgtatcaaagatattctggagttggatttaatttcagtttttgcgctacggtctaagggaattcttcgctaaagattttttatgggtattcaatgaaaatttcaatacactatatacgacgactttgtccaaaaatgccatcgccgttatcgtcgttagggttccgtccattccgcgacattaagtgctataagatgaacaatgtacttaactccgcgacattaagtgctataggatgaacagtgtacttaacagtgcaaaatagacagaaccctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgccatgcccgcaggacagtcttagcgctcggtcgcctcgagcgcgcggctccggcaggaggccgagctcgccgcggccgaggaacgccagcaagcggcagcagagactgctgcgatggcagcgagggcgtcaaggctgcctgcggcggaattggtggcggcaagggtggaagtggaagcagcggcggatgcagcgcaagcggcggcggcagagctcaaggctctgcgcgacaatagctccagcagctctgtctccgcctacgacatccctgctgatgagctgacgagggaggcagctcgtgagcgggtggagcaacgggcagccgcgcaaccccacacgcgccgtagcagcagcccagccgggcgtggatgcgtcggcggcgttcctggcaggagcgcgcgcggcagcggtagcccagacgggcttggacgcattggcggaccccttggcaggggtgcgcatgacggcggtgctcccggcggcaacggcttggtcgacggagatcgcggccgttgcaggcggctcgtctctccctccccggaccggtaccgtggacaccacgggattcaggccgtcatcagggaagtcagccccggcggtggttggcctgccttcaccaagaccaactacatcgagtgagctgcggtcatgagggtgaggctccaggtgcggcacatgtgggaggcagttcggtacggcgacgtcgactacgacgaggatcgacgggcactgaaaggatgatgtcctaagatgctaaaagcaaaactgaaagaatgttgtcctaggatcgctaggatgctgtcctaagatgctaaaagcaaaactgaaaggatgttgtcctaagatgctaaaaacaaaacagaacaacaaaaggcttattccatcaggcattgggcttatatacttcttaaaatattaacacaccattagaacaattatacatgtgtggtgtggtgatgagatgcctgctcttgcctcctagcaagcttagttcgaacattgggtgggaatcttttttgttttcctttttttaagtggcatgcacaccttgaatggaccagcaaaagaagactagacaggaaaaaacacccatcatgaagatttgatcacatgatttccaggaacgtaagagttcatttaaccactttaagcactcgtcaacttattatagatgatagcccattaaattcttaatctcatatgagctcatcgccaacaaaatattttagatacaatttttgtgcatcaatattgtgccatgttgtgttacgcattcctggtaatgcatatgtgagctcatatgacagttgataatgagctatattctataataagttgattaatataccaattgtttaatgacatcactaaaaaaattgcactggccaaggatcgaactcaactaggtggcaagtttagacatcttaccactacaccattcatgtaccattatgtggatgggtgtgttaatatgttagaaacatatgagcccagaaccaaagttattggcgcggaccatctagtaatgtggattttgtgccacttgtgccatggtatcaatgctaggatctttggtgacaagatattgaggatgtttgaatcccaagcaaggaaaagcatagcctagcctagcaaggagagttgcttagtattagcaaaagaaaaaaaaagtattgcttagtaaggccaactaactaccgagaaaagctcacccaagacaaaaagccaaatcggttagcatccgatggcaatttgtcgggctaaacatccaagcattgtacttttgcttttttatgccatagctttcatgggctagcttgagcttgctaggccaagcaaaggtaattgcacaatctaaatagaccatgaatattggtgctaatgatcttggagccgagattcaggtccaattattttataagttttgtcaaggtctatttataaagtaagttttcaaatggaccagattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcaacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggtctgcccgctgagctgctccagcacctgcaagaaaccggagagagaggggggttgaaatggaggttggcgaaaggagggttgggagaattttggggggaggggggttggtgaccttggaggcgcgggttaggcggtcgccgctctcgccgacggagatgttgaggacgagcttctgcaccttgatctcccgcatcgggttcgactgctttttttccgacgcctgcaccacaactcaccacacgcacgcggaagaggggtgttaggttgaggagatgaacagcgatgagtcgggaaggagggagggaggaggcgaccatggcggagatggccgggagttcgtcggcggcgaggagggaggagggaaggtggcgtggcggcgctgggataaaagagagagcgcaaccctaggcggtggctgcgaccaagaggtttctggatgggcccaattgtggtaagtggccttttgaacgacagcgaaaagaatggcccaatgcttcgatgcaaccacaaaatgggccaaaagcccaaattctaccacgtacaaatgtgcccgcttgatgagttttggattatttttgggattttaaatgttctaatggtaagaacattttattcggtatttttgagtaaatttcaaaaaactacatatactttgacaaactattataaaactatagatttaaaaaggtgtatcacaaaactacagatttaggaccgaattcatcaaagaactacatatttaaggtggaagatcaccaaactataaatttagtaataaaattatcacaacagttcatgttttgcatcatgttaagtacaaaactacacatttatcactctaacatagcagtagtggtaggaatttaagctgtaaaatatgtagttttgtgatactctagtattaaatctatagttttgtgataaattttgtgttaaatatgtagttttataatacgacgccttaaatctgtacttttataatacttcgatcaaagtactgtagttttataaaatttactcgtaattttatttgtatgagcaatcataaaaagagatatgaccaacaaagaataatctcaaaatcaaaatcaaattatattattatagattttgattgcaatccaaatatttgagggacctaagagttgtatctcaaaatacaactcaactttttgaaatcttgctctacgaaaaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggcaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgtatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatgacatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacaacaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattggcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgaagatgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataaaggccagccgtgcaggcggaaacaccagtcggcggcggagaaggcaagccggtcggtgaagacgtagacgcccaacaatggcggcataaaggccagccgtgcaggcggaaacaccagtcggcagcggcaaaggcaagccagtcggtgaagacgtagacgcccaacaacggcggcataaaggccagccgtgcaggcggaaacaccagtcggcggtggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcttgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatgaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgatggcaacgaaggtgagccaacggtgaggacgtagacatccaacaacggcggcataataggccagccgtgtaggcggaggcaccagtccgcggcgacggaggcaggccggcgatgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcagtggcataataggccagccgtgtaggcagaagcatcagtcggcggcgacggaggcaggccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggtcgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacaatatctttgttatatttaactagaaaggtagcccgcgcattcgcgcgggcatgtatcgtaagctgcatttgagatactcgtaagtaataggctgattgtgttaaaatgtcgtatttgttgtatagtaaactataggcatatggatcttatatcgttggtttgattataaacagagcaatagttagattagaaatcagacgtgaaacttataattatagattatttatattttagttaaataggaacgtaagaggaatgaaaagtttagagcttgagccagagaggggaaggagcggctgtgtagtgatgggcgcgtgtggaggggattttttttttaatttttctaagtgattaagtgaaagccaattattagatgtaattttcctaagatttgcaagatttttttaaaatatgtgacatgccacttattaagatatatttttctaaaagtagattagatagttgaaaataatgttaataggtcatcgatctaggtgaaaaccgttagctagatgttttattttttttcttttaatatataagattttactaatttttaaaatgtgacacttggtaatttagcatgtatctaaaaggtcatacatggtgactttgtatttttctattttttattatgtagaatgattaagatgacataatacatattgtcaaattttcaatgtttcagtgttgtttgcttgttggtgtatgttcaaattacgtattttaaattttacatagtaaaatatgagtaacataaataaacagttcaaataaattaaaaataggatgttatttgggttgtcaggtaaagaataggtggcagttcaaataacatattttattttttatagtgaaatattggtaatattgattttaaattatttagctgtctagttatgaaacaaccgttcaaacaaactaaataaaaacagatatactacatccgttttatattataagtcattttgacttttttaagtcaatttttaagtttgaccaagtttatagaaaatatagtaaaattttcaaaaaaaacatattatggatatatatggaacgttatatctaacaaaacaattttgtgtgatagatgttgttaattttttttatatatttggtcaaatctaaagaaatttaattaagaaaaaagttaaaatggcttataatatgatatagagggagtaactttttaaaattatgattattttgctatgtaactattatcttttttctaaattgttagttaaaaatagatttgttatttataaaagcatgcatcaaatcattaatcatttatatatttaggcatgggacatgcaatcaagagtccacatccattctcgttagatagaagtgaagaaattaattattaagtaataaaacaaaaatcttaactaccatacagaaaaaaggaaagagatgaggagaagggattgaggggaaggagatgagaacgtactgtagtagttgaggaagaattttttttatgagataaatccaattggcccaccagttcaagttatatatttttttctaatttattagagtgccacgtgatggcttatgagtgtttataggagtctcacgtggcaacttaagagggtttataggaagtttaatggacttttagtatataataatagatagatagatagatatataatatatgttgttaataagtatttaatttatttagatggcatgcaaacttgcaaaatgcacagtctataccacaataacatattgcttatatatagcaaaacattggatgtaaaattgtcaatttaattataaatagagcaacgttttaatagaatataaattagctatgtacatttaaattattttaaatggtcaacttaactcgtttttaatttgataacataaaagaattaggaagagaaagagatggagatataaaagaataggaagaggaagagacagggagagcgtactaagttcttatgttttttctttttccggcccacggttatacgaagccacacgtacgtacgtatgtttttttttctttttctggcccacagcagaggaagggattactttattgggtccaccaatttaactaaaaatcgacggtgagattatacagtggtatgtggcggtttaggagtgtttgtaggagtgacacgtggcagattgaaagcgtatgtaggaagtttaagccacacgtacgtacgtacgttttttttccttttttttggcccacagcagaggaagggattactttcttaaataatagatctaatccaatggtctaaaatatcgggtccaccaatttaagtgaaaatcgacggtgagattatatagtgccatgtggcggtctagaagtgtttgtaggagtgacacgtgccgaattgagagcgtttgtagaaagtttaatggacttttagtatataatagaagatagatagatagatagatagatagatgtgttgctgttcgttagcaacaaactaactttgatttgtcatcgtgttctttttattaaaataaacggttgtgcaattatctctaaataatatatgttgtactgagaagataaatatatattgtattgatgatcatgagtgctagtgagttgatgtgtgtatcttaaatttttgggacaaattgcttaaaattgtgttcattgattgtatttcttggaataggatgtttgtcaatggttatattttctctttcaattactgaaatcaattgtttaagtataggtgcatagccagaaagagttgcttatcaatgcccatgatagctgttagctagagagagacatggctgtgtaaaaacagttgaaagggccaactaa

SEQ ID NO: 8627 - DNA, 2333 bp, Oryza sativa
tggatcccccacaaagaaaattcattcagtttatgaaaatagaaaaacattaagaaattttctttagaccgcatgtactgtagagcagtgcctaacatactacctttataatctcgacaagctgatccactgcactttcaccaggaaagagaggctggaaaaatggacaaaaaagatgtttagttcaaagtttgctatagtcaacctgataaaaaaaaacagtcaaagaagccacaaacaggaaataacctggccaaggagcaactcagcaagaacacacccagctgaccatatatcaattgatgtcgtgtattcggttgccccaaatatcagttctggagcacggtaataacgtgaacatatatacgatatgtttgcttcacctttaacctgcccagcgattgaatggaaaagcagatcaaaatgaggacagtagagttgcattacagcaatataaaagaaaaaagaaatacagcaatgtgaggttgatccagaaatgcactgtttttccccagtttctaatttgtccacatgaaaacagcaagaagatattcttgcaacaaaacgaacaaaagatctaatccagtaatttaaattatgtaaatcaaactgctaaatataccctcttgaaaaccagaaagaattgtgctatacaaaaataaaataaaataaaataaaataaaatgagctacttcagtatttaaatcatgcgaattaaactgctaaactaaaccctctccaaatcataaagaaccactccaatataaatatctgtaatcaacactaaaatgtgcattaactcaccaacatttttgcgctcccaaaatcacatattttgacttggtgagtaagaggatcgacctattaaaaccaatataaagtaagaatcagcttatattcagatactgttaaccacaggttattaaaatatcaagcgtgaaatgaacataccaaaagattctgaggcttcacatccctgtggcaaactccaggtacagtatgaatgtaagccaaaccacggaatatctatacagaacagacaagcaatatcaatatcatgaatacaactatggaaactaacaaaaagtagtaagcaactgtattgtcaataacatcttacctggtaaacatacaatttgacatatataagtggcatcctttggttcatgttgctataatgcttcaacacacgatacagtgactcaggaacaaattccatgaccaggttaaggaaaagttcatctctgcttgttgtagagaagaagcaatgcttcaaagaaacaacattgcaatgatccattgatcgcataatctgcaactccctgttcttgtaacgcttgtcctgtaaaaccttcttaatggcgacagtctcaccagtctccaaacattttgcctgaatgataaaagaaataccaaataagagacaaataaactttaaaggaggacaatgttacactgcagaagtttacctgaaagacgattccaaatgatccagttcccacaactcgttctgccatgtagctaatcgtctacagagcacaaaaatcaacccaagttagataaccttacacataagattgaataacatattgtggcttccatttatgttataatttacccttttaggttctccattcttccctccaatcgttgtggagattatgtggccggtgacaggatcactcccttccataagagaagcaccgtgctgtcatgtagcaacaaccagtgaggcaaggcagaacatcaacaatcaacaaagaaagaaaaaccactaaaacaaacaggttcatgacatctactgcctcaattatctaaagcggcagcacatcactaatgattccatcccatagcactagaactataaatccaagcgatacatactatcgacaatctcctggattgcttcatttcaaggagcttggaccaaacaggtgacacaaatgtgctgacttggcacggctgattactgcaagactaactgcataccggcatttaccctacgaattcataacaataagctagcaagagtcccaacaagactaatcagatgacttacaaaccttgctaatcgccccaacaccaaacatcgcatcgcgcgctcattcaagggctcaactcaactgaatgctcaccaccaaggcgctaaccaactaattgccccctcactagaacaaattaaaccataaacaaccataaataagtactaggaaactagtatcatcaagccgtccaagtttggacgcagctggtgatgggatggagaagcgcttgcatggcgcacacgcaaaggacaaccccggaggagggcagcgcatcccctcccctcccct

SEQ ID NO: 8628 - DNA, 7098 bp, Oryza sativa
atcggacaaaagatagctgatgcagccgatatcacgaagatggttatataatcgtatacgggattgatcgacgtgctgtgcaaggattgccatgatagagataagctcacggataggcaattgtatctattaattagggtattttaaatagtttctttaaagatatgtttcggcaagagtctgcttaaaagacttgtttgtatcttaacgattgtacccattttagagtcgtgtccggtaaggactagtcatgtatctcgagtataaatataacccgatcctatgtaattagacacacacagttcaataacactttcggcgcatcgccaccttttctcttttcgttactttcgacgagttcttgcttcgagttgggctgcatcggtttcgatctccagtaagaggtaaaacttgttatggcgacttgtgttctcgggattagtgcttacatcttcatgacactctaatcttgtttatgtaaatcgtcaagttatcatatatgttatataatctctatcaatattgttatctaaccctgaatcggttgccatctactattagaaagtagccgatagggttagatgccaacgttgatctaggttatatagcatatccatcatctctaagaggttttcactgacttgtttagatcttttgttactctttctgcttaatgctgcatcagttacgttcgatctattaagtaatatctagaaccttaatatctaacctgttttatgattatcgatagagatagaatcggggttttagccgatcttacttgatttagttatcttgttatctttatatttacttgatatactaaatctgccctttatattaagatcttagcgcgttaaaatatattaagcttactgtttagtacattttgcttgttttaatatcttagtataaagtggtatcggagtactagccgatacatattagatctagtttcatcggctaagctatgagtatatataatctttatcttgagatacttttagatattaagtgatttatactgtctcggcatgctgtccgatctatcccaatcacatgatttaaacatgcttcaagatatagattatatattactgatatctatagccgatcggatagatttaatcttatcttgcttttattattcattgccgatcgatctcaagatgacatcggctcaaggataaacgatatgtcatactctgtttatggatttaaccctgtttatttctttctttgtttcttgttggttacaagattaaaccaactgggatgcctttgaacccaagagcaagacataggacctgcactggagttaagcagatctcccagccagtgtgtgtttttcgcatcaacaaatatatagcatatgcgatgtgaatcccgaataacatgatccgagtgatatatcgactgctttgtaaaatatgatgcgagcaacttaaagttgtgtacatcatggaaaattcacatagcaaaacaactataaaagaagcttgtatgccggaataaagaaattttcaaagtatacatacaccatgcgtacactgctttaacaaatatgcttaagtccctaaaagacacatggtttcaccacacccagaaatatacgacatacgtggtgtaaaatccgagtaaataaactcataaagaatttaccaactgcttggaaaatgaccaaatgtataatcagcctaagccataatattggtcaataaatatgcacacttccgtggcaaaaaagcaacgatattgtatccaaccgattgctttataaatccaaacagtcccttgactatataaaaaaaattagctggacgactatataaagcttcactatttagcaccttttaaaatgcattgtaccaactcctaaaaagttaagtaacagcggtataaaaggattttaaggtattgggcacttgatcacgtgcacttttgcctaagcaaaaaatgcctaagtccctaaaagaacgtgataggccacacctgaaaatatgggctgcagacatattaggcctagacccaaatatgcccaccgatacccttgaataagacgtgtatagcacgcctattaatatgctcccgagtgacaaatctcccgggtgatgtagatcaagtacatatcatctgagtatcttctgaaccaagcagctatccctcatggagagtaccaaagtagatgtgataatcaaatcccgactagcgcaagtactcagctgatggccttcgcggggaatgatgaataatccagtctgtgagcataagaaattagctcatgaccatgaatccatgttgaatgtgttcggaattaatccaaattgaagatataatcctcgcacttgcgttgatgagcccctaagcatgtagcttatccttctgttatagtcacaattgtctattggtggtagctgacgtagtcaacatggagacgaaatgaccaacatgaagatgatatcacccatcagagccgatgaagatgtcagtggtggtaaagacaatgacaccaatcaaaggtgatgaagtcgcatagccgtggagacgaagaaaccagtcggcagcagacaagtcagccaacagtgaagacgaaggcgcccaacgacggcgacaaagttgtgcagcgatggtggcaaaataatcagtcagtgatagatgaggcgaccggtgaagaaaacgaagacgcccattagcagtaacacaataagccaatcatgaaggcgatgacaccaatcggtggcaacgaaggcaagccaacggtgaagacgtagatgctcatcaacgatgatggcaaaatccaccgatcatggagatgacaaaaacagtcggcaacggtagatgcaatagacggtaatgacaattggcagcagtagagatggccggttatgatgacgaagttgcctatcaatggaagcaaaataggctaaatcgaagaagcatgacaggatattgatgatgacgacgatgtcggtgatccagtcaatagcagagtaatagctgatgatgacgacgaggtcacctatcagcaattgcgtagtaggccaaccgtgaaggtgaaataataagtcggcaatgaaagtcggcgatgacggaagaaatcgaaggcaaagatgtagtcacccattaccaacagcggagatgtctgggccgatgaagtagagttgctggtgatgatgtcagtgataataattcatcaaattgttgagaagatatccatgctcgagtagttttcttgatgttggcatctgcataactaagattgatgcaacgcctcttgatttatgaagataatagtagaacttggtgttgaagctgttggagatgcttctcttggaggaaaatagatgttgttgttcaactcgtcaaatctgagttgattgtttgataactctaaactcccttagctcgaacttgggaagttgagaaacttgaagtagattgtggcaacgtccagaagctaaaattgtcggtaaaataattggagttgctgaagtaaaacgcctattctgaagcgtagacgaagataatgactcccgaagttgactcgttggctaattgattgattgcttcatcttgacataaaacttgtcaaattttgagccttctatttgtgtagcccccgactatttggttagttggaaaacaactgaacatagagttaagaactgtagctttttgtctagtactcatcatttgattgaagatatacgttgaggatgtctgagtagaaatattgaagattggaacaccacttgttgtagtaaaataacacggcatcatatttggtgaaacatgccgagatgtcgaggcacttgtagacgtcgtggttggtgaactagcaaggcttgcgaagtagaggcaatagagtttgccagtgccaaagataatgaagatgaagtcgctcaaccatggtgacaaagttgcatagccatgatgacgtgaacacgagtcggcggcaaccgaagcaaaccggtggcgaagacgcgtagtcgtgaagataaaaaccccagtcggcggcagcataatcagtcggtgatggaagaagcaaaatgatgatgaaaacgaagatgtccttgagtggcggcataaaaggccagcgtgaaagcgaagacaccatggacggcggtggagatgagccggcggtgatgacgatgacgcccatcgtcggtggtgtgaccaaccagccgtggaggcaaggacaccagtcggcggcgacgacgacaggccaacggcgaagacgtagaagcccatcgacgatagtgtgaccaactagccgtgtaggcaaagacacaccagtcggcggcagcggaagcaagctggcggtgaagacgatgacgcccatcgacggtggtgtgaccaaccaaccgtggaggcgaggaaacaccagtcggcggcagctgaggcaagccggtgatgaagacgtagacgttcaacaatagtggtgtgacaatttacccgtatagctcgaggacaccagtcagcggcgaacgaggcgcccggtcagtgaagacaatgacgcccaccaacgccggtgtgaccacccaccggaataggcaaggccattattcgccgccgaacaagccgcccggttggtaaagacaataacgccgaacgacgccggtgtgcccacccaccggaataggcaagacctccattggccgttgaagccaacccaccgttaaaaataaaattcattgacggttggttgtaaccaaccaaccgtggaggcgaggaaacatcagttggcgacagctgaagcagccggtcggtaaagacacagacgcccaacaacggtggtgtgacgaaccaaccgtgtaggcggagacactagtcggtggcgacagaggcaagccggcagtgaagacgtagacgcccaacaacggtggtgtgaccacccaaccgtataggcgaggacactagtcggcggcggatgaggcggccggtcggtgaagacgatgatgcccaacaaagtcggtgtgaccacccaaccgtataggcgaggacaccaatcggcgtcgacggaggcaagccgacggtgaagacgatgacgcccaacaacggtggtgtaaccaaccaaccgtataggcagaaacaccagtcggcgtcggcgatggcaggccggcggtgaagatgtagatgtccaatcaacgatggtgtgaccaaacaaccgtgtaggcggagacaccagtcggcggcgacgacggcaagccggtggtgaagacataaacgcccaacaacggtggtgtgaccatccaaccatgtaggcgaggacatcaatcggcagcggcgatggcaggccggcggtgaagacgtagacgcccaacaacggtggtgtgaccatccgaccgtataggcgaaggcaccagtcggcgacggtaaaggcaagccggtggtgatgttctgaccgatcccttcttgaagcgtaggagataagctaatagccatgaatccctattttgcatatccggatctggatcctgcataacaaacatataggatgagtagtatctgatgtaaatacagtacttgaggaaaatttaagtattttaaaatatctataaatatgtatttctcctcttgtcaattttgatttccccgagcagatgattccttacgtttaaacactctgcccgattactcattgacatgagttcgtcattaatgaaacaaagtttcacacatcagaatttactactcgggtacttttgcaattgttaagagcagaaaacaaattatcttatccctatgcttttgatttcttccgagtaatgcttagaaccttgcgttactcggtctatccaatgagcccccgggttctaggaatcggcccaaaggcaactatccatcaacaaactaaacataaagcataggaagatagaactctataacttgataggcactttatttttactcggattattcacaagcaatcaagataaatattgtgaaaattattgaaaaaatatgatataacatctatagcccccgactcactactcaatagagaaccaattgatgtagtgaggcagaggaaaagaaaaatatcatataaaaatgatgacttagctttttggtattccccttggtgacgacagagatggctgatgtgggaaaaaggtcgtccatcaatagcgactaaaacaccagccatggaggcagctgaggcgactggcgatgaagatgaggacgcccatcaacggtggtgtgaccaatcggcggtgtgaccagctaaccgtataggcaaaagcaccagtcagcggcggcgaaagcaggccggcggtgaagacgtagatgcccatcaacggcagtgtgaccaaccaactgtgtaggcagagacaccagtcaatggcggtgaaggcaagccggtggtgaagacgtagatgcccatcgacggcggtgtgaccaaccaaccttgtaggcgaggacaccagtcggcggcggcgaaggcagaccgacggtgaagacgtagacacccatcgacggtgatgtgaccaaccaaccgtataggcacaaacactagtcggcggcggcgaaggcgtacaaccgtggtggcgaaaaccacccgtaggcgatgacaaaggcagccgttggtgaagaagaaggtgtatatgtgtcatcagcggagtatggcatgcttgattgaatcagagacgatatctcccgatgatctcagccaatatgttatatatcctgatgtatgttgtgtggattccataaaaaaggttgctgtgtgcatgtatctgtctaggtaggtagatcacgcacgtgcatgtatagcatggacagaagtggctttgatcgatgccattaaggggtgaaaacggtacagaatatttccggattccgggcaggttttcgaaaacggaatcggtcggttggaatttttttggaatttttcggaaacggaaacgaatacggaaatattttctcggaaacggaatcgaaaatgataagagcagtttccgacggaactcggaatcggtcgaaaactttccgaaaactctctcggaatttccgaagttacaaagtccataatacctcccgcttgcccagcccaacccactacagctaaccctaccctatttgaagaaagtgaga

SEQ ID NO: 8629 - DNA, 1354 bp, Oryza sativa
cccatgtttgaaggcactagagaaataaatccttggtagctctacccattagagggtatattcatgtctaatttttaacattgttatccctttaaccaatagaagcggtatttttagaatattttttttatagatttagaaataagagttgacataaacatttaggtatgtagtggagattaatgttttatgtattaatgattaataggcttactttggtgatacatatgtagttccatttattaaaaaggcatcaagcaacaatgataattagtaatggtgataataggcgaatttacgtgtaatctagacaaaagtgatttttgcttgaatataagaaaattcttatcgtttatcaaagtctagggtcaatttagcgacaaagacttttttttaattataagttgaaatctaccatttataatatgcatagtgaaatatgacttaattctattaacattatttctatagataataaataaggtgcccgctcatatgcgtgggctttctttctagtttacataataatacaataaaaaatttgagcaaacccgtggaactcgtcgaaaaggttttttttttttaccttctgattaacctctggtaaaacctctgtaaggaaaggttgaattatacataccatttagaattaatttcttggactgaatatcatactattttataaaatttgcatgttagtatgttactctaaaaaatcctgctagtcaagggtctgttcggtacccataggtatggttggcgctgcaacagctgctacaatgaatcgatcgttcatttgtatggcgttgcgcggcagcggcagctctggccttcgaacatagcccctctccctttgttcatgtagttttagctagtggaagacacgttaagaaaatgttaaaagatttctatgtcctcgttaatatagcaatctagtactacatttgtatcaaaaatataagaatcaaatggaatattcttagtacaatatatctagatagggagtaggtaagatcacatccgatcataagttcttatattttgagatggaggtgggtgatagatgaaattagtattagtataactatgatgtaagtatcagttttttttggacggagggagtaataagacgaagggagcgttgtcttttgagacagagataggccctgtttagatcccaccctaaaatttttcaccatgccatattgaatgtttaaacacctacatgaagtattaaatatagggtaaaaaataactaattgtacagattgcgctaatttgccagaccaatctttttaagcctaattgtgccatgatctgacaatgtggtgctacagtaaacatttactaatga

SEQ ID NO: 8630 - DNA, 911 bp, Oryza sativa
  unsure (1)..(911): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgacaccatttgcattcagctttccacgcaccatttattttcttcttaacaaaatcttgccatgctgcagatttcagtctcttattatcatgttctacttctgtaccttgtgaatcatttatttcgacgcttggagcattggttggagtgggagtggaagtggaagatggtgtcaatgcaacttgtgactcaacggtggcagcagggttcgacattctgtccacaaataacataattcaataatagatcacaatctgctgctatgtgctatgtactaccaaatctaccaaatatacactgaaatatacactgaaatagatcacaatcttctgtttcataatttcattcacaaatcacaaggcacatttggagtattggagatggagcaatacctctcactctttgtgatgtgctgcaacctcgccgccggccgcgccctgtgcgccgccgccgccgccctgtgcgccgccggccgcgcccttgctgccggtgtcgcctccccgccgcgcctgtgcgccgccgccggcccgccgtggcgccgccccgtgtgccgccgccgctgactccggagggagaggacgagctcgagccgccggacgccggaggggagactggagaggaggggagaggagatggtggcctggcggctggcaggcgccggcgacgccgagagggcgagatccagaggcgagccggcgagccgcccacgagcgcgcgccgccgcctaggtcacgcggctcacgccacagccgcacgggatgagtggatgaccggaaggggaggggaatgggctgcagg

SEQ ID NO: 8631 - DNA, 1483 bp, Oryza sativa
tcctgcagcccttacatgacccgtaatggcagaataaggtacaataacaggacttttagtttttcatgttgctgaatctttgttttaatcgaataaaaatctaactttctgtcatttctttcagcatggctggtgtaacaacaggaaatgtggcgtatttggctaatgctattcatgaggtcactaaaacaaatgaagctacttcctcttccctcttcggccaatgaaatgaggcttgcaagcggcggcgttttttttttggggggtggtctattgacctttaagatggttgtactagagaaataatccagtgaacatgctggtgtttctccaacttcggattttccctgtatggaggagagaactagaaacctacccaattttgagagctatagatgccgatcctgttatttcaatcgtcagatgttatgcctgtggcagcctggcaggtcacctcagaaacagagatatgtgaaagagaataaatgcaaatgagctgagcattttgacaagtcatgtgtggccctgccgaccgaccatgagaatttagataaaatttgctgctttttttgtatgtgatatcaagacgaggcaggcgtattctgctgaatattttttggtaaacgtagcatgagagtttagcatgtagactcgcaggaataagccgtctcagcgaagaacatttcatattgattcgtgcttttgggctctttcatactgattcttgtaactgagaaaaacatgcaagatgcaatgtaattttctcgagaacatattgtaggatgggtagcatactgatttgcactgtacagtgcatacgccaacacgaccagaaatgaccgatctacctagcagttagagattggatcgtgaggcatttgcaacaccagcaaactccttgcagattccaagtaaaactacatccagactatacacgtttttgtacaattgtcatccttttgtttgtggttctcccccctgatgtacaattgtgatcatctgggaccagatagctcaattggctctattatgaaggatgatgaatcatgaggatcctcatgccttactgagaaactgcaagatcctccatagggaggcacttctctattcaagtcgatgccgttctctggcagggtgacattagcttcaagggcattaaggacttccgacatcttgggacgcaaaatgggattggtctgagtgcattgcagaattacgtcaacagaacactccaactcggcgaaatcaaatgaatatttcagatccctgtcaaccagtttatccagtttattttcttccttgacttctctaacctgcagagaattaagattaggtggtaagaaagtatacaaggatatgggcatcaaatgacagtagttaggtaattagataaagattgaactaaaagaggatacccaatctaaaatcattcccttctgagattgcgcgtgcccattgctcaaggttttaggcccagtgatca

SEQ ID NO: 8632 - DNA, 7411 bp, Oryza sativa
tgttagtaagagagtgaaatggaaaagaaatgataggagaatgatgcaaaatcaaccaacacaggatcacaacacacatctttgtaaggaagctatcatagttttacataatcatcattttagcttttggatcaacaacagtctaccttcaataagaactacaactggaaactggcccagctatattaaaacataaaatcaaaatttgtttggacgattgtaattacctctcaagcgatcagcaacactgccatttggcatatatggatatacaagcaacctttcttttgaggtcatgcagaatccatataaccgcaaaaggttcctgtgcacagctagaccaatcaactccacttctgtctgaaattgaacttcaccagtaatatcaggatcttttagtctctttacagccaccaaagctccatttctcagacagcctttataaacaacaccaaagccaccttgacctaatatgttctttgagttgaaattgtcagttgcactctgaagctcgtgaaatgagaagtgctttagatggcccaattcaatttcaagatcttggtctagaagtaacaaaagaaaagaatgtttatcagatgctatatattctgaactctgcaataagagagtagatgcttaaccctttgaaaattaccagcagaagcaaaaggcaagcgccatctgcaatattttagccaacaaatgacaaacagaacaaatactgtggcacagatgatgcttaatgaaattgccagagctagttgatgatggctgtttgtttttttcgacgggctagaaattgttgattctgcaaaggaaggcaaattaggtccaacagataaatatgcaagtatatgacatcaggtaaacaattaccattagttaatactgtgagatctttgcaaccatgcataattgatgaattgcaaaggaacctgtttcctgcaatactggaaatcagaggaaagtgatcatcaggagggtattaaaactgatgagaaggaattatgtgcatatgctttgggaaggaattatgtgcctacgcttagtttagcataagaacacagaaaatatgcaggtgccaaacactttggttaagcaaatggaaggaaataagcagagcttatcgtacgcactctcaccaacttacctgtagtcatgtgcatagatttttggaaccgggccgctcaaattattggatgataaatcactgaaacaattttcccatgttgggtaaaaatcaataattacgtttatacacaacatttataacagaagagagaatataaagtggtgaaaagagacatacaggaatgtgagacctggaagctttgcgacatcttcagggatctgtccagacaagttgttcttatctaggcgcctgaaggattcacaaacagaagtcatattttgggacaagcaaaatatgtggcacaaaatttgaagcaatattttggcatctgctcacagatagtttaattcagtcagccgccctagagaacttgggatttcaccaacaaactggttaccagaaagatcaagagctttcagattggtcaacttcccaatctctggaggaatgccacctgatatcatgttattctgtagtaacctgaatgaagacaataaaaatgttgagtaatcaagtaatggtattttgtttcattttatgaggacagacagatgtcaagcaaacaagttcatgggaatcagtatgaatacacgatcaacttaagtatatgacactgcaagatgtaatatgctcatgtccttacaaataggatgaagacaatcaaatgttggacaaaccatactcataaacatttcaatgttatattcaaatatgaatcaaatgaatattctatagtggtcacatagtaatagccttcaatccacatatgcagcacagttgatcattctgatttgtagggttagccaaaagaaacatgaatctctctacagattaagatacatttctactaaagcagtcagttaaggtgacaatatacttccagactatttatatactaaaaataataattgctatagaatctgcatataattttcacgtttgggtctgtagacaaactttggttatgaattctagtgctgcaaggttcagaaaaatgtttatagaacagaaaatgcactaattagtgagtcatgattatctcaactctttatatggatctatttcaatgatacttagaccaaacaaggtgagccgcacattcattattaccaggccttgaatcctgagaatgtcatttattataactaataggaagtgtgacttgctcacatgaaaatggtgttccaatgctagcattggaaatgcttcagttgtacgaaaagtgtcatttgcccacatgaaggtctataaaaaatattaaaaatggagatgccatggcatggcatctgtcccccactcttttcagatgaagaaaatgaaattttattcagaggtgccatgctatgtcagctgtcatctctcaagtgatgtattttacacatctgtcttgcctggctctggagagtaaatgttcagtgttcacggaccctacatggagttctcctaagttcaactacaagagacatagcccatagggtaatgccctcactttccagctctttaactatggagatatcaatcgatcaatcaccaatcggatggtaccaaatccaaaacaacagttggggaaaactgatcctaccaacccagctcaactaattttgcagtgctacgactatgagacaatccgtgctcactaataaatgcattaatggaacaagaacaaaacctttgcatttgataaggttcgaatgaattcgttcaagaaccccttacattgtctgcaggtggctgaggttcccgatgctcggcgacagcgtcccggccaatccgttgttcgccatctgcctgcagcagcacagcaatccaaccaaaaccgccataatcaacaccaccaccacgagcagtagcagcagcaataacaaaatcccacgaacgaatcaggagaggggaatcctcacagcgagacgacgaatccgtcgggggagcaggcgaccatggaccaggtgcacgggtcgacggagttgatgtcccaccctcccatcacccccttctcgtcccgcatcctgctcttcaccgccatcagcgccgccactgcaaaaaccccccacatcatatcaaaaccctaacccacctagggttcccgttccccaaccaaaacccacgctacccaacccacgcaccttcgtagttgagccccttgggcgacagcggcgggtccccggcggcggcgacggcccacgcggcgaccaccaccgccgccgccacggcgagggcgcggggccccgccatgagaggagtccgacggcgacgccggggagggcgaggaggaggccgcgcgggcgcagcgcagcagcggcggcggaggcggaggcggtggcttgaggtgggctacgctgcagcaggagctcgggcttggcggccatgggcgcctgcgcgagtataatactgccactgtatcgagctaagcgacgggggtgcttagcttaggcggggggtgtgattagattagagttaagattaaattagcgcaatttggttgggaattgggcatcttaattacgaaagagatcgctaattgggccttaattacgtttatcgcgagtggaggcgggtggctctctccctgcctcgggaatcgcgctcccaaaaaaggctcccgatttttatttattttcattttcgttttttttgggattcttttttgttatttgggtcggtgagaaatgtgaaattgtaaataggtcctcgaaattataagtagctagggaattggcgcttccggtctgccttgagccctcctgttgttttgctgcttgtttttttactgctcctgattgagctagctctgacacaacacaattgtttgttctctttgggaacactaaacatttgtttccttgtgacagtttctagacaatttaacattactgtatgtgtggacaagagggccattaaaacacagtttttttttttttgtagggaaggagggaagaaacaaacaaatgatggcactggtcctagacaacagtattggtagttgagaaaattgagcatgcagagaaatgccagattggtatcgagtcccatagtgcaatttggtttggatattgaagctacagagggtgataaggttaattgtgttttcattttctcgatattttatagctcaatgttctagtacattttttcattaaatctatgacttgccccgagcttaatgtatatccatatattatactcgttacgaggctggcctatattattataggtgggcgaggcatcaatagatgtaagcagcatatcgcgcatatcaaataaatttaataccataattagtcaatttttaattgtatctagattcgtgaaaaatcttagctattattctgtacacaacggacttagatatcttatatattgggcgataaacaatctgggtagcaacagctaaccactcctacggtcctatcatagcttcgatgtcaacaaagatggagccatagaggaccatctcatgtgattgcaactagatttaggtgctatccacaaggagactaacaacacctgtatttagatccaaatacatttcgtcatcactcatcagtacgatggagttaatcacaaaatcttttcctctgcatttcattgtcccctgaaattttctgtaaggcactttatcttgaaaaaacacgaacatgtaaatggagaaaatgtgtccttggaatcaaaagtttataaggaaaaagcatattttacatctttaaaaagttcactttcatccttcacctgttataaacagatgtgatttgtgccatgtcagccaccacacatcaccacaagcaccttgccatccttattgcttactttaccgtttgttctccgcagttagaacaagtgcaataagatttggctgcttcttctaaaagtaccgattaggttgtggtggagaagggaactgataaggcagagaggataagctgtttcttatgcaaatacaacatctattaatctttaaaaaagtgaaaaacaaagtgctaaagagatttatcattttccgtgtgcatgtttcccaaaatgctaaatgttactttttttgcaaacaacattctatacgaaagttgtttgaaaaaaataatattaattcattttttaagttgaaaataattaatacttaattaatcatgtgttaatggctcatctcgttttgtgtgtatcttctcactcttctcttttcccctcctctcaaatacagccagtgtgagagcaaacaaaataaataaaattataccataatattatggtttatgaattagagatgatatgttaaacgtgttgtgacatcccggcccagggcttaataggattaatagaatactcatatcaacaagttgcaacttcttttccggaagccgatctccaaagaactcctgggtgtgcacgagtgaggacaaagtgtgccaacttgtgttagtctgtgaggacagtttatgacctataaaagctatcatatgtaagcgggccgacctgggagaggataaaaaatgtgagtttttcaactttaactaatatttagattataatttatagaactacatattatcagaatctaggtgagaatatagattgcttaggggagttaaagactggattataatttatagaactacatattatcagaatctaggtgagaatatagattgcttaggagagttaaagacttgagaggctcctctcaaacatggtcatttcttctagaatctagagctcttcaaacagtctagacttttgttcagattgtgaaaatatgtagttgtagaatatagtaaatgaattagaaggaaaaaaattagcattttcagattctcaccagttagcttctcaaaacactcaagctcttcaaacagagctaaatatgggagtgggagtaatgtcttggttagtgggattaatgtatggtatgttaatagattaatttagatgcaatgtagcctgggatgcgcattagtccaagcatactaatctccggtaaatgttgcccaagacgaagacgagagcacaagcacaaactgcttttgcatgtgtatggtctatcctgcctgatggtagtacctactgccaagccaaaccagggaaaccatgaaccatcgtcagtactttcatttcggcttgtatatgtccacaattgtagtgcaaaaaccatattgatgcattgttaagaagccgattcctgcgactgtgagaccagctcaatcaacggccttcagaaaattcagattaggccctacaaaatctgactccacctgctcaccttagaaatttgcagcactgttttgttctaattccaacttgtcagttgtcagaatcgtgattattgaccaaagaactttgaaatcatgcaggtagacaatgaaatctggggacggtgtgaaatgaagaagtcatcaaagcagcaaaaataaaacaacactgtatgtatatgctttgtttacagacttctataagtttgtagccttcccatagtcaacagcaactggaaaaaaaatagctataaaagattaatagagcaggtgtgtcagcatgatgataataaagcaaataaatagtgttctgctcaaccacactaaacagacagcatctctattgatgaaaggaccagccgacacaaccaattggttctcaactgttgcttttattctctcaatataggattggtgcagacacctgccttaaatccttacacaactcacaaatgcagacctcaaatatattactcatttatcaacaattttatcctagtattccagtgacaatgataatcacaacattcatctttgcagccaacagatgaggaaagttctctgaaccatatggtagaggaaaccagtagggggggggggggtaaacaagtttgggcatggggtatcataacaagagatttttccattaggaacatttacacaattacatcgacaatagggcatgagaaacacttacaggggcactacaacattaatcgtgggagaaagtagtacagtacttgggatctgatccctttcaatagcttaacaatacaccatccccattccctccagctatccccacagtacttggctaatcctgaccaccatggcctcctaataatggaggagaagcattaaattaacatgggttggctgtgcctagcacacccacctcatataacacattggcgccagctcatgttcagcttcccaataatggtcagattctacaccttaaatgtgagaacatgcaagttgccctttggcacaaacaagcatcggcttcgcaaagtaaaaataccatccagctgtcctatgg

SEQ ID NO: 8633 - DNA, 969 bp, Oryza sativa
tcctgcagcccttctctttattttaacatgcaatccttctttacactatgtttaacaccacaataattaaacataaatatttctaacgcgtataattgaaccatagttaaatttacaatttcaaacgccacaattcaaatccaaaatcaaaattttcaaacatgtaaatatggtgtgggcagaatgccatatacaacaacatgcaaccaaaatttatagttcaccaatgaaaacgaaaattgctcaccaacatgtcattgtctgtctccatatcaccacaataggctatgtgaacctagtgatgcattattttttttgcggagatgcactatataatttaaaaataacacaccctactagaatgaatggttcgatcataaaaataacaaatctaaaagtagtacatatcctactagcaaatgacacttagataattgcagaaattaacacaaaaggactccaagaaccaatcgtggaaatgatatatcctactagcaaaggacacgtggatcatccaaaacgatccaacttattccatcgaagtgctcaaacttctccattaccgtcaccaaactcacctccaaagccactactaccatcaaatccaccattgagggcagccacctttgaagctgcaatttgtgtcctcatagccaacacatatgttctcacatctggttccaatgtggaaacatcacaaaacatgatcttctgttcttgatcccacactaaattatgctcagcaaataagagcttgcgctcttgaatctccttagtttccttccatctctcttctttcactttagcttctttctctttggcgtcaagcaaatctttcatcgcctccttttatggtccatcttctccattcttcatcttctcctttgcttgcttcctacccattggtctttttttagcacttggctgtaataaatcaggagttgtactcttcctagcatcatctccttc

SEQ ID NO: 8634 - DNA, 5614 bp, Oryza sativa
caagtgttagtttacatacatacaagattgttattaataataatgaataaacaatttaacttacaagctcttgatgtggtatgccacttggatgtcgacgctcaatttgctcgtagcagccctgaaacttgcttacttccttctgaatgttatcccaaagtgctcaagagagtttgcattcctatcagacttaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttccaatcattagaatttagaacaggttatgctagagctctacaaaattgaattaaaaagaaaaccatatagcaccccaaagcagcttattttttctcttttttaacagtctactcgaagaacctgcatataactaacatcggtataaataaaattgtgtagctcaggaaattaagcagcactacacccataccctctagaatatgatcacaagatttcagctggcacagtgtctcaaagtcatgcatattgaaaatcacactgaaaaccatatagcactatccaaaacttacaattcccaaaaccatattagctcgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctacttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctctaacacgctaggtgctaccatataactcaatccacaaatccactggaaaaatgaaaacatgataccttcaactagcgccagggagaagggcgtcaggatccaggaggatattgccgggtgggcaggtggccggccaggaaggagggcaccagggaggacgcctgcaggggaggagggtgccgccgtgccggccaggaggaggatgttgggaaggaggaggcctaccgaggaggagtgtgacgggcagggaggagggcgccacccgggatgagggcgtcggcaggggaggagggcgctggccaggaggagcggtgtagatccgtggaggcgccgctagcaggatatttcacgcgaaaaaagaagtgcccgcgcgtctctgccgcggatgggggctgcggagaaagcccctgggactgggggcctgaggggataatttggaggccttcctattttaggggctttagtaggggtcttgttggacctgattttttagtctcaactctcaaaattagtataggggctgtgtttagaactctactggagatgctctaataagcaaaaaggcttattagaaaataaaaatgaatttgcaggtgaaacttttataaatgtgttttttgacttaaaagccaatgttgaaaaagaaactacgttgaaaatatctcaaaattaagcttgaaaatttaaaatttagctttttctttggctgattaggccatccgatgggaacctaggtaggttccaaacgagcaccagctaatttaacagggcagcgaggcgagtcgatcagtcagtccacatcgatccatcgatggatcgtccctcgtccgtgttcgcatcaacgtacgtgtaccacttacacccgaatcgatctcgatccgcatgtgtgttgttctgttcagccagcgcaccctgcggccggccttggcgttttatctacagtagggttttatgtcttggaaacgtctatttctaagggtggtgggtgataggtacaaatggtagatcatttcggctagaaattttaaaaatggggtgaatagtaaattcggtccttgaacttttattcaggggttgaatcagtgttcgttgttatatgttatccaaatttcaaataagcccctaaacattgtcgtgcggctttgacccactgaaaatgccatgaggtcttgcagccaaagtcaacatttaaatatccattttatccttacatttttataaaaaaaggaaatagaaaaaaggaagaaagatatcataaaacaaaggaaaatgttaattctttagttactaatagttttttttttgctaatggttaattgccatactattttttgttattttctcaaccgttctttttgatttactatgaaaatgtaagagtagaatgtacatttaaatgttgactttgtatgcatagatgatatggcatgttcatgcggtttttttaagtaggtctaaggactatattaataccacaactaatcttggggatttctttggcaatatgaaccttcaagaactaaatttatcatgaagcgaaagttcaacgatcttattggttattcacccaaaaaaacattcttacgatcagaatagtgaatcaaaaagaaaatccaaatggtgtagcacgggccaatttgaattagtgcacaacaaaaattttggtagtatcaaagcttaagtaagttttgactctatacatatgtttaaggaaaaagtccaaaataacacccctccccgtgatcttttgaggtagttcgatttacatccctcaattttagtatagatattttctactaccaaactcttcaaactagacaaattaccctctctaacctacactaaggtggtattagtcctacatggcgtacatgtggcggtagtttggccacatattaatctagctagcatttgagaaaataaattttaaaaataatttcagccccacttatcatcctctatacatcttatctcttaccctctcatctttctctctcccatgccattgccacatgtcgttgccttacatgtcacatgttcgccttgtgttacttgtggaagagaatggaggggcctacattagctctcccctccaccaccatcaacgagcttactggcagccattctctgtgaatgatgagggaggctgtcacgccccgaactagtaccgaccggaactagcccgtgacgctctaaattaacctgtaaatcgataccagtcccaggaaacagtgctggtatcacaggaagacagattattacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccagcttgctcctggaagaactcctcatcagcaggatccgcttcatcttcttcagcaactggggggggaattatttatatagagcaagggtgagtacgggagtactcagcaagccaggggaaataagtgtttaatgcatgcttcaaggaaaggctgttgtttttgcaattgattttatttaaactctttttgaaaacaactaagtgagtgcttctcaaacgacacggataagacagtgcgtcttgtccggtcggagtatgtgcaatgtatcagtctttagaattgttcaagattggcacccggccaacaactttcaaacggccacccgggcctagctgatcccatcagccgcagattttccaaacatcgaacccctttccacaacagcaatttcacaagcagtagtcaaacaaaactacgctaggaatcacctcacatccgcccatgaccgtgggcacgactgttcgaacagtttgttaacctctgcagagggggtacactttacccacacgacattactaacctggatcacccagcccgtggggattagccacgtcgggagacctccaagctttcatgacaaggcatttccaaagccgacacaggtttaccatatgccgacgagaggggtcccagaccgacaacaggttaggtcccagaccatactgtgccaggaagcccaggggtcctccccgacaccaccccggcgaatccacatgtctctcgtcatcaaggctcccctgatacactagttactcagctaggggtgtcccattccacccatgtggtcgtacttgtcttatgttggatgaaattccaaggaaacgttccttaagtgcaagagcgggaaaccgtacacccggtacgttccccggtccgcggttttggaaattcatttagttcgcaagcaccgacccaggtgtcgggttttccaagtcttttgtaaaacccaagttttacccaagaagttactcagattttatgtttgaaggcggccgtcgatactcgtgcagagtgcacggtttccgaggcgcaactgggtggtcacaagggaacatgggataacaattaacaaaggaaggatcaaatgcaacaaactaggtaggtccgctaatctgccttgcagacgggacaaacagattaagtgcgatcctatcaatgcataatatttttcaagcaacacaattaaattcaaatataggctcaagatgttcaaaggtggcttgccttgctcgagatctggaggttgatcctcgaaatcctcgcactgcgggtcttcgggctccgaaactacacgcgaaacgggacaactcaacaaacggcgaaaataaaaccctattaatgacctctaagcgtgccattagatagatctcgagatttgaggaattttggaagttgaacggagtcaaacggatttacggttgggaagatattgaatttctaagattattggatttttggtctaaaggaaaacgatttaattaaatcctttttgaaaaagaaaagaaagagagaggagaagtagacttccctcgggcggctagggcgcggcccgagagaagaagcgcggctcggccgagctaatgggccggccggcccaagaggattcggcccagtagggcgcgcgggaggggaggagagagggagccggtggaccgggctcatctcgcgtggtcccgggtgggacccgcttgtcagcgctcggctcaccgtgaggagggagcacgtggcgcggcgctagggtgaggtgtggggcgcggtgcacgcgcgcggttcgcggaggacgcggatgcggcgggcccacgtgtagcctcacgggctgcagga

SEQ ID NO: 8635 - DNA, 7673 bp, Oryza sativa
agggggagatgggccgagagaaattcggcccatcgaacccgggggaggcaaaatagacttttgcggaggaattgatttggaaggatttggattcggaattgaactcgacgatagatcggggatttgagatctgagaagacacggacgctagacgacaagcaaagaaacaaatttcgcaattagggtttttaagagataattttcccgctaggcgccacgatggaacgggcgctacagaggcgggggatggagttatagagagggaggcaaagcggcgacaagggtggaggtggtagatctggcgatgtccactctcccactccaacacctctctcatcggccggagaagaaggaggatgcagggacctcgaggagatgatgatggaggtagagcacggtgagacccacatggaggtagatcttgccgcagggcagggacccaacgctcaggacaatgcaactgacaatagtgacatgacgtggatatgaaactcgaggcgatgctgctgcatcttctatccagcaagatagggaggaggaggtgagacgctggcaggcaaggtcacggaggaggtggagcttggtgctggagacaacggtgttgatctctaccaccgaggtcgagcctagggccaagcgagagatgttagtggtgggtggctatcaatgtagctgttgttcgattggagattaaggacgagggagagaaaagaggaagaggggataatatgtacactgataggcgagccctaccaattttattgttattacttcttccgtttcataatgtaagactttatagcgttgcccatatttatatatatatattaatgaatctagacatatatgtgtttctagattcattaatatctatatgaatgcaggaaatgctataatgtcttgcattatgaaacggagggagcattagctaacatgactatcacatatcagtcaaactactgccacgtggcaccaaagtcgctctggatttagttaagggataattcattgggaatgaaagaagagtatatgataacaaatgtatggtgtatggtgttagagtgagtgtgcatattggaggggtgggggtttgtttaaactgtactatgccaaaagtttaggtggtaaattagattttttttcctctctttttattttacagttgaggtgcttcaactgcattgatatggagaaaactttgcttcaatttaattactcactctgtcccattttaagtgcaaccatgagtttccatgtccaactttgatcgtctgttttatttgaattttttttataattagtatttttgttgttatgagatgataaaatatgaataatactttattcatgacttatgtttttaaatttttttaaataagacggacgattaaaattgggcacggaaaattaaggctacacttaaaatgggacggagggagtatctagctaggatgcagtaagcaattagtagggtaaaatctgaagcaaactgactccataatatcctaggtgacaggtaaaacaacaatacaattgatcaattaaggtgaacacatgtgaaagggcctgtagcctagtggttacaagagcctcagtagcacataaggtcctgggtttgactcctcatgagagcgaatttttcaggatttaacggcgttgtgctttcagtggtagacgacatacccgtcaacaacgaggcgcctgtggtgactgtcaatctcgaggatttgccagcccagtcttcgaagatacttatagggtagggtttgtgtgcgtgcgttgataagggtgagtgcacgtgcgttgtgagtgtctacgtcagcgaggtgtctgtggtgacttcgtcaatctcgaggatttgccgtgcgttgagtgtctacgttatactgtgtacagggccagctctacatattttagggccctaggccaactccatgacatgggcccttaggcatacactctctctctatatacacatatgcactttggatttttaaagtatacttttgaagcattcatccgctaatcatgctgaaaataaatattgataatatcctctatatatgttgctaaaaataccaaaagagcattaaaatggaattactatggttaccttgaattcttgacttaggatcaagctctagggacttcattaataatacttgacaaaagataaaatgacagatatccatttgcttctcataaaaaaatactccttcgggcatttcttgatgcaaaatcattaatgacggtatcgagatcaatattttccaagacattcttctcaatgcagcacatagccaagccatttaatctttcttgtgacatggttgatctcaaatagtttttcaataactttaattttgagaagcttctttcagttgaggctactgtcacaggcacagttaagaggattcgataggcaactaaaacatttggatagcaatctgcagctgtaatgaattcaagaatctcaggtgctgacttcaaagcatctggcaaagtcgcttgcaacacttttaattcagaaaagaagtcatttagctcaacatcggatgagttattatgtgaaaatgtctctacaaaattagtgcagcactgccatagatcagtatcatccaaggatttcaaattctttgaggtgaacaagaaaccaaacacattttcaaatgccttcaactgctcaaatcgactagtcaatgaggcaattgcaacatcaatcatgactaggaagtaattaactctaaaggactccacaactgattgttgttcttcattttggtcattttgttcatcaaaatgtttctttcttttagcttgacgttttgtaggaaattttggttctatatccatgtcagatgcaatgacttttgcaatatctatactagaagtgaagccttcatttctgtacctctggaaaaatgatatgacaccttcgatttgcttgagagtagcatccatgcacacaatctcagactgcaacttcttgctgaccatatttatagaaaataatatatcatgccaaataaccattccaactaaatattcaaaattctctagtgcagtgaccaaagattgagcatcactcacagcttttgggtcatcggtagaagctttctctagttccaacaaagctgaccttatttggggagtttggtatctaatagcttggacactttttattcgactctcccatcgtgtattacacactgatttgacagtcaagtgtggaacattctcaagaaaaatcttccatctttttgtcgagcatgaaaatagtgtatatattcgttgtataacaccaaagaacgaaatagctttattgcacgattttgccatatcacatagagttaaatttagactatgacatgcacatggcatgtataatgctcttggattaatttcaagcaaacgtttctgaactccttggtgtttccccttcatattagaaccattgtcataaccttgtcctctcacatcactgacattcaattcaagggagtccaatgccttcatcagttcattaaaaagccccaatcccgatgtatcatccaccttcaaaaactctagaaagaactcctcgactcttggaatattactcgataaattgacacaacgcacaattaaagtcatttgttcttcatggctgacatccggggtacaatctaatattacagagaaatacttagcatccttgataaccctcataatataaactttcacagcctgagcaagaagggaaattagctcgttctgaatattgtggccgagatagtgatggtgaacttcatgattttgaatgcgtctaatgtggtcttgcatcacagaatcaaactcagcaaccatttcaattgtgcccagaaaattgccattgttatcttgataaagtttctcattggatcctcgaaaggccaaattatgtttagcaagaaacttcactgcagcaactattcttatcaaaacttgtctccaacgctctttctcctttgaaattccccgttgcaaatcatcatcaattgtctgattttggcttaacctcaacctaagttcattccaagtattcatgttttttatatgctccacactgttctcatgctgtttgagtcttccactgagatgcttccagtccttcaatccatcagaagctaacaaacttttgctctgatttgatttgaacagtttacagcaaaaacaatatactttgtccacatgcttagagtaaaccaaccattttctatcaatcacctcaccattgctcagctttctagagtagtaagcatacgaaaaatgtctaccactactatctgaagggaacagtagattgaattctctgataggccccttttcaattaatatatctctccccctgttgtcaagattttcccaagtcctaggatcatagatattctcatgtacatcaacatttgcattctcagtacaaggtgaacgctgcaaattttcatgttctgaatcatcatgattagcgtcatcttcagtatttacaaaaagaacaagttgctgctcttgttcttcagtactaggataatctgcctcaggattttcatcaggaacagcactacttgatgccgaaaagaactttatgtatagcacccttctgtgattcaataaactgatctcctcgttttctttttttccttttcttagcaccagataaatgctttttaggtaacattgcaaactaaacgtacaaaggaaactgatctttagtatttactaattactaatgactgattaagtgattagtacttcactagttcaattcaatggacaatatggttacagcacagtagtatgcaagtacctgtaaattgaaacctgcagacactctggaagttgaggcagattcacgttgtgttgtgtcggcggtcgccggtcggccggtgtccaaggcgaacagtcgacagacaaaggcacaaagctgtgaagggctgaatgctgaagggatcgccggcggctcggcgtggggcgaacttgcgcaggcgccgtggagggcgctggaggcggattggcggagactgccgccggtagaggagaggagacgagaagacaaaagtttggaacttggacggtcgtgtatgcccaatgattcgatcagaaacttgtatacgtgcatatggtatacctaatacatacctaggtctgggcccctactttttctgggccctaggccatcgcacttcttgccgtggcccagagccggtcctgactatgtaattctaaaaaaaaaattaaggtgaacacacaccctcaaaattaacatgaaagggagtgcttggcagcctctacggacaccacacacgcatgcatgtgcaagttggttatctatcacatttggtgtgataagagtcaacttcatattagacgtacacattaaacatgcctatatgcctatatcagcagagaccatcgtaaaagctttatcaatcatagttaagcttaaaccgatatgcatatatccgaaaaaagaaaagccggcgatcgatcgagaaactagcagtgctaatcaccggaaaggtggtaaattaaagcagcaaagctagcctaataaagcgggacagatgcgcctgatgatgcgatgatttagcagtactagaattaagctagattgatctcttgctcctaataacaacagctcacatgggggatatgggagaggatgatagcgcagctcaacctctaccggcgccgtcccggccgtagagcgaaggaagaagaagaaggaggagaagaatcgtattgtgtgccaatcatgcgccgatggatgcgggggtttactacggtccccgacgagtaccttggtcagccagctctttttctctcttgtatcccccatccatcggcagcatcatgcagtcaggcagggaagtatccaaaagtgaacatttggagtaggccaagcacacacccacctacctacctagctaccaacctgcctgcctacttcagcactatagctaccttagctagcgatagaaagatcacactgatcatctccaggaatgcatgtactcctcctgtcatactgtcctaggttttaaaatatggagtaagtgttttttatttaaaaattatactacactaaaaacctatttttaacatgccatattttacttcatcgaaagcccgaaagaattattacccgcgtgtaaaaataagttgggggggggggggggcttgcgaggcacaacgatgatggcggcggctttggttttttagtgtttattaaacgattattaacacgcaagcagatctttacgtggaccgattgtgacaatgtgtttgcacatacggctgcggttatgcatgtggaaatgcaatactattgtgggcatttgattagagatggtcgaccgaaccatctgtgcaaacccattttgaccgtttacaaaaatacattttgtcatagtgctataatataattatttatttgcttattttctcatctcattcgatcacaaccatacaaatctcttattcaattattttcatctactttttttatctcaatcaatcacaaccatatatcttaattactgctaaaacttctagagatgctcgtaattttgaactaggggagctgaggatagatttgggatgttttagtgagttaaacgtgttcacattttagactattgatggagaactaatgaaaccactttgtttttagccaacaaactccatattctgcgatagtctatgacttggagctttgtcgaatggatcctacacgtctatcattcatgggatcgaaagcgaatggaaggccaaataaaacaagaacatgctgtgattaattagaaacctgtgactccatagtgcggtgtagggaaaaaaaaagggaagttactagggcataagtttcttcctcatctgtaaggctgtaaccggttccaattccaaatcatttgtcaatacgtggacactcacatgcaccatgcatgtcctttctagctaggataaacaccattatcatccgagctaattgtcactttattttttgtcagatgaaatatagtcgaaaatcaaagttagagcttgtgatgctatagtgaagcattagtcattatttttcatctaaaggcgaagagagatcatgacaggtgactttactggtaacagaaatctattttcattgacaactccattgctggtatggtcgtactggcccaaacgattgctacagcttattgggttgctaatataatatcaacatgctacttttcttgtcatttgcctactgattagaggtgtgagctagacaaagttttatcataagaaaatccagaaaatatcatcggcaaatgccctaatataagaaatgtcattgatagacccaacttcagtgaaataccatcatacaagtgcctttgtcccagaaatatactatcgccgttaggtttccgttaagtcctataaaaagactattttacccctagtaactgttaagagctgattaaaacttttgctctttctaccagcttacgctaatttgtaggttgctttccatactaaattattgtaagttgacagaaagaacaaacattttaatcaactttcaacaattcgtaggggtgaaatggtctttttatagtagttaacggagggttgctaaccaaaacctaacaatgatagcatttctggaaaaaaaaagt

SEQ ID NO: 8636 - DNA, 1723 bp, Oryza sativa
attaaagttctcctctcctttttcttttacaagtttatagattagtttttttattactacctttattccttcttctttctgtccgacaatatcgatatttatcctgattaagtcgatattgaagagagtcgatgatgaattattgtcgtggaattattaatttatatcaccttttctctgagttatctcccggcgattgtcggtcggggaatattgtttgtgtttactgatcacaccacacgtgaatcttgtccatttgtaggacgggaaagctgcaggttttggagaaaagattagtcagagtaaaacaaatttgtctgtctgttattgacttgttgggcgaagaatcgactccgcgaatcaagcctgattcacaacctctatataattaatttatcgatatatgcatatatcctattgttaaacagaggatgaaagaggagattccatgttcactatgttaagtgctaaaaattaaaggatctatatgcatgtttatgttcatgctacatctacattataacatgtagattaataagtatatatatatatatatatatatatatatatatatatatatatatatatatatatatatatatatatatatatatacatatatatggacagagagaaaagtttattcgtctcttaagggaatgccctctcattttgcatgtcgttgaaaaagttttaaaaattctaagaaaataaacttgtaaatcggatacgaacttgtgtgtttgtggagtaaaacatcatatattgttcatcatgtcaaaaaaaattttgatgatttttggagtgatatgtatgaaatgagggggatatcaccttgagcgacaaatatccatcttcgtttgttaaggttgttttatttgcttaagagatagtactacaattgtatttctagctagtttttcagttcttcgatcagttttctttcatcaaattgcaatcgttacttaattgatcctgaaaactaccaaaattgcaaatagctagaacgtatggggaatgcgtcacatgaacacagtatcacaattaatacgctagggatgtctccttcacagcccatacatagctgatcacagctaattaagcacacattatttggaataaatccaaattgcatgccggcttgcttgctggcttgcttaatcatcatatataccaataccttttcagatcgagacagttgctgctcgtacgccttctctcgtgaaaatccccttgttaagaaagacgtacgtactagcttgcacggcatgaatttaatcatggacatgatcaattgatcagaacaacaaacagtgagttagtttggtgtgttcatgtatgtatcaatgcatgtggctctcgtacgtaggtgatgtgtatatatgtatatgtttttagtattcaacaattcatggtacatacatacatacgcaagtagtatgagatttggctgtttgtttgggcatgcgtccaaagatagtataagtataggcgacattgacatgagtctctgcaagctaataataattaattaataatcttctgtctgctaactcatgcatgcatgtagtgttgtcccggtcccacgaggtttgtgatcaccaaccaatccatctgtagtgctaccaaacaccacatataccggtaacaaacactgaccagcacgttgcactggtgtactgatggcagcagcatcttctagtacatacaagtactaattact

SEQ ID NO: 8637 - DNA, 4500 bp, Oryza sativa
agtggttgggttaattacaagaaaaatccaatatctgggggttgataaaataatgttgttaagttggatcaaacaactcaaaaccccagcccataggttacatgcaaattagttagttaactacaacaatttgctgaattattaacctcttaatttattcactaattgtccatgcatgcaacaaccaagccactatataggtcagtggaagagagaaggttatagcaaagcagcagcaactcaagtactcccaggtcaacaaggccaaaagggccagtgagtggctagcttaattagctaagctcatagtcatagcaatggctggagccgtgctggtgaggagaatggtggtggtggttgccattgccgccttggtggcgcccggcgaggtggcggcgcagctgacgccgacgtactacgacggcagctgcccgagcctgcagtccatcgtgaggtcggccatggcggccgccgtgcagcaagagccccgcatgggcgcctccatcctccgcctcttcttccacgactgcttcgtcaatgtaagtacaccatagctagctagctagcttgagagtggccagccatggcggctctgagaatgacggcggatggggatcgagctgatggtcgctcgccggcgttcatggcgattatatatgattgcaggggtgcgacgcgtcggtgctgctggacgactcgtcgacgatcaccggcgagaagaacgccgggccgaacgccaactcgctgcgcggattcgaggtcatcgactccatcaagtcgcaggtcgaggccgcctgccccggcaccgtctcctgcgccgacatcctcgccgtcgccgcccgcgacggcgtcaacctggtaattaatcaatttaccaaccaatttaattaataattacttttacactgcatgcatgtcaatttttttttttaccgtgcggccgctcgccgacaggccgtacagccaactcaagctgcaaatgcaacgcactgcatcatgcccgtgtcaaaaagccacctacatttttaatgacgcacgcatgctcgcgccgcgcgacaaattacaatctagagccatccgcacatgccgtaccccctcagtctcaaaatattgtttacatgtaattcaaataaaaaaatttaactctaaatattttcgttacgaaatgcaaaagttaaatttggatttacatatttgtgggaatgatatatcatatattaatacatctgcttaattttttttaatttttttagaattatttgggtgacgtgcaaataaggaaggacataccctcaagagtttagaataatttcctgtccaatatctcactgccatgtgggccatcccctcccacgtccatgtacagttgatttgcgttgattttacttgcggctgcatgcatgacgaaaaatgattgacgctgatggatggatcgaccgatcgccttagcctgtcaatcttgtcgtgcatggggtgtcaagacctgcctaatcaccacaccaaattgtaactaaactaattttacagcggtaatcaactcgagagaagtaaaactaatttggtgcgtaaatttgatttgctgcagttgggtgggccgacgtgggcggtgcagctggggcggcgcgacacgcggacggcgagccagtcggcggcgaacagcaacctgccgtcgccgtcgtcgagcgcggcggcgctggtgtcggcgttcgcgtccaaggggctcgactcccgcgacatggtggcgctgtcgggcgcccacaccatcggcgccgcccggtgcgccaccttccgcgcccgcgtctacaacgacaccaacatcagccccgggttcgccgtccgccggcggcaggtgtgcccggcgagcggcggcgacggcaacctggcgccgctcgacgcgctcagctccgtccgcttcgacaacggctacttccgcaacctcatgggccgcttcggcctcctccactctgaccaggagctcttcaatggcgggcccgtcgactccatcgcgcagcagtacgccgccaatggcgccgccttctcccgcgacttcgtcaccgccgtcgtcaagatgggcaacatcagcccgctcaccggctccagcggcgaggtccgctccaactgccggaagcccaactaagctccggcgatctttgagattcgtgcccggtcgatcgatcgatcgatctttgagattcgtgcggagatcgatcgatcggacggtctggatggatggctagtcaactgccagctaggactaggggatggaggaggtggggcccagggatcagtgagacgtgtggctttttttggcgtgggaaggaagcgatcgagaatccaagggaccgaaataattaggtggagtggcgctgtcaaaaggggaggatcaagagggaggtggggcccacgctgcagtgacacaaagggctgcatgcattgcctttttttttttgttattttggtttggggttaattatcgcattcttttcctgtatcataatattggtggtgatcgatcgatcgatgcatttggtaataatttgagctgtaattttttttttttgtatatgtactaccccatgatgatgattgagaagatgactgattagtttgcaaggcatgcagatatgaataatggagacactagttcatgcatgcatcgtgcatgtggtgtgttttcctcaggatgcagacaagtcgtatataatgatcatccatgcatgcgcttatatatgggacaaatatgttactgtaactaggggaaaatgctattaccttcctaatatcgggacgaagaggtaatattgaataattatactcaatctaaaacgaacgcatgtgcataattattagaccaattaaccgtttatcatatacacgtatactcaaatacaaagatccattattcttttagtgtatcatataaactagctaggtgcctgggtggcccgcgcaactgcgtggttagcacccatacaaaattatatagtttttaatatggttttacttaaagtttattaaataggtatcttgttgtcttaagattttgaaagaccaacccttatcatccccgtttttctaattttatagtttttatactcctatacggctcatccactgtctcttctatttcgtgtcattgggattttaaaaattggatataattattgtttgggtttttttatactttctaaaagtcccgtcaaaccatcagtggctttgccactatactcctctacggcttgcccggtgtctcccttctttattatcattgagaatttaaaatcaaacatgattatcattgggattttttttatttttagatgtctcgaacctttaaaaattggaccttgtaatttttagagtttattgtgtcgtggggtttcatttttctataaaatttcgaagtcacttcaaacgctgccactatactcctctacggcttatccgtcgtctactctttattatcattgggattctaaaagtcgaacataactatcgttggaattcattttttactttctatatgtcccgccaaccgtcggcggctctgccactatacccctgtacaacacgcccgctttttattgtcattgaaattttaaaaacgaatatgattatcatgagtgttttttttactttttagaagtcccgccaaccgccttgactggttgcttcacgtcttgcctgtcgttcctccttttaattgtaattaggattctatttagtgttttatcaatagtttttagatgtcccaccactactttactcctttataggcctattacttacttcctcccgtttacaatgtaagtcattctagcatttcctacatccatattgatgttaatgaatctagacatatatatatatatatatatatatatatatatatatatatatatatatatatatatatatatatatatatctatttagacccattaatatccatatgaatgtggaaaatgttagaatgactttcattatgaaatggagggagtaattattctcgtcatgtgttttagatggtcctttctttcaatggtctttattatcttatcaccaattttagttatttataaattgtattcctagttgaaatcttatttttcttttctaatttcagaatttattttattttttattttgaattttaattaatattgcattgtgttcttttaatatttttattttttattttttattttcagtttcacttgtttcaaaattgtattcctacttgaactttttttattttctttttctaattttaatttttaattaatctcgtattgggtttttatatagacttttatttcaatatttcttaattttaattctgaatttcagtatttttaattgtatttctacttgaactcttcttttttttttggctaatttcatattttattttattttttattttgaatattaattaatctcatattaaattcttatatgatctcttctttcaatagtgcttatttttattccgaattt

SEQ ID NO: 8638 - DNA, 4248 bp, Oryza sativa
  unsure (1)..(4248): unsure at all n locations
tgccgcctggggaagagcgtgttgccggttttcctcacccaatcgagaaacccctatgcataaaaggacaacgtggcagccatcccgaggagaaaaaaaattcaattctaagaaaatcggtaggagtagagcttttattaattgatgataggtagaagaaaagagggttgaaatataatattatgagggccctttaaaaccaccgtacattggagaggtgccaaatgggcaccttaacagtgacttcaatccatgcatatatatagatggcaaaccttctctcgtttgagatagataaagatcaagactaaacttagaaaaaataaagcacacaaaacggaaaagtaatagtgtattattaaatgagttctaattattataattttagaaaatgggtttatttattattctaaataatttttatatagaaagtttttaaacgaaacacaccgtttaccagtttgaaaagtgtgctaacgaaaattatgataaaatatatatattaatttaataaaaaataatgaacggggctagattgcaagctgtccaatactgtggctgcacgtgtttttgaccgatatttgcaaattaaatccagtgatcgacgtcttagggtgtgtttagatccctcggcaaaatttttcactctgtcacatcgaatatttggacgcgtgtatagagtattaaattaaacgaataaaataataattacacagattgcgtataaattgcgatacgaatcttttaagtctaattgcgtcatgatttgacaatgtggtgctatagtaaacatttgctagtgacggattaactaggcttaataaattcgtctcgcggttcacaggtggaatatgtaatttgttttgtaattagtctatgtttaatacttcaaatgtatttctgttgtccgatgtgacacgccaaaactttacacctatagatctatgcccctgtttagatccaaccctaaaatttttcaccctgtcacatcaaacgtttgaacatcttcatgaaatattaaatataggctaaaaaataactaatttcacagtttgcgattattttgcgagacgaatcttttaagcctaattgctccatgatttgataatgtggtgctacagtaaatatttgctaatacggactaattaggttcaataaattcgtctcgcggttttctcacagattatgtaattagtttttttattagtgcccgaaaccccatataacaccctatatagtactcgatgtgataatttttgcatttttaggtatcaaaataaacaaaacccatcctagtggatttgccaaaaccttatccctgaatgtaaacaccctcttattatgaaaatcaaaatgaaccagcactagctactactctagctaggtagtgcaggttctagggtctggacacgtactggcagtacagcatgcacggctgcacccaatgtcccagctgcaggctgcagccgtacagggcttcccagccgacacgatccgggaaatggtaaactttgtttcaaaactaaccctatcaattaagtaatgactttatcaaaatttgacgaggtaatctaaaacatggccaaaatttacctccattatcaagttttgataattctaaaagttcctctcacaaaatcttaataatggtaacaaactaaacataacttccacttctcaactttaccaaatacaatatcaatatttgataacattgatttagacattaaagtgaacagccccttaattatctttcgtcctctttccggaagaataatactccatctacataactctgccagtctgccttgcaaaactaaagcacttggaacagattcctctctgcaaacagcggaacagagcacccaaacagcagaaagggagtacagacacgcaccaaaccaatgaagcagccgcttctcctgcgatcgacacgaagagagatcggtacagctcatgcgcataattccctcgcccaggacagcattaggttgcgaagcagcagtacgcgaacacacacatgcagtagcacccgcaccgtaggctgcagcgatcgaatagcagtgcagttccatgaattccaaggttggtggcgaactcccgatcgccggaacgctggccggacaggcgtttggtggatccattccatcgcattttgcatatcttcgcgtaatcttagctgtagccctgtacttggagtatgtatgttttctggtcatacctgatcattatttgctaataaatattattagccataccttacaaagactaagaaaatcttgtcatatttttttaaattcattaatatgtgagatctaatttattggaaagataatcttgtgataactataagtacaactaaacagccaacaaggtgatcaaacttatcaaactatggtaaaatatggttaacaaacaaacactcacaaaggtcgttctgaagtgtggcaaactctgccacacttttcatattgttgtcggcatcacggactcatgtacgtatattgtacagaatgcatgaatgtaatggaataagtctatttggcctccctcatgtcttgttgttggtcaaatcgtatccctcaaccgtaaaacagggtacaaattaatttctttggtagttttaaaagtggtttttgctgacgtaacacgttgacttggtccaagtatgtgtgggtgtgtgcgcgcactcgacaatgacatccaggtgaccagtttatcgctgccgtgggacatgtcgtcattggtgcatcctggtgagagagaggggagagagagtggggagggaggcgaggtgaggaagataagatttggatgatacgtggatcccacccgctgacttagctagtcaattgcggtcaatatatcacgtcagctaaaatcaccttctaaaacacctaaggagatgatttgcaccgatgtttaaacacggggaggtgttatacccggttttgtgttagacggaggcgattcagtcatgaccaagactgaggagaaattatagacttaatctgaatgttattgactgctatctccgtccagcccatcgaagaccctgttagttccaattgttatatgggccaaaatgggcccaagaaaatcctcctcctttttcagcgtaaccataaccctccgcgaaagcagccagctaacccaatgtgacgcgcgtagcgcaactgtagagcgtgtgcgcaaccatctcgcacgcacttgactgacagccactctccgccgaaccccaccaccatgccgctgccaccccatggtgggctccctcccgcacccatcatcgccaccgccaccgccacgcgcgccgaattcgccgcccacttccaccacaccaccatgcgatgcaacaaccggtgggcgcgccgcgcgcagctctcgcggttaaattctcccaacacctgcgcacggcgcacaacccaacgccggcccgccaagactacggacgaacgttcgtccatccaccacggccctcggagggcacacgacgctgacgctggatccgacggagtcgggtgatatagattgattggttactgtttcacaagttcacaacttgtttcgatgcttaaaagttcgtaaagcgaaataattgcacctaatagataaactaattagcaacatgtggttngggcaaaaaacattagtacaaaggatagggaatcttttgccaaaaaaccaaacaatattgtcaaaatttttgccaggaacaggagccccttggcagcaaccggaacacaccggcttttgagcctctatcaacggtatcgattaatcacccttatcgtctttggttccttctgcttgcttctcttgctggttcgtcggtcggtggagtttgagcctgcgccatggctgtcggcgggagagggagacggccgctgctcctgctcctgctcctcctcgccgtggcgctggcgctggcggcgcgcgcgcgggcgcagctgtcgccggggttctactcggcgagctgccccaccgtgcacggcgtcgtgcggcaggtcatgtcgcaggccgtcatgaacgacacgcgcgccggcgccgccgtcctccgcctcttctaccacgactgcttcgtcggcgtaaggaccgcgccgctcgccgccgtccggacgaacacatgctgcctcttctccgcgcactgctaagctttgattttgtgttgtggggttggggttcacagggctgcgacgcgtcggtgctcctcgacgacacccccgcggcgcccggcgagaagggcgt

SEQ ID NO: 8639 - DNA, 1457 bp, Oryza sativa
gctcgcgcgacctcgccgcgctgtccggcgcgcacaccgtcggccgcgccagctgcgtcaacttccgcacccgcgtctactgcgacgccaacgtgagcccggcgttcgcgtcgcaccagcggcagtcctgcccggcgtccggcggcgacgccgcgctggcgccgctggactccctgacccccgacgcgttcgacaacggctactaccgcacctcgtcgccggcgccgggctgctgcactccgaccaggagctgttcaacaacgggccggtggactcggtggtgcagctgtacagctccaacgccgccgccttctcgtcggacttcgccgcgtccatgatcaggctcgggaacatcggcccgttgaccgggtcaaccggcgaggtcaggctcaactgcaggaaagtgaattcctgatcgatactactagatagcattgccgcgcgcaaattgttcatagtacaaagtttaaagttatataatcagctgtcaatttcatgtattaagtgaattatgacataagaatgcaatagaaatgtcccaattttagacatcaatcactagtggataattcttccgtttgttcaattaattaaaccttgcttaattcagctaccatgtaactattgcgacggctatgatttttgcaatgaacacaagaactttacccgattgttactagtagtgatgttactgtgatagtactactgctgatcactatcacagtagtatcagtagacttgacaaatgcgtagcaacaaatcactggaaaaaaattcacatgatgtgttttgtgtagtcctgaatagtgagcggtgtggtcgtgactcgtgagtgatcagtttctgctcgtgatggaagaatattggcctactatatgtcgttttgggaagatacagaaaggaattcgatggatacaatagcaagagcgaccaaaaaatccggcaaaaatgcatacgtcgactccgtccggaacgatgtggttttgtggatggatctgaagatgttacgaaagggactaatcaaccaaccaacttggtgagcttgtctgtgtagcttacctgggcttgattggagaaagaaaaattttcgaaatcatgaggaggcatgacctgtttctcataaagtggtttctctaatgcatctgaattttgaacatgttcttttccattttaatagttgaagaacattctctgcgctcaacttatcggtggtgcgcatgtatccttctttacaatattttcagttgcagcttatgatattattttataaaacagaagatgacctcaatgataaaaaaaaaagctagttgttatccatatatatgcgttgaagagctccatgataccacttgctctaaagagtggctcctaccaacggataaaatcgaaagcccctctgctaattgctaaagcaatgaccaaaattgcagacaattggagcacatgaagttgggggt

SEQ ID NO: 8640 - DNA, 707 bp, Oryza sativa
caagggacggaggcagagcccctcctccctctgccgagacgcccccgctcccctcctcctttttccaaagaagcaagggacaagccccctttctctccccccttttctccctttttccctctcgccggcgtcacctcctgtcgccgttttggccgctagccggagcgccagctcgccggcttgaccgtccaatgtcggttcctctctcccaaaccgaccttgtcgcccatttaaacccaagctcctccccctccaatctccctcgttttcgtctctcgccaccaatgtcgcccctgttcgctgtcgccgttcgtcgttgcgcgtgtcggaggagccggcacgagcaaggacgcgaaaggggacttcggccgcgccctcttcctcctcttcctcggcccgaggccgaaacgatcatgtttcgcgccgtcggctctcgtcactgcgcccgcccgcacggtagtgcatctccccgttctccctcctcgttccatctcctccccttagactcgggtagtagcacgagtagcctccccgtagctagccggcgccgccccgaccgttgccgtcgctcgccgtgtgctcgccgccgtcgccgcccgagctcgggaacgcctctcgtcgccggcctccctcgaagcgtttcctcctaatccggcgcaagggacggattcccgtagccgcatagatgctctcgcggcgggaatcgg

SEQ ID NO: 8641 - DNA, 719 bp, Oryza sativa
tactgatgcttattagtagtgacagcgatgtagccagccgtgaagaagatagcatcagttggcgttataacaggccagccctgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcaaaggcaagccagtcggtgaagacgtagacgcccaacaacggcggcataaaggccagccgtgcaggcggaaacacc

SEQ ID NO: 8642 - DNA, 25093 bp, Oryza sativa
aaaccgaacttgggccttggaccttgtaataaactaagcccatctcggaagtgttttcccttcaccttcacgccttaacacttaaccctagatttattttcctctataaatgtctatatacaccctctagaacaattgggttttgtttaattgaattttgctaagtaccattcaccttgtctctagtcctcgctcgattagccgacgactatagattcaaagcccccaatagttggtgtgttgatttgccaggttgattagatctaccacttcaatcgcaactattactttatgcttcatcacctattcgcaatatttatattgcatttatcttgttcttacagtgttctctcgtttgcattgcagggatcatcaaccgcgcatcacggttggtacaatatcatttgtggtgtagcgattgcacggtgtcctggacttgttctggttagtagcaacgtctcaaacgtcacactcgatcaaagcgagagttattctcctcaccagaagatcgggccacgagtcagagcgtcatcactgcgaaaattgttttttatagtagtttgttaaaagttgatttattttgggatgtaaagagtataacattgttaacttttaaaatttatcttattaaagaaaaatatataaatattatttgtttttttcagatgaaagttttttttaattattttgatgtaacttgctttattattaatggtactataagtctaatttaactatgccatgcacatttgcactaaatcttagagaagatgtacgaatattttaatgttatgtttaaaagtcaaaattgttgtatatgcattcaaaaacagatggagcttgtctatctgtcaagcttatccgtttagtttgttgccggtatatatggggaaatgctgccgatcggtcgaccggcgcccggtgtccaggatcggtcgctcccccccccccttcccacgtgtccatgtccacctgcttgtcaccaccacatactccattgcaacaaatcacttatatattctggaaaccctctattaaaaaattcgttttattttttttccaaaaaaagttttacctagtgtagtcataatgttttactatgtgtatagatctaatgttgtagtgaattgaaacattcttttgcaacaaatcacccacgtattccaatattaaaaaaattcgtttaattttttgttccaccaaaaatatttcacttagtgtactcacaatgtttcactatgtatggatctaatattgtagtgaattgaaacattctttcgctatttgctgaaacattattttcatataaggtgaaacagtgtccgatttaaacgattgaaacattttcaatctacttagtgaaacaattctgatatacttagtggaacaacgtataatatttaaaaataatttaataataagctaaatttttttcatcagaatatatacatgtgtgatcttgttttaaaaatttaattgcaacgaatttaataatacaatcatatcataatttggataaataatttaagagaaaaaatagtttacgttagcggccgatttttccacggctgatcgagcgcccatcggtagtatcgtccgtatatatgtcgccacaacgtaacaacaatgttaatgtctggatagttagctatacgtgcacgtgtactaaatatacagtattactttacttgcctcaattagtggcatttatatacatacaccagtatatacgtatgcatcaaatgaatgcgtatatatcgaactaatctacgtaccaattttaaatcgtcctagctatattctttttttttttgggaaacctcaccgggggccaggtgcagctatattcgtatattaaatatgtggatgtgactgtgcgtggcctacatgagcgaattttgttccttgccaccgcgtatattccaacgcgatgtgccgttgaatttgcgaattcatatgtgatattctttttccgcaaacacggaaaaaaagaattatacgttaatatattaaaaaaatcatattttctgttacacaacacaaatgacaagagaaccattgccggaggacaaagaaagaaaaaaccagcaaataaaccgaaatgcaaaatataggacttctaaggtaaaaaaaatgttgctcctatatagagggagggtgatggcgtaagaacctccctacactttcaataggcccccaaaagcaacagtgccagtagaagaaaagctgaaaagctttgtaatagatacaatcgcaaacacaaagtgaccctacgttaggcgcaacatgtaaggatgaaaactgaaagagaaacaaatattattttttagaagatgattattggttggtcaaaaatttacatacttatctatttatttatttaatgttgactgtaatacaatgttaaaagaaattagaaagctcaaaatttatatttagataaataaaaacgatgataggtcgattaggaatttcgctgttttcacgtttgtaggaggccttgacctgagcaagttgagcttgagcccttcacagcaaagaggaggagcagcgcattcctggtgggcctactcatgggcctactggccaacctcctatggaccacaaactgaaaagaccggcccatcatctccgctacggatcgtcccaaactcatcccgcccgtaaactcaagcccctcccttttaaagggaataagttcactttaggtccctctatttgtcggtcagtctgattttcgtccctcgaccgcaaaactgggtatgacccgtcccccaacttacgaaaaccgggcaaacgaggtccctcggcagtatgaagggcgcttttggccgacgtggcgcctaagtgcctcctttgactaggtcttcgtcccacgtggcattgacgtggcgattacgtggcattgacgtggcactttcgtggcaattttatccgaaaaaataataaaaatagtgggacccatatgtcagctaaaaaataattaaaaaaaggtggggcccatgtggtcctacctgtcagcctccctcctctctatccccctctttgtcccttatactacacgaaggcgagcggcggcggcgcagagggggtgacggcggcgggcggtggacggagcgacggcgggcggagcagaggggtggcgggagcggcggcgagcgatgggcggagcggtgacaggcggagcggtggcaggcgtgctcaccggccgaggtcgccgcccgcctcgctccctcgttctcgacatgaactcgagggggatcaacgtcgaggcacgaagagggcgagcaaggtccgtgggtagtggtcggcgaggacgggcgggtaggatggtgagctcgagctcgccggctcccctctcctctccctctccactctcagatcttcctcttcttcctctcagctctccctcgtcctcgcggcggagcggcggcggcggcaggccgcgggcagagtggaagggcggacgcgaccacgccaaggacgctgtgcgcaccttcgacgcgagaggagcggcggtgcgcaccggccggcgggagagagggagagaagcggcggtgtgtttggatcggcgccggcgggagggcgagaaaggaacggcggcgcgcggctgccggcgggagagggtcggcggcgcaagccggctaacgtgtgagagggagagaagcggcggcacgcgcagcgccggcggagaaggcagccaacgggagggtggaagaggagcggcggctcgccggcctctccagtctccacccttgttgctctgtccaccgcccttgtaggggagagagagaaggggatagagaggagggaggctgacaggtgggaccacatgggccccacctttttttaattatttttttgtgtagctgacatatgggtcccactatttttattattttttcggataaaattgccacgtaatcaccacattaatgccacgtgggacgaagacctagtcaaaggagccacgtaggcgctacgtcggctaaaaccgccctacatactgccgagggacctcgtttgccctgttttcgtaagttggggatgggtcatacccggttttgcggtcaagggacgaaaatcagactaaccgacaaatagagggacctaaagtaaacttattcccttttaaagaggacgccgctgcagcgacactgttctagggctctcccctttctctcctgctcatcgcatccgcggcggccggctgcggcgacggcggcttggatgggtcgccttcctcccttgctgctcggatgaaccctcgccgcatgcatcgcgatcttgatattcttggcatggaattaatagcgtctcttttttatcccccttacggttcttgatctccagcgcttctctgaattctctggttcttcttgctcgctcaatttacttgttttgttttctcgattgattggttgcctgatcagctgtgctgtggatgcatgcgatgttgcaaaaccgagcgcgctgttgattaatcttatctccctcgggcacggttgatcatgtgcttggagggggctcgatggagctcggatatgaacccttccatggagtttgtcaggcttcctgcgtcctcccttgtacgcttggagtttagaatactctccaacatttcttcctccctttatttctatgttttttattctcctttcaaatgtattattatattgtgtgtttgaggaagtaagaacactgcctcgatcagggaggagcagatcttcaggttaacagattactgaatgagttaggtttgtgaacatatttggtttcagctaaattttatccaaaaccatgcaagttcaatcgaatattagtacctcgcaatgttctttgtccacgatgtcgttatcttgatcaacaaatctgataacattgcaagaaaatagctttacactttttgcagaagaactgaacgatggatgcacgtccgtggactgaaatagacattcagtttcagtatgctgaatgtaagatggcatgtttagtcagtttccactgtcaaattaaccgatcgatcgagcagacttgattcgattttaagcgattccgtttcgagctggacaacccatcgctctcgcttttggcgatctgcacttttgcagttcttgcacagcttcgctttgcctttggtgatctgcagctctgcacgtttatttatttcttacagattattgctagtcaagcagcagcatatttcagcaccgaattttaagcgaggcaccattctttttctttcctgcgttgattcccgccaccttctcgttgcacacaaattgtacatgtgacatgtccatcagtccatgtctccaactctgattgcaactcatatatgtggcccaaagagaccatgaacatgcttaataatctaggaaagcatttggcactgcatatggcacgttctaaacagctaatggaaggtatggattattcatggcctgttttcaggagtactttctcaaaaaactttttatgtcagtattgcttagtttttttgggggggtaagctgtcggcagctttatatatttattctacatatatgccatttaacagaacaaatactttggaatcttacaaattttagatcggccgatagctttaagattcgtgccaacaccaaacccattcttcctctctccctagtctggtgcccccagtagaccagccgcgagtcacaattgatccttgcctccttcgtcgccactgcgtcattgcctggcctcaacagttggccaaacagcgccaacgagccccctgctggcttcctcccccttcccccccacacccttcccccttcactttcccaagctggtgctagcaagtgccccgctcgccaacttctccgtctttggtagccccccgctattggatctaccaccaccgaccggtacatcctaaccacaagccttgactttgccctcgttgccagcacccgcccaccaccttcctccatctccatagctctggcaccaccaccgcctcaccgcccgcccatgttcaccacctatcatggggccacctatatctctaagcctgacgatctcccctctattccagctctcctcacccccaccacaacttagcactctaaactgtaaatcgtcggaccgcccttagttgctagagctggaggaggagaaaaagctaggattatcgaatcacgaaacaaagcttaaggtcagaaatttacaagattttggacttaatattttgttgaatgtgatttatcaattccaatatttattaattcattcatcgttttctttgtctgtaattgtcggagatatgggcccgggggtatgtgaggtagaggagaattactcttcctccggccacgtggcttggccagatagccccactcacacgccacacgtatcatagaagcagcgggagggggggggctcggggtacgacgtcaccccctcggggtatcacatcgccccctcggggtatggcatcgcccccttgagccctaccgcaccttcgccccgaggccctcgccacccccttaaaactataaaaggaggaccctgcccacagtgcaagggtgtggaaccagagaaaacccaaacttcggaagagaggaggcaagagtgctctccaaagaaaaggaacccttgtaacttcatccataatcccaaacacaggagtagggtgttacgctctattgcggcccgaacctgtataatctgtttgtgtactagctcactgagagtcttagggacgacaaacgaattctgagggacgagcctccgcccccggccgaactcacgaaaggggggtctcacgactccctgttattgagggttctccctcgacaggtggagcgccaggtagggggcggttgtgcgtcccgggagaaagttgttttcttccgtcctaaggttttccaggacttggccgactatggtcgaggtcctggaaatggaggaggaggtggtggcattcacccccaccccatcggggagtgaggattccggcgagagccgaggtcctcgtcaccgtcgccatggatctccaactcctccccgccgcgaaccttcgcggagggagaatgccgctcgttcgggtggttcggcaccctctcctctccaaggcggagtgaggccgcgacgcgccggggtacgccgctgtctcgattatggagacggcgattcgccccaaggcgcgcttcaagcagtaggcgcccttctacgacatcccccggtgaacccggagctggagactcctgttcagcgttggctggacgatgtgaccaacttggtcactgctgctcaacggcagttggccataggtggtcgatccgctgccgccggtacatcacgtacctcagtcaccctctcctcgtcggcgaggagaagggctcatcgatcggccacgatctcgaggcggtctatggtcccaacatcatcaggggcctctggaagccggaggcgtcacaaaggcctctacggtacacaggacgctcgaatcaacatcgagcgacgccgggatgagcgccgagctgcccgtatgggcgaaggcgcctcctcgtctggagcgccacattcttcctcacgaggcggtcctcctcccacactcacccctggggggacaggttgtagggccttcgtggcgagtctctggaatgttcggtggcccctgaagtttcgccctaaccttacggagaagtatgatggtaacatcaatccctccgagttcctccagatctataccacggtcatcgtggctgcagggggtgacgaccgggtcatggcgaattactttcccatggccctcaagggtcaggcgtgtggctggttaatgacccagccccccgactccattcactcctgggaggacttgtcccagcagttcatcacaaacttccaaggcacatatcctcgcccaggggaagaggcggacctgcatgctgtgcggcagaaggatgatgaatccctccgttcgtacatacaacgcttttgtcaggtccgtaacaccattccgtgcattccagcccacgcggttgtatatgcgttccgaaacagcgtgcgacataatcgcatgttggagaagatcacctccaaggagcccaagaccaccactgagctcttcgagctggcagacaaggtggccaggaaggaggaagcgtgggcctggaactctcctggcaccggtgcagcggccgcagccacccccgagtctgccccccgctctaagcggtgagataggagaggcaaaaggaaatcagtccgttccgatgacaagagacatgtccttgcggcggatgggcccacatgggccccacgcaaagggaaagctgccggcgacaagccgaaccctactgttccctccggagaggcccggtcggcggacaagtggtgctcggtgcacaacaccgaccgccacagtctcgccgactgccgctcggttaaaaatttggccgagcggttctgaaaggctgatgaggagaagcggcagggtcgacgggagggcaaagcccccacgacctcgaccggtgatcggcaagaggaagccaagaacaaggcccccgccgatgatggcggagacagtgaggatctggatttccagatacctcaaggggtcgtcgccacgcttgacgagggagcttgccctcacacctctcgccgaagcttcaaggccatgaggcgagagcttctggccgctgtccccacgcatgaggtggtccggaaggcacgttggtcggaggtgaagctcacattcgaccagaatgaccatcccacggtgctcgctcggcagggggggggagttggccctggtggtctccccaaccatccacaacgtcaagatgaagcgtgtgctggtggatggctgggccagtctgagcatcatctccccggctgcttttgacgcgctcaaagccccggggatgaagctccagccgtcgctcccgatcattggcgttactccggggcacacgtggccgcttggtcacgtagagtttccggtaacttttggcgattccgccaacttccgcaccgagcggatcgacttcaatgtggcagatctcaatccgccctacaacgcggttctgggtaggcctgcgttgctgaagttcatggccgccacccattacgcctatctccagatgaagatgccaggtcccgctggccccatcaccatttttggtgatgtcaaggttgctctcacctacgcagagcagcgtgcggacaacctggcggtggccacgggaccacaggcccctgaggcatctgcgtctcacgcttctaagaagcgcatcacctcggctgacgaggtgcccgtcaaggaaatcccccttcgcgacgacccgtccaagaccgccaagatcagcgggaccttggacgctaaataggaaggcgcgttcgtctccttcctgcgggcaaattctgtcgtttttgcatggaaaccgtcggatatgcccggggtccccagggaggtgatcgagcaccgccttgccgtgtggccggatgtgcgacctgtccggcagaaggtgcggtgtcaagccccggagcggcaggccttcatcagggaggaagtggcgcggctcttggaggctgacttcattcgtgaggtgatccacccggaatggctggcgaacccggtggtcgtcccgaaggccaacggcaagctacggatgtgcatcgactacaccgacctcagcaaggcatgccctaaagatcccttccctctgccacgcatagatcaaatagtcgactccaccgcggggtgcgaccttttgtgttttctagatgcatactctgggtatcatcagattcgtatggctagggaagatgaggaaaaaactgcttttattactcctgtgggtgctttttgttatacaaccatgccttttgggttgaagaatgcaggccctacttttcagcgcatgactcgtattactttaagtaatcagatagggcgcaatgtagaggcgtatgtcgatgacctagtgataaagacgtgccaccagaacacgttgctgcaggacctggctgaaacttttgatagcctcaggtccacgcacgtaaagctgaaccccgataagtgtgtgttcggcgtgccggcgggcaaacttctcagttttctagtctcttcccaaggcatagaagcaaattctgagaaaatacgtgcaatagagaggatgcgcccccccagcaagcttagggatgtgcagtgcgtcactggatgcatggccgccctgagtcggtttatattgaggctgggtgagagggcgctgcccctgttcaaactcctcaagcgctccgagccgtttgtatggacagaggaagctgagcaagctctcgatcagctgaaggcttacctcacttcccctcccatctaggtagccccagggctagaggaacccttgctactctacttggcagcgactccccatgtggtgagtgccgccctagtggttgagcgtagggaaggcgaacaggagggccctccgacttgcgatggccccttgactctcgaggaaatagcaaccgaactctcctgcatccgggagggccccgaggcacccaagggaggagtgcagactttgatagatggccttaggctcgatgaccccgaggcggtccggggtcccctcgggacctccgaacaggtgcgccccgaatcaccagcccctgacagcacgatccggccccaccgaaaggtgcagcggcccatctacttcgtcagtgaggcactacgagatgcgaaaacccggtatccgcaggctcagaaaatgctttatgctgtcttgatggcctcgaggaagctacggcattactttcaagcacatcgggtttccgtagtgacgtcataccctcttggccagattttgcgcaaccgagagggtactggacgggtggtgaaatgggctatcgagctggctgagttcgatctgcacttcgaaccgtggcatgcgatcaagagtcaaatcctggctgacttcattgcggaatggaccccggtggacgaatcgattccatctaataccctcttcttccccggagaagaagaggatccaaacgccgacattcgtggcgggcactgggtgatgcatttcgacggctctctcaaccttcaaggtgtgggtgccggagtcacgctgacctcgccgaacggggatgtcctcaaatacgtcgtacgtctcgacttccgagccacgaacaacatggcaaaatatgaagggctcctcgcaggattgagggcggcggccggaatgggcatccgccgtctcctggttttaggcgactcccagctggtcgtaaatcaagtatccaaagaatatcagtgcaccgacccgcaaatggaagcatacgttcgagaggtacggcgcatggaacgccacttcaacggagtagagctccagcacgtgccccgacgcaacaacacagttgctaacgagttgtcgcgtgttgcgtcggcacgaaccccactccccccaggaactttcgaggaaaggctcgcacagccctcagcacgacccagccctttgaaggaccccaatgatgcgcccttcgacccaacctctggcgacccgcgtcaggtcacgtggatgaccgacatccgggcgtatctcgatggtaatactcttcccgaggaccgcgcagaagctgaaaagctcgcgcgtatctctaagaggtacatccttgtagagggggccctctaccggcgtgccgccaacgggatactcctgaagtgcattcctcgagagcggggcatcgagctcatagctgacgcccattagggtgagtacggagcccactcggcctcacgaactttggtcggaaaagcattccagcaaggtttttattggccgaccgcattgcaagacgtccaagaatgagtccagcggtgcaaggcatgccagttccatgccaagcagacccaccagccggcccaggccctacaggtcattccgttatcttggcctttcgcagtctgggggctagatatccttggaccgttcaaggcggctcgaggtgggtaccagcacttgtacgtcgccattgacaaatcactaagtggcccgaagcctacccagtcgtcaaaatcgacaagcattctgctcttaagttcatcaggggcatcacgtctcgattcggagtgcctaaccgtatcattacagacaacggtacccagttcaccaatgaggtgtttggcgattactgtgatgacatgggcatcaaattgtgcgttgcctcacccgcccaccccaagagcaacggctaagtcgagcgagccaacgccaaaatcctcaaaggactcaagaccaagacgtacaacgtcctcaagaagcacggggattcatggcttgaggagttgcccgccgtgttgtgggcaaatcggaccactccaagccgtgctacaggggaaacaccttttttcctggtgtacggcgccgaagcggtcctaccctccgagctttccctgggttcgcctcgtgtcgctctgtacaacgaggccaaccaagatgactttcgccgcgacgatctcgattctcttgaagaacggagaaggcgggtggccttgcgcgccgcccgctaccaacaaagcctgcgacgctaccatcagcgccatgtccgggcccgatcactataagttggcgacctcgtcctacgccgtgttcagtcgcgtctagggctgagcaagctctcgccaatgtgggaaggaccatacaaagtgatcggcgtgccccgaccaggttgcgttcggttaaccacggaggacggcacagagctgcccaacccctggaatatcgaacacctccgtcgcttctatccatgaaatcgagattttttttttcctggagctcaggccagcacccgcacaatccctcggtttgtacggaactggccgggggctgccactatgtatcatgttttcctttgaaagcaataaccttctttctatttcttcgcaaagactgctttttcccctttccctctggcttgtcccaactcaaaaattaatctgcgtttgttctaaaacctaagtgctataaagcgaccgggacaccccggaaagggagcacgaacgcgggccatgccccggactgtgccgaaccccgcggggccggaagggcctacacacgatcatccccgacccccggtcgtcgcagcctcggtccggccagtcccgctgggcgactccctcagagcgatggtcttgcttatcgctacttaggttccgtggaccgaacgcgggtctaccttcttgatggaacaagcccgagggggggatggagtcaaacgatatatcaatcgcagactgtctaattatccctttctgccttggctttttctttttactatgtaacaggtattcgatggaaaaggcaaaaaagtgaaagggtttaaagagttttcaattgcagaacaagacaggatgacctaaatacaagaagtgcttgttataggcacacagcaaaaaggaataaaaggtgtgagcaatcacggagtgcccggtcccccgagactggcgccgctaacaatgtcgtcccagtcgtcgccaccgtcgtcgttctcgcttccgctctcctcgtccgaaatgtgtccggaggtgaaccggggggccgacccctcgaagcttgaaacgatagcgtcggccgcctcccggacttgctcccgggcccgtgcttcggtccctgggggaaaatcctcaagcgcacgccacggcatgaagtcagggtcacgcgcttggtggctcgcaaggaccagctccactgcagcccgcgccaaagaggccgacgaagtctttatggtttcaccgacctcctcctctaacctctccaggtttgcagccagcccgtctagccgaagcgcgagtgccggctatgtgggcgggagtttgctgtcccggcgcacggagatgccgactcgacggcccgcgcgctccagccgatcgagtgcgtcagagagctccccgggcccaagctcgttggtgaggcggagagccgcgatctccctagcctgatcctacgccaggcactccaagtcggcgagggtgctctgagccgtggcaagttggctggccaactccgcgccaccggacggcccgctcgctgccaagtctttctcccgggcctccagttcagaggtctttgccgctatcgccgcgcgctcggcgcgggcgctctctagatgacgagcttcgcgcccggcaacagcctcctcgcatctcgcgagttgctcgctcagccagcgcgaggctatctcgcggcggctcacttcagcttcacgctcggcaagcgcggcatcccgttcccggcatgcctcctctcgcagccgtagttcttccgcgtggcgatctgcgtaagctttcgcggcaagggtgatctggtcacgctcggacgcggcctcttcacagaggcgaagggaagcctcgacctccatcgctgttctctcgtgagcggccagggtggactcccactggtctagcaggcgtgctcgctcctccagctcctgggcccgccgtgcctgttctgcaccgcgcgcattttgctcgcgctgatttcgatcgagaacttcgatccgccgacggatcgtggcttcaaactactgcgcggagcgagcacgatcatccaaggctttgcgctcagcctcgagcgccatcgtccgagcctgcagagaggcattagcctctgacacccgccgctcttgggcggcagctgagtcgaggatgccacgggcgtcccggatcctcttctccagtggagtcggcggcggcgagtacctgcagaagcggatccatgctcgccggagtcggggaggaaaaggccgcggtccgcccccgggacaacggggtactgctagatcctccacgagaccgggggctgctctcggccccccttccgcgagaccagccccgagggtgccccaagcgccaggaggaacggctgttcctcttaccccccgcttcggggcctcgggtggattcggcctcggcctcagcctctggttccgggccgccctcggcctcagcctcggcctcggactcaggaccgccctcagcctcagcctcgggctcgaggccactcctggtttcagcgcttgggccacgtcctccttcgccccctgattttaggggacgctccacgtgggctccggtcccggggccgccctcgggaggagcgtcaccacccctatcgcccacggcagattgggtcccgcctgagggccgctcggggtcgggcccagggtgtgacttctaggccccaccgcgaggctgcgaagaccccgcggccttagattggccgagcccagactgcccgtgcgaggggttagaccctgggattccctgggaaggaatctcactacaaaggaacccagatcatgttagcaaaagaaaatgaagagacaagagcaccaaggtgagcgccaacgttcgtacctacggggagggcggttgaaggtccacttcgggggctcgatgaagcttccccggcatggctccgtctaccctatcttccagagccgcttctttttccgaccagcatcaggctcggctagtcgcttgtggcatgatcgcgaacggtctattgcacgctcagcgcccccccctcccccgcgcgggggagagggcggacgggagtaggccaccttccgcttcccctttgggtcgctggcgggatcgcctccaggtccgcggctcgatccgggcgcccttgagtcaccgccaactaggccgctggcccgcccccccccctgctgacggcgctgccaccggcaccgcctcggctggaccggctcctgccggcaccaatggcggacatcacagccaggatgctctcccggtcgcggtcgcagcagaggggaagaatcccgtcagggattagtgttggctcggcggagtccaggcccagcaccccccgaatcaccctctttgcgtcttcctcgccccagtcccagcgctcgcccacatgggtccgcatggggtcgttgggaccggtgtattcccacgctccacgggatcgttcctgaagaggtgcgatgcggcgacggaagtaatcgccaaagaccatcgcccctgtgaggcccaggctccacaggcccctaaggcgatcccacactgcgtcatattcctcacctagctccgacgttgccagccatgcggcagacctttcgggagggccagcgggaactcgaagtcgcggatggtccggcaaggcggtgtagaaccagtccttcttccaatcctcccatttcttgcggaggtggctctcgatgtattggcccgctgtgcccggtcggggctggaaatagcatccccccaccactacgccttgcagcagctgcgggatgaagaaggcttggaacagccgcatcgtcggtcgcaccccaatgaacatctcgtacaaatgcgtgaagatggccagcgtcatcacggcattaggcgcgagatgcaaggcgtgaatctcgtagaaatccaggacttcatggaagaatttggagaacggcgggatcaagcccaccatggcaaaggacaagaggtgtacggatcgctccaaatatcgcggccgtggcagcgactctccctcccgcacgacggcctcttccggcataatcttgcgaggaaggctaaggtgcttgtctaccgtgatgcgggaggaaaggagcactgcgtcgccggcgtcttgggccatagcaactggcggagagatggcacaggatgaggggtctaagacaatgtgaggaggcgggagtgttagggctcgagaggcgaaaggatgagtgagcaattggcgaaaggaagaaggcagagtttccttctccgcccccttctatcctcgcctcatccgcgttcgcctcctcgtttcgtgcccccataactgccctcacgatcttcgcgcccgcgtctgcctctccgcatctcgcgcccaatcattgcgtcgcccgttgcgtccacctccgccttttgtgcgcctgtcagtgacgcgctcgaggtggagtgtgcaacggccataagcgcaattggacaaactgtcaccacttccgtcgcgggtgtagcgggcgagagaatcaaggcgcggtttgagtgatcccccggttatcgcgccccaagcatctttgtcatgagcgcagtctaaggcggtcaaattactgccgtggtaagtgcgctaacctagccaccccaaaatttctttcaaaatccctggcgggcccacaaccccaatttgaagaatcatgaagcgccatgtcaggacaatcctgggaagatcaacacctgatacggcgccaggggctactgtcggagatatgggcccgggggtatgtgaggtaaaggagaattactcttcctccgaccacgtggcttggccggatagccccactcacacgccacgcgtatcataaaagcagcagggggggcctcggggtacgatgtcgccccctcggggtatggcatcgccccctggagccctaccgcaccttcgccccgaggccctcgcctggccgccacgcggcagaggggagcataggctgaacagccgtaaatgcacagcgccccaactgtccctcgcagggcagacgtgcggcgcgtctggctaacccctgctagtcggatgtgactggtctgtaaccggcccgtttccgtcacatccgatggatagggtaatcatatcatcacgtcacccttgaccccggcggagtgggggtaggtgtgacccgtcacatccgggtgatgctcgaggaagggctgttgcatgtcttcgatcatttatgagggaatgaccgggctgaccaccgtgtcaggcgggggacggcgccgggttccactcaaggatcggttatggcttagcttccgagagaaggcacgtcttgaaggccaaaaaggtgaagtggggtctttcccccccccccctttccccggtgagagtaggtagaatcggcgcatgtggtatccccttaaaactataaaaggaggaccctgcccacagtgcaagggtgtggaaccagagaaaacccaaacttcggaagagaggaggcaagagtgctctccgaagaaaaggaacccttgtaacttcatccataatcccaaacacaggagtagggtgttaagctctattgcggcccgaacctgtataatccgtttgtgtactagctcactgagtcttagggacgagcaaacgaattccgagggacgagcctccgcccccggccgaactcacgaaaggggggtctcacgactccctgttattgagggttctccctcgacagtaatctatccattcaaccagttaaaaacctctaaatttttctattaagcatggctttttatcctctattttttttctattaagcattgactttgatgtatgacagtatgaggtggtgacggatcaactcaattccattctacaaaccaaataaaaccaatatacaatcgagcaatcaattcacccatcctatttctcaacccaaacataatctataagtgataatgtcctaagatcaagaatgtatttcagttgcagactttcagtacaccacaaagtgctgcgaaaataatggggccagcactgggggcatgtacaatacaactaccttcatgtatatatgcagagagatctgaagtggtgtggagtaatgtgtgggttaaaagtggcggccgggcgcatatatcataccgggcgtgcatgcgcaaaactgaaagtatgcatactcttgcatatatgctgcaccttcttcccaattgctgccaaattgcatgcatgccgacatcgagcaattctttctcttttcttttcttttcttttttccctctctgcatcttcctctttccaatacgccgaggattgtctttctaggcgtgcactagtgcgtccatggaagcactatctactgtgcctggtatatactagtacaataatgtgctaccacaggagatccaactccaactacaactggtggaactttcattcattcatatctgcatgcatcttcatgcttagctttcttgtgaatttttgagcatatatattcaggcatttatccattgcttgggcatgcaattggcaattgggatagaaggtggttgcttgatgctaattggcatcatagcccagtgcccccagtggtgccagccatggtggtggtggtgcccatcgattaggagagaaaagaaaatggaagagaaaggatacatagttgtttttgtttgttgcaagtacctgacaggcagggcacaatgagtactgatgagcccatgatgcagggcctggattggccagttcctgcaaaatcaacatagaaaaatgcaacatccaacagcataggccgtgtttatttccttctccaaaaattttttatgtatacggacacatattttaagtattaaacatagactaataacaaaacaaattataaattcctcctgtaaactgcgcagataaatttattaagcctaattaatccgtcattagcaaatgttagctgtagcatcacattgtcaaatcatggcgtaattaggctcaaaagattcgtctcacaatttacatgtaaactgtacaattagttttttttcatatttaatgctctatgtatgtgcctaaatattttatgtgacgaaatttttagatgtttgaagggaacacatccatatagcgcctctctgcagcaatctctgcatgcgaactttcaaaggcaggagacgtgctcacctgccattatgctacgagacaaactcaacaagcagagcaggagaggatagctaggttaggtgcccactagatagattttcgatcgaaaaggcgatggatgcatgattgcggcgagtggcagcgactgttggtgcctctgccatctggagcggcaaggcggcgacacaggggtgaggcggcgatcattgtggctctccccggagggggcagcccacgcataatccaaaatcctctcttgatctcatgtcactagctaacctaagtttttttttggatttgcacaacccccctagtgctagttatctcctttctttggagaaaaaatgaaaagaaggttgcacggcactagatacattttgaggtgctgtttggaacatagtcatccaatccatatcttcaatatagatgttcttagagattgaaaactggtgcatacattgcgttgttcttgtcttcgatgagattttaagtgaaattgttgctatggctataatgactcaggtcatgatattaatgggttctgatgaaaaaaatatgaccaaacaactgcatggtgatcaatacaaagagtcaatctaacttacagtgctgcggcatatgtagcacaagccattaaatggttttgtccgatatcatggatgttttgtccttttaaagtattaattactatacgcatgagaatcgattaaaatatgagcatcattgatttttttttttttttgtttgtgatgttaatatggtattttactgaagcactcgatgtgggttgtttcagttggggtgactcaccatcatgatgctaagaggaaaatgctttgacctgattgggggttaatgatggctattattaaagagataataaggtcttggtcagaagggcttagtggaaatgggaagccaatggataggggttaactcagaagtgggagttgtgcccaagtttggctctgccaatgtggccaagaacggctatatgtgctataacattgctttttcactttaatttcttttagttgacacgagatcatgggctgtagggtagtctcatggaaagagctagtgtatgtcttcatttcactgaacaatttggcatgtgcacttatatgtaatcttaactttagaacaaaatcaatggcatatataacctgttacacaacacacgcaacccatcagtatggtcttttgactagtcattggatgaatattacaggtgacagatgcaatagccacaataatgcaattaatatgtccaagaattgcctatatctaacaaattctactttgggttaagccaataattattcatattagcgatattaagatccatagcatatacaaataattgtaatagagggcttggatatttcaatacagggcatatgttgtgtggtgtgttttgttttgacgatgataaactgcctatggaaaatgcactatcaatttcagaaagtatgttttctacacctagctatatgcatgtgattcaaattattgcatagaaattcgaccaaatttctggtaagaaatgaaaacccaaaactattatcaggtgcatatattatcttaaaagcttcctgtatattctgacatactattctttttcttttgcaatagctttgttatatatctagaaataaaaatatatgtatatatgattgattgtaccttaaaaagagacaatctgttttctacaatactctcctagtctcctccatatactctctttgaactaatatatggcgccattgactttttaacaaacatttgactattcatcttatttaatttttttgcaaatataaaaatatttaagtcatgcttgaaaaatatttgatgataaatcaagtcaaaataaaataaataataattacatttttttaataagagaaatggttagaaaaacagagtatgttcagggaaggaggcagtgtatataccttcacctggagatagagatgaagagctagtaggagcgtatagtacggatctttttgcatgtgtatacatggtgatgtgttaattaatcgaaagaaaaaccacacgttgggagtggattggccttgtgtgcacattccattcgcagagacggcagcggccggtgcagcactgggatggatggatcgacctggtggtggctgctgggtgcttctgttatgcgcgcgcgtgctcaagtgcatgaaacccccgcactcgcgccgcgatcgacttggatttacacaacatctgcacgcgcgcgcggaggtgctcatccagccggtgatactctgcgacctgccctgcatgtgttccctagctgtcactactagaaaaatcattttaccagatggtcaaaaacagttttcacaagtgaaggaaaggactgcctagacgcaaaggcctgcaaaaatagttgaattttgcaggcggcatcaccatcttcgcagacggtagattcacccgccatcaaaaacacatttcagcgaataaaaaaaagccgtaccacccacgagcgccaccgcgggcctccccctccgaccgatggctctcctccatccgccaccgcccctacaggcgtcatccttgtcgcagcatttttcgttgtcgtcgtcgcgtcagcgctgtcgtcgtcgcgttgatgccatcgtcgcggcggttgttgtcgtcattgtcgtcgcgtcggcgccaccgtcgtcgcgcgtctcctccccctacccacaggcggcgccgtcgtcgtcacacgtcgccgggagaggaaggagccaagtcgccgtcgctgagagaggccggatccgcgcgcccgggctagctggcggcggatccataggcgtcggtgccatccgttacagctggtggcggaggcggcgagctgcaggggatccacactcccagggcgagccagcggtggatccccaggcatcggcgccatcatggccggcagcggaggcggcgccgcggccggcaactgaggcagcgacgagctgagcctgcggtggatttgtgctatgaacaaatgagagagagatagagaggatggggagggaaatgagtggtggggagagaataaggatggtggagaagaagataaggatgaaacttagatatttttcttggtagcatgatttttgcaggcgcactatataaggtaatccctcatgtcataaatatttaacatttagggtaaaatttctgtcaagctttcaaggctttatctgttaattttatgtaagaacaaatttaaaaaaaatagtaagtttacgatattatcacctcggatgttgtggaacttgactcccatgtcactctctagagagatttaggagaggcaactgcccctaaactcccacactccaccccaagacctccacaacttgacacttctagtgatgggcgatggtgccttccaccctcctccatcttcaccttattgttttctctttcctcctccatttcccttcctcattttttaccccgctctagaatcaagtagggtgttggcggtcgaagtacaattcgttgcacaagggcttcccagcaaagctacatgaagaggttggacaaacgatggttgttcggcggtactgacagtactacgcggaatcacagaaacactctatgtgggataacaccatgtggtggcatgggctagtgggatgacactctatgccggggttgttgccactcttcgctcattccacttcctccatgaagctcttcctcttctaaggttggtctgcttccagcagggttggaaatttctgtcatttcggtcccctccgatacgatattacttcggccgaaatttttcaattttttcatgaatttgggtaatatttgttcaaattcaactaaattttgttcaaattttcgaaaattttggaccgaaattttcaaaatttcgggatttcggtgacccccgatcaaaagccctaagccgatatagtgaaccctggcttccagatctggatgtggggagctccgtgacatggtacggtggtggatgtcagcttggacaagaatagtcaaacatttacatcagtggtttagcgactagtggctaggaacaaacctggcccctagtgcgcaaatagtgtcaagtggtgtggctacacaacaattagtaagggatatgttgtttcattctatgattgtgcatggttgcaaatgatgccttgtgttgggtgtgacctgctacgaggagtcggagttgttgcattggtcattgagcttggcaacaatgacatttgtgaagccaatgttgttgtggtgatatagaagctgtggtcgtggttgttaatgctcttctagcatggtgttgacagtggtggccatgttaaccaacatggggtgtgagacaaaaaattggtgactttcctcatgggtttggtggttgggtaagcgttttagacaaaagcattgtttggcttgttggtaccagtatgatttttgtaggcactgttcatctcattggacacgttgctatggcgtttttacctccttccgacttaggggagttgtttgggtgtgtacctagatctattttagatcacaaaatgtcattttgttggagttttctacttacatgtatcaccttggcccatcccgattcgcttgcttagggtatttggtgatgtgcgggagaaacccgtgacatcttttgatggagttggtgttttcatttgttggtggaggttttcgttaattaatcatgctactagtaagttttttttcctaattttccttatgaactctatagtgaaatgcattaactttctgcccttttataaaagattctttgataaagataataactttccaggcaaatatatgcatgatgtttttgttttatgaaaaattagcatttgagaggctactgatggtcaaaggcttgaaaagtttaaccgaatcatttgtgaacgccaaatatttacgaccaaggagatcagcagttaccaaaagttaagaaacaatttgagagagagagagagagtgtgtgtgtataaccaagacaatctttcatctgatgttaatgccataatgtagctaagagcaaggttaacagtatagccaactactagctccaaaccatttatagccaatttaatagccaactcatacaatagttgtttactatactattaatacatggtcccacctgtcatacacacattacgtcttagagtccgtgctgcagctgactacatatctgttgcctactgctcttctctctcctattttaactttttaaaatatatttacagctggcttatagtctgcttattgtacctgctctaaggagctcttcagttaatccgagacgcagaagcagaagctggtcaggtcagaaaagaagctctatgggactgggctactcaaccttgagtaagctaagagatttcgaggcagaggatctgaacactgcggtcgccatcatgccgcatgcgactccttta

SEQ ID NO: 8643 - DNA, 4864 bp, Oryza sativa
aaatattactatatttatctacaaacctagttaaacttgaagtagcttgattttaaccaaagttgaaatgacttataatctaaaacgatggagtacctgtatattaattattactatcatgcgtgcatcacaaagagtttgtgttatcgttgactgtcaaaataaagcaaaaatttcagatagaggtcccaggacaatgcctacaaatgtagaaacttataatttcagtaatcggagtactaaattgagtaattaacaagatatataggtgtctctttcaatctatgcattttgttgccatgtgagagatgatgtgctttgcctaattttctggtgatgtgaaagtgtgttgcaccggggagcaagcaagtaccaggagatcgctctcattgatacaaagcattttggcaaggtatctgtccatttctgcctctcttttttctttcttttttttaaaaaaaaagaaacacagaagtcctatatatcatttctattcttgtttcgtaacaccaacttgtgtggtgtaatttagtactcccttcgttttaaaatatattaacctaatactagttagaaaaatatattttagtactagtttgctatttttaaaaatgaagagagtaagtaactagaacactgatatgacaccctttttctaccaggctctaataatcgatgggaacaccctttttctaccaggctctaataatcgatgggaagatgcagagtacagaggtggacgagttcatctaccatgagtccctcatacaccctcccctcctcttccatcccaagtacgttaaattaccatcgcgcaatcaatgatctcacagctgcttccttcatctcgaaatatattaacgactacctcctattctagtcaaacactaatccagattctttagacatgtaagtatatataataaaatagattctaatctctcgaggtgagtacgtgcagcccaaagacggtgttcatcatgggaggcggcgagggttccgcggcgagggaggtgctccggcacaacaccgtccacagggtcgtcatgtgcgacatcgaccaggtactcgatgatcgatctagattgcaccgttgattgatatatatgcagtactacctccgtttcagattataagattttatatgtctagattcattaacatatatatatatatatatatatatatatatatatatatatatatatatatatatatatatatatatatatatatatatatatatatatgaatgtgaacaatactagaaagtcttataatataaaaacggaggaagtaatagattcttaaattaaactgttgttttgtttctctgaatgaacgcatatgcgtgggtgcgtgatgataattatattaagcaggaggtggtggacttctgccggacgtacctgaccgtcaactgggacgccttcgccagcgacaagctctgcctcatcatcaacgacgccaggtatgtaccaaatcatatatagaaggtggtcaggtggacatactagtgttctctattaaagatgacgataaaattagagtatgaaacaaactattaacatgtgattaattgagttttaaatattataaagttgaaaaatagatttatctgatattttaaaataatttctacgtataaagttttcgtacaaaatataccacttaacaatttaaaagcgtgttaatgaaaatcgagataaaatctgtatcttaatctggaaaaaagaacgaccatattaatgctgcaaactgaaaatgaatcagcatcatgtattcatgtgtatgtatgttttcttgatcggtgtgtgcttatatgcatttgcatgcagggcggagctggagaagagtagggagaagttcgacgtgatagtgggagacttggctgacccagtggaggggggcccctgctaccagctctacaccaagtcattctaccaacacatcgtcaagcccaagctcaacgaccgcggcgtcttcgtcacccaggtacgtatataatttttcatcaactctttgcctagttatttgactgaactctgaacttctctgaaattttagcgtttttactgacagttgttttggctgttgacaggcagggcagccggcgttctgacccacaaggaggtcttctcctccatctacaacaccctcaggcatgtcttcaagtgtgagtagcccagcaattaaagactcccttaattatattttttgctatatgcatggggtgattttgtttttgtgattctgatgatgcatttgttaatcatatcataccacagatgtcaaagcatacactgctcatgtgccatcctttgctgacacctggggctgggtcatggtatgtagctagccaccttattacaatattacttactgaaaagttcagttccctttctattctttttagatggttttcctttctgctagcatcaattaattaatccgttgctattcttcttcctattattccttttgtatgtaggcatcagattatccatttagcatgaatgctcagcaaatcaatgagaggatcaaggagaggatagatggggagctggtgtacttgagtggggagtccctcatttcctctaccatattgaacaagagcgtttaccagtcgtaagtaactatcagtaaagatcactgtaaaaaaaaactactatacttattttcagcaacacgtgaaagatgcaggtggcatcgatgcttaagtgaaaagatattcagaacattgcactgactgaactgtaatttcttttctttttccttgaaaaaataatactcgcaggctgttgaatgagacgcatgtgtacaccgaggatgatgcaaggttcatctacggacatggaagggcacgttgtgcttgaatcccatatcttacacgcataaacacctgagcaaaatggtgataaattagtagctattttccaacttaagaggtcgagatgcacaagtgtggatagcaagtctgaaattgatcagttagctactagatctccagatcaaccgatcgagaacagaaaaaagaacaagtgatcgatgcaactttgtgaagaacttttttcgcctttgttttcctacgtgaggcgaggaaagaactgaaaaagaactagaatggaataaaaactatataatgctctccatgcatgtgcatgtttcactctttttgttcagcgtaaatgaatggtagctctcttgacaagcagaccgcatatatctatctggtggcatgattgttaacttttgggaattgggagaagagatgactttttggagattgaacctgttcactgctaggctgtacaagagggtaagaaaagactgaaaaggtcttgatacattaacacacatatatattaggctgcgtttggcagggcagagagaaatggagccatcgtttcgcttattcgcggaataagcgaaacgacatatttgcaaacgaaaaataatttgtgaataaaacttttatatacgtgttcttagcgatctaaaagcgaaggctgaaaaataaacttcgataaaaaaaaaccttaaaatcagcttcgtatttaaggttgaaaatttaagatttggctgataagtataagaataagcgaaaatatgaggcccaaaaactcttttgtatttcacgcacacactacctgaactgttaaatgatatttttaaaaaatatatacatataaaagatgttttgagaaatcacattaatctatttttcaagttaaaaatagttaatactcaattaatcacaataatggttcatcttgttttacctatcttctcaagcttcttctttcccccactctcaaacacacacacccaaatacaatgtacttaaatacaatgtgtgtacagtaacattgcatttgaagctacaactatataaatccaaactcgttccttttgcacgattttaatagtgaatcagatttggctcctatatgaattcaaaatggactttttcttccaagcaagaaactccctgaccgggccgtacaaaccccaacctattttgatccagccgcgcgcgtactcccccttcacgcggttttcccttgccgaggccgaccgacctcaacccctcccaccgcccagccgcccgcacccgcgacagccgtgtgatgcgatgcgatgcgctgcgagcctgcgacacgggccacgacgtacgtgtgtctccgtgatgccatgcagatcgatgcattcccccgtacgccgccgacattagctgtccgcgagccgcaacgcgcgaccctgtagtagtggtacgtgtctaattgcagaatgcagacccaagctttggccccccacgcgaccgacgcgtcccgatcaaaagttgatgtcaagtacaaacaacaaatcaacagaatatatataaatttacgtatacaaattaacgacgaactatatgtttgtagtatatatatatatatatatatatatatatatatatatatatatatatatatatatatatatatatatatatggtttaatttaatcgtaaccatgtcctagtgtactgtttagttacatgtaattagtgtgtgtctagttgggcttccggcagttgagcctgacctccaccggcgtcccggcggccggcgcgaggttccccatcttcaccatcgccttggcgaagtccctcgcgaacttcgccccgttgccggcgtacttccgcaccagcgcgtcctgcgacgacgacctgccgccgccgccggcggcgaacagctcctggtccgagtgcagcagcccgcgctgcttcgtcagctcgcggaagtagccgttgtcgaacacgtcgggcgtctcggcgtccagcggcgcgaggttgccgtctccgcccgtgcccgcggggcac

SEQ ID NO: 8644 - DNA, 3839 bp, Oryza sativa
cgcgtccaccacctcgaacccgcgcgcggagccggcgttcgcgccggcgcccttctccccggtgaaccccggcggcgcgtcgtcgagcaggacggacccgtcgcagccgttcacgaagcagtcgtggaagaagagcctgagcacggacgcgcccatgcgccggtccgccgccaccgcccgcgccatcaccgaccgaacgacggactccacggcggggcacgtcttagcatagtacctcgtcgacaaaccctccgccacgccgacgccgccaaagccgccatggcaggagacggcgacgagcagaagggcaccgagcaagaagaccctccggcccgaagcagacattgccgccattgtcgcggagaacttggcgtgccgcgtcggggtggcgcgcggcggcgacgatcgaggtggtggtatttgtagtggcgggaaagcatttattgtaggggggcatgggaggagggaaggaggcagctggccatggctgcggtcggttgaccgcacgcggaatgggtcgcgtcgtgggctgctcttgtgctcggtttatcgatggatggatcgatctggcgtccgacgcgagcgagccaagctgctgacctacataggagtgtacatgttgatgaggtgtggtgtagtaatgacttggggttgggacgtgaacgtgacgagctgagctaaggctaagagatcgggtggtgttttctttgcttctactccatttccggctctatctgcttttgtcgtagtagtaacaagttagcactagtgctgctgttgcgttttccttgtggcgactcatcaagtgtaggttcgagcgaacacatgccgtgtgccagtgccaatcaactatgtttgagcatctccatctgacttcttcaaatatctatttaactagcttgctaaaaaatagagagttaaatttacctttcacgtcaacaacctttctattacacttttcaatttaacaacatctatgtgcttcttcctccttctctccctacccatcccatccacctctctccacgtttgggcaggcacagcgacgacgacagacactagggtactagccaagaggtggggcgattgcaacaccggcgagccgactaatgggggtcaccaccgttggtggatgggccatcctcatcaaacagttagatcctcgcctccccccccctagggttgccgatttggcaccttgcgccaactgctactccgttatcgtcctttgctccgcatttgaatatgggcaccgcgtcaatgggaaggtgaggcagacgcgccagagagtgaggtgtagttgatgaatggcgctagaggtatgttggtcgatgctaaaggtcaacaacaatgaaggattctggaggagagagagaaggaattaggaacgaagatgtatggggccacctgttactcagcgagtgtgcaattgtcagatttggccagccgaatggcttggccaaccggttggaggggctgttaaaggatttttttttgtacttattaaaatttagcttagagagctatttaactactcttttgaagatactctaacctccaaggcaacctcatttcaaaaaaaaaaacatccaaggcaaccgtggtctcttgcactagagatgaggcttagagcctatttgaggagcttaagattatgagatgtgagatgcagttggttggtagccaccttctgagaatcagcttatgagaatatggaaaagctgggtttcccagcttctgtcttctaatttattttctggattttataactacagcttcttaaaatttggaccaaaagctgaaccgtttagaggagcttttgatttttaggagaagctgcaccggctaaaagctctcaaaaggcccttaaatatggtcatggcatcgtcacgccatgtccaggtaaagtgggcttgtttggaccataaaactcgatcagtatttgggcctttggtcacggcctcatggagttacgtcatgggtcagccggtgcagaacggcaacatatgtagttggcagtttggcattcacaattgcacaagcccctgataatgtaggcgcaaacagagggtttgtttgtttgttgcagcagcctgtgaccgtgacgatcgatctcatattctcattattgcgttgcgcatgggattcgctcatgaacgaaccgatgaaccgtcgtggctggctgcgcagccgcagcgcgagcaagttccggcacgtacgacgcgccgacgtcgcgagaggctgcgcgcgagcgaaggtttcctcctcatccaccgatccacgacgacgactgtgctgctgtgcgcgcacgagacgagatggccggaaggcggccgatcgagctgtggctacgcgccgcgcagggggatggatggatggatgcctggatggtggcgttggcgcgccgaggcggagatatcccaagagttgatcatggcgtccgtattccgttggggctcgctcggtagtcgagacgcggtttacgcgcgcgaagctgttgcgccaaccgccaatatgcatcaatccgggcagccgcatacccgcgccggttttgctatcccggcccataaggcccacgcacgcgcgctagaattttttttccgctggcgccggtttttccgttttctcttctgttttttcttttcgtgttttcttttcttttttttgcgcttttttcatattatactttctttaatcttttagcacacgtgttttttatatgtattgagttgaaagttttaaaatattgacttgaaaattttcaaatctagcaaatttttaaatctcgagtgaaaattttcgaatctaagtcgaaaattttcaattttttcaaatctagacttgaaagttttcgaatctgctcatgggctttgcttggtcgactgcccgatctgctcatacctctctgattctcagtttgggtttgccctggctagctcgatacaattgggtctgtttggctgtccgtacctagatcaaccaagaccagactgaatagcatgagacgtccgttggctggtatagtgtaaattttttttagataatagaaatatataaaacccggcttctacaccgtgtatacagccacagtggtatagtgtaaatgctcctatgtatataaggtattatttggttggttctgaatcatatgtgtagttactttttcatttgattgtgaggttacctctttgacgtataatactattgttaagttttaagcattttaaattatagtaaccagtatagtggcccgcgctaacatcattatattttctcttatataataacatatatgttttctcaacgtattattccaatatattaaatgacaacataattttaaattttgtactaactttacgaaactactaatgtgtaatattcatattgtattttatatacgtgttggttattaattatttttaatatcaaattttagttatttgtaaattatattcctatattcctatatgttctttttttaattccaaattttcgttagctgtaaattgtatttctatatagactctaggctcttcttccaatattatttatttttaattctgaatttttattatttctaattggatttctatgtagactccaaactcatctttcaatattctttaatttttaattttgaatttcagttacttctaaattgtattcctatattgactttagacacttctttccatgtattttttttatttcaaattttagttatttgtaaattgtatttttatacgaactctaaactttacttttaattttattatgtttattccgaattttagttagttttaaattcatatatagactctatactctacttctaa
